United States Patent 8,781,750 (CELL-TYPE-SPECIFIC PATTERNS OF GENE EXPRESSION) - sequence listing, part 15

SEQ ID NO: 36404 - DNA, 90770 bp, Homo sapiens
aggcaactggtaaccacctcatttggggatgtttctgccttgctagcagtgccagagagaacttcatcattgtcacctcatcaaagactactttttcagacatctcctgtagggctagattcagagagcagcttctgatatttggagggtaagtgccagaaaagttactgtaatgttacatgtggagaatcaggactccagccacagtgacagataggcattgagtgttcgggggagggctttctgttgggatgttgctttttctcagctctagaaaatttgggaccagatactaagaaaaattcttcagtgggcattcttttttgggtggtgagatacagtagcaagttcccagggagaattattagaccttcttgaaatatttaaagaaaaggtagtcagtaatctgtgtgagggggcattctttagatgcagttttcctggaagctaggcatgtagtagagttgattgctagagattcctctatagtcttattcattggttcctgatatgccattaagagcatgtaaatgacaatttggccttttaatgtttataatgttaaggactttaaggcaaaagaggttttatgttataaatattttattgtaataattattataaatagaacctagtgtatgcagatatctttgaaatggagatagtcttgaatatagcatatccataattagctgtttgatattgaatgcaattgagttttcctgttctagtgaaacagacaatggaaatcattggggattaacaacaaggctatgtgattcttgatatagcaagcctttctttcccccagaaaatattttatcaatgaatgaagtactaaattaagatgcatacagttttaaatttttaaaaaatctatagaatttgtaaaataatccaaatgcttcccattgtattttcaccaactgaaatgatacttagatgtactgtttaatggtagacagtgatctccagactgtgggaggaaaaaacaatattttaataactatgttttaaaaattttcttagagttgcatttccctttgggtggttcaagaggactcagaaacaatttagaacattatcttaaaagtttaacaatgacagtttgtatagaatcactgtattttaataatactgtatgcttattagtgttattagagcagtagacagttaattacagccttttctgagacatgttaactatatattaacaaccatgttaaaaaagaatgatgtatactcttaacatacaagcggctgcttgcttgattctttaaaaaaaatcttttagaatgtatggagtcagggttttggttcagaattatgaaaggttttctactaaagcaacttaattttaaaacttttcactgggttataaaatttttctcctgtttttttttctttccagtgtcattagaaattattgctcctcagtggttttagtttttccaaattgtattttgagatacccatgttttcttgttttttgatgacttcggccaacataatccattaaaagcttatttaattgattttgctcctcttaatacttctttttgtggaataattttagtcactttttctttagccaaattgtgattacttaaaactctatataacctaatattctacatacatttcagcagttaatcacagaggtagttctaagattatttcattgtctaaatctcaaacctggattttcactatggcttctagaatggcaaaacaatgggttactgaaactagagggatttaaagctggacttaggcttacttagacaattctatcaaattggttaactatttgagttatcttggttgatttgaatttgtagatcttgtaacctcgtaatatggctcttaaaaacgcactagtattcccactttctgaagtttgtagaagctgctatatatttctgtaagtattaaactacaaaaaagtaagtaagtaataaggtatgtctgtgttatataaaacagaaagttcatagttagcattctgtgccttgtacgtattgagcactcattaaagaattgctaaattaatgataaaatataaaatgtagcttgtgccgataaagatttattggcaaagagaattttctttctaattttctgtttttactagggttatctgaacacttaatctgcacatgcctcattttctggataattggatgatttttttttttttttttttggtagcacctgggtctctgttctatcctcattgtctgaccttcagtattaggttaagtgtgcctgctcagcttcattctttggtgtttggttgtggtaacaaacaataccggagtcaaacagagcactcccctgagttccttgcaatttgagccaccaagtagccatccttctgatattccagaaccaaaaatattatggactagtgcctcaaggctgattgaccttctatgcgttctttcctacaataatgattgtttttcaggctcccattgaataaatactactgtaattattgcataaaaagatatttttcattgcagcttaaatacattgtttgaaaagtactctaagatttggagtgtttgtatatgaatattttactccattccttaaaactaattctgaaattgcagtagggttgtgttagctgcatccaaaatattctgaaaagttctaggcattctatgaaagttatctaaaaaagacacttccttttaaaatttattttcattttaaaatatgagtggggctgcttgtaagacagtcctatttagttacacaaaagacagaatttcttaagtggtgcactgctgtgtgacctattacattatcatgcacattctgtctctttaaaaacacagtctcctctatttgccctattaattgttgatatgttgccatccacgagacaaaaattagagctgtaattaaataatcatgtgatgctccttagtgccaatgagagcaaactcatttttccaggccctgatggtcactgattattgtattactactggcttgctttatttttttttaatgattctctatctgtagattacctaactactgtccttcttttcaaaattaaagaaagtagaaaacattcagccagttaattggctagaggtcctcagggacataaggtagacataccttttttgcttttggtcacctggtgggttctttggggaggctacatcagtggtgtggttgcctgccatttaatttacactggtgttttggctgggatggaggcatatggggaatgccaggagaattacaaaaggagccgggtattaaaattcagaaatgattaaaattgaaataaaaggatgctgcttctttgccagtactctggcagtcataatgacacatagagattagtttccaccttcatcttttccttctttctcatttcctcttgtttattgttgacacattttccttatgtctgtctcctgtctctgtatctttttgcaccattatgcattcctacttctccctctttctttaagcatggagaagcctacttaaccttattataacaataacagaataggttattaatatttaatatgcacatgattaaaatttctctcccttaaacataggtcagctgtattattactaaccggcatgtaatttttcatttaaaatattggtattctgccccatgccgtttctgaaatgcagtctactttagtagtgatttaatacacaacgtttagaaaattgtggtcggctagtgagaaaagaatttaccagtcatggataatcaattatgcatgaattcagatgtaacagatggaatctggtgagttaaagtttctctttgccttagcggttattttttttttttatttgtttgtttgacacctgtctcttatatagagataaacatctaacgtagcatgtgagaaatttccttatatttatattttctctttcaagtgaacttaatttttttaattgaagaaagagattttttatgtgatcttaaagatgatcagactctatccattcattttatagatacggaacctgatcctgcttaactaatgaaggatcactcagctagtgagtagagtaagaagcaagacccaaatctagtttctctatcttttctccactacttttcccactatgtgacttatgttcctttttgtgggagttacttaatagtaggggtattatactacctctgagttttaaaggctttctgatgaaaactgtggtagactagttttaaattgtggaatactctcttgtataacatgcaaatattatctgtgtacatataaaaatgttatgctatgtgtatattttatatatatatatatacttattcttacttggatgttggccaaacaattggatttttcaaatctattgagaatgccacaagatttggttttacatcctaaactgcggcatatgccagccttgaagatacatttacacttggttgcagtgttgtaaatttttagtgacaaaacccctttgcacaaagcgaaataaaaagttatttttgagagccttgttacctcaaagaagagatgagaggttaatttttattaaatataatgtgaatatgtagtgtttcttcaactgtaaaagtaatagaagaatagtggatattgacctttaaagcagtctagccttaaaacagaaagctggtttccatcaaaatttttcataaatgtgctatttgtttctctctcaagtgtatttatgtattaaataacacaaatgaaaagtctttgcaaaataaataaaaataaatgattaaaaaacagcctcaaggctctctagttcttttttaaagttctactgtggcattatttatcaactttttccttcatgttggctcaaaatgtccatgtatagtccatgctagttatctaataaatttttaaatgaacacattaataaagaaaaaggcacctacaagataggtaactggatatgccttaagcatagctatactgtgaagctgtcttttagtattttatttaatgcttttacacataataaatatatgtttgtaagttggtttcactttattagcattccttaattatgcgtataagaaaaaaatacagatacgaacttcaataaaatgatttatacatgaatttccaaatcattaaaaactccatcattaatacaagtttttaatataaaatccataggaatagatgatatgaaaactgaatgtggaacagtacaggaaaagatgatatttcaaattattatatgtagatatactttcatccttattactagcactaaaaaagtaactgagctgattaaatttgaaagcgtttttttaaacaaaattttcttttattaaaaaaatagaatctaaagtctttttatgtagacaatttgcaaattagtactttatacagttgttacaattgcagctgttctgcatatatgagcgtgacactcaaagtactgtgtaacagagaaaatctatttcatgcatatagttaatttttactgttttgaaaaacattccaaaagaattttttggacttaaggaactcctgtttgtttttgtctatgcgcctttctctttttttggctaagatattgtattgaataaaaccttaaaagagaaccattttcttacattgaaggaacctcaaagtgagtgggatcttggtctctaattaccaatccatgttaattatccttgggtcaggtattcatcatattaattgtgtagcatagactggactgtagctgttagcaggtaaggacaaagcaatgtaagattggggtggggatgggattgttcaatgtgatgtagctcattgtttctctgaggcttggcatgatattttcctggtattatatatctgccaatactaggcatacatgaaagattgttttgcttttgtttttttttttttgaaaatgtttatatggtaaaatatgtgttaaaaaatacgccattttgactgtttctaggtgtacaattcagtgacattaattacatacacactgttgtgcaaccatcaccacagtttgtttccaactctttttctatcagcccaaatacaatgtgctttagttttgaatttaatttctccttcacttcaacaaatttcaagtgttacagtagtatttaattattgtccaggtgtgaagcatttgtttctgatggtggctttccttccaacggacaatgcctcgtccagtgccttatggtggtgggcatagcagtacaatatcagatattgcctttggctgatgttgccacaaaaatgacctggacaaggattcaggaccattgttatcgcgaattctttctccctccaattaagctaggaaagattagaaataacattcatatcaactaaggaaatttggttgatatgtacatcttggttaaaagttgattgggaacagttgctgttcgatttcaccggaattaaaaattggaggattttacctcgagctttctgagaatattaaaggcacagcaactaggtctaggatgctttgcagttggctccttgacatggacagtctaaatactttggttctgttcaagtgcagtgacagtctggaaataagttgaacagttttcagcccttcaaagagaagcccactcaaggttgaacagttgtctgagagaaaaatcatgttatattgaaaaaagaattagaggaaacttggatggttctggctccagtaaataatagactggtttgagaactgtacttccatgtataattttgtggttagtcacttaatgtctatcatgataaataacatacctgcacaggatttctggcaccccagtaaatctcaaacaagtgcccaaatgctagtttattatggttcctcaaatagcatgtatttatttgccaaatcaatgatccagtagcttcctgcccccacttttattgcctttttagaaatttgaaacaagtagcttgcccacatatacatttctcaaattttggtctactgctggttcatacaacaggttagcttttccaagtgactccaggagtgagttaaaaaccacctcagagatgtcctgagtatttgattctctgtctctaaaacatcacctaacctggtagatgccaaacctggctgtatatgagaatcaccttgagagctttaaaaaactgaatgtcttctcctcatcctcagccattctgatttaattgcagtggggttcagcctggacatctggattgtgatctcagtacctggttttacgtcctaagactgtcaaagggaatgcagaaatatatacatgagtaaaccttcaagatgcttagagtcttgcagtttggagaggcagacatatagatagatatgaaatgtcacattgcattcaggcagtgtgatggagcatggagaaggaaataactaacaactggagaaggcttcggactgacaaggggaaatcaagctgcacgttaaagaagatagcagaaaggaggtcctcaagtgagaagggacatgaagggcactccacgagctacaggaaaaaaatgaggcatctttgtggactctagggcaatttcaagaatccttccttcttcttactcgattttggatctgggtccagataaaggtaccaattttggtggaattattaccaccgtgccctgtcaaataagtgatccatactgacatccatggaaggaaaggtagctaaaagatttttttccaatgaagttcccaatgaaacagtattgtttctgagtaaaaggcccagatatcctgtcggtttccagaagccagctgcaatggctgctcgttttccctctccagatctcccaaaacaaacataaacattgggttttttccccctcaactataatgacctttgtctattaaaactgtatcatgaattaccactctgtatttacatctatgccaagtaattagggaaataacttttgatcgctatcattctagctaaaactgaaactcaacttcttaggggaagaaaacaaaaccaaaaaatccttaaaccctatatttagagttcattatcatcactcctttaactcgcctgcaacattttgaagctttttgccattattctctgcagtgcatcattatttgttatctggatgccctcccagttcgagtaggtatctacattaatgcttccagagaggcatttctaagggtagctatgcttatataatataggtacaggggtaagggtgggaatgactgtgatttttaacttcacctatgagatacttaaatgttcacggaaagcagcttttggagtaaacacattacttaaaatgtattacagaaccctttcaagtacagacatgtctagaaagttcttaaatttgtatttagcagtatacaggtatcatttcctgcaactttacagatctacaggctaattctaaaatggaaaattatcttgactcagatgtcattggaatgtctgaaagccatttagcacctctaagactcctcctggccaggtcttggattcccttagttgtcttttaaaggagttctctagggtaagcactgtccaatggaactttctgcagtgaggaagtgttctgtaatctacactgtccgctattagagtattagtcacatggggctattgagcacctgaaatgtgaatgaggaattaaatcataaatttcatttaaattaattcaaatttaaatgatatagccaccttcttcaatgttccctcttcctacaatcactttaaaaaactgtcaatgcaatttgtagtggaaattggttgcaagtgacactgtgagcttttgttcccatttattcatttataatataaatattacaaggacactgtataaattcctagtaatatggcagtgagcaagacacccagtctctgctctcatagggcttacagtctagtaagggagacatgtattaagccagtaattacccaaattgttaattaattaagactgtgatgactgtttcaaaggagaaatacaagattctgtgagggtatataatgggggccagaacttcttgcataattagtcagagagtttaatcagagttctaattattaactagacaagaaaagcatgaggcagcttcctttccccaagttcaaggctgggtcaggttggctgcaggaggcacagctctcagagtagggcagctagcatgtgccatgccatgacctccaaagaagtgggatctgtttaagacgtaggatcttaatctgattaagctctgtgcatacaaatactgcaaacttctgaacttgaacaagtagattgtttcccaaactgtatgcagttgtaatgatgtcggtcacagataatatgtgagaagaagcgtgcaatgtttacaggatattgcatttcttctccaatatatattttgacaaagttgtttgggctgcagccccagcttcttcctccctgctctttcaaattggtatttggtccattcaggaaacgatgcagaaatcggtcctgacatcccagacagacaaaatgagacacatgacagcaaaacatatggctcagacacacatccttatatggccaacagagaaccatattcccagaaattcatatatggaaaacaccacctgcagctaaagccaaaaaacaaagagttgacacgacaaaaagagcaatatgctacataaattgtgctgctttaagagtgtagagatagccaactgtatttgaatttaaaaagatgaaaaaagaaaaaaaaacatgtccttagaaagtgttatggtggtaagcattgctttgctaacacagtcactggcggagttgctatatcttaaaagcactcgaattctaaatgctttctctgtttattacaaatgtatgtgctattcagaactctgaatgtgttttaatgcgttcggatatctgcctgcatatttatcttaatacattgccatctgaaacatgcagtagtcctttcattaagtttttaaaaattttgtgtgtagccaggataatgccttctcatgtgatagaaaattgatgcactctgttttaaatgtgcatccacatgttaaatagttcatgtatttgaattgcaatattttatgttcctgaggttttctattttgatggccagacttataaagtttaactttcttcaatacttgcatgcatcattattgcttaatataagatccctgtattgaagttttttcctcctgccgtgatagtttatgttcacatatgcctaggaaggtggtattttcttaattattgctattatttgaatacttgtcctctccaaaactcatgttgaaatttaatccccaatgtggcaatactgagaggtggggcctttaagaggtgtttggatcatgtgggctttgctcttgtgaatggattaatccattcgtggattaatgggttaatggattaatgggttatcatgggagtgggactgttggctttgtaagaaaaggaagagagccctgagctagcatactcaagccccttgccatgtaatatccagtgccaccacaggactctgcagagaactcccactaggaagaaggccctcaccagatgaggcccctccacctggaatttctcagcctccacagtgtaagaaataaattccttttctttataaattacccaatttcaggtattctgttataaggaacagaaaacagactaagacaaatttctttctttttttgttatttatttttatctggctttacactggccaatactcagtggcttataatgaaatattctaaagggtagttaatatatagtaattaatttcatcagtgatgtataccactagtacattaacctctatgtgccattttacttatgtcatttcttatagttctggaataaaaaatgtgcttgagggaaagtttattgtgctatattgttattcattataatatagtcattcttagatgcctttatgctcatttattctgtttatcattttccaaggccatgtcagtccttattacatactttcatgttttgtgtttttgaatagatttgtgactcagataaaaggtgctattcaaatttaaggattgctgtattaattcccatattatattagcattcaccaggtcattaggagggtaaaacattcagatggcattttgtcttatttatttctgtaaaatgatgtaataagcatgtttacaatattttatttcagtctatcttaatattgatatttcccgtgatctttgtttagtggtgttttctcttagtttaaattttattttgcccaacagctttcttttcttttataaaaaacattcagcttgaggtgacattgcctggctaaattacatttgtgtgtgtgtggaccactataatttttctttatttttaaatgttgctattgtttgtaaatttgtacaacaaggcactagagtgcacagtccctactgaaaacaaggcaggtttcagggaaacatgtcaggcattactagtttgaagcaactattaaagtatccatattggaaatttcaaatttaacctaccatatttctatttcttatactttagctaacatatcttccttcagatttccccacattttaacttttaaaaatttactatcatttgggctttttactaaaaatttgccttaaatttcttttcctatttttgatgctgtgttttctgtttatcacatgttcattcttttgctcaaggcttgggtttgtgtgccaagattcacggttgccttcccagatttggctaacctttctggtttgtgggtgaaacgtgggtgctattagagtgatatattttcattttgtttctcctaaacttactctcccctaggaggccatcatttcctacacttttctgctttaccttttggcttttctttagatttgtaatgtaaacagtgtgcctaagagtgtattggtggctttacagagcttaatttgcaaatttcccttttatctcagtacttgtgctaacttgttgcttttttatgtgtaacaaaatgtttatctgactgatttttctcttttccctaccagcaaattctgaaaaataattcttgttttttgttaatgattaactgccttcagggtgctaaaatggtagaactaaaacctaagcgataaatgaggcatttctattttgggttacattgtaatattctttatttttacatgaactatatttaatagattgtctaaataataggatcatacttatgtggtaatgaccatttatctaactgggtaacctaccctagattacagcagaagtgtttattgctacaacagatgtatttaccaacccaaactttcctcttttgcctagcgtaaattatttgaagaatgatggcatcttttcctttataataacaagtcaggtctctttcaagtgacccaaattttgtttaactcggccacgtatttcttcttccaaagtattctatggctcagaagtgagggcgatttgaaccaacgtctgactagtacagaacgctcttactcagttctttctaatgttggctcctcatagtttaaggaccaccctccttagaggataaacattccgagcgtttcgaggctcctggcctttattgctgtacacgtttctgcaccctccgcgcttccccggagagaactgccttccgtctgtacccctccagccacttcctgatggctccctacctcattcctcagcgcctgtcacctgcgtacccgcgcccttctcccacggggccggtgcgtctccctgtccccccacctcgcctgtccctctgcgacgctccaggcgtactcctttttgtggcttttgtggcgtgtgggtggttggttagttttctcccctggccctcgccccctcctccccgtcattttccttccccccgccccccgtgcccgtcctgcccgtcctgcccctcctccctcccactcacacacctgcccctgccgcccgcgcgccgcgcgctcccctccccgctccggcggacgctgccagggaagccccctctcctcctcccctctgcgccctccctggcgcgtctggcggcggccggcgctagccctcgcacagcgccctgttattctgggtattgtgtgtaataaatgtcgggccgcctcactctaatcaagctcattacaaattcttgcgcgcccggggccggaaatcgtgcgctccccccattccctcactcattcactagttacttgtctttcggctttttaactcgccgcccccgccccctcccccaatcccggccctccagcccgggttttaatccccatcccttttccgcccgctccgtgcaccctgcccccccacgccgccttcctcctcggctccgcacccccttcctcctctcctcccccctcctcctcctccgccgccgccgccgccgccgccactttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcacggcggcggcagcgacagcggccgggatgagtcaactaataatttaatgggggcagagacggcagcgaggggtagagctagcgagggagagagcgagagaagcagccccgtccggggactcgcgctcacactcacgcacacacacaaacacacacacacctctccctgtgccacccagcaacacccggcctcgtcacaacaacaacagccgcggccgccctctatcctgcccgggggcccagccgaaagccagggcgactctagaggacgctgcccgcccccctctttcatttcgggaaactcctgatcagttttgtcggggtttctgggtttcttttcccccaaagtcctagtgccattgtggtgctcgttgtttacctcggactctggacgagtgagagcttggcgactttttggggggagggggcggggagtttgtcgctgcctaggcggtggaggtggctgggggtgccttctgatcttcctcctcctccccctccccccgaacctcttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgagtttcaggtcggttttgctaatttcactcagtaaaactgcagtgtttctgtttctagatagtactttgcttctttgtctctttaaaaggtcacagtgaaagcttggcctggatcgtgccggccatatggaatggataagggcacaatcttaaaatgtgattatggggttgtgtgggggcgaaggaggcgatccagctagaaactcattgaaaaggatctcgctttgcaaaaaatcggttcctaaaaaactagaatttcgagattttctttccttttaaaggaaataattgttgttactgagttcactgttttattcagtaattatcatatatggtcttagtttatgggcagataaatgggattttcagaaagtagcttgctttctgtgtggcaaccagacattgcactaaaatgggttgtaacgtgtaactcaaaagaaactcttcagcctggcatctgttgagaccatagttagttcctgctgctgtcatccaagcaggcctgttggaggttgctcttttcaatcccaaactgaggtttggtgaactttagcccgggcatagagttaaaatgagtaaattgggtgttttatgcgcatttaattttggtttgtaatgtaaagctttttacaccacgacttagtgtttaatagatgcttataggtgggtattcaaaggacagtttttcatgacctatatgatactttagattgtcaatacattaaattataatgtatcactttcatttgctgtacagtttctagtgttgttaagcctcatgattacttaatatgttttatagcattaactttgatgctgttgtctacaccccctccctttttttcctcttaaattgccccaagggctaaagatttttcttttcaaatcatatgttttaaaattcatcttctgctctaggatgaggcaaccaatttcagaaaaagctctgtgttatccacatgaaacgttataaagagtgttttgaataagttaataatcatctctttctaattttggctttagactgcagtttaatataatggaaaagagtaatcttgctaaaaagtggtttaaaaaggcacatttattgttaatgaacctcataaccaaaaacagatgggacctctatcaacggtaaacctttagttctcagtgtgccactctggagtacaaagataaatagccattaatttttctcaaactttatagttcttcaattggcattcttaaggttgcttttaaacttccagattaacattgctgccccccttttcttgattatatggtaagaagtaggctatggttaaacagaagaaaaaatatttacagaaaagccatgctaatacaaactggctttcaacaaatccagatttaaatagctccagtgtaagaatttacaacaaaaacaagctatatcaaattactagacagctaggaaaaatggtaattattctctctggttttcctaaatatgatccccttagtttcataagctcaatacttcaaataccatcaaagttcataaaataattctacttacctgttcttatcaattctaattaaaactatactttaaaaatgactttgatattgtctaatcactttactataaatgatgggaaaattgatgtctaatatataactgaaaataattatctgttaatttttttgaagttaattacaatgttaatgccattgcatgctgaggttatttctgaatactggatattttgttttaccagtatcatcaaggttttttgtttgtgttttttttttttttaattgagcttggcacttcaacctaatgtgcatatcacgaagtgtattcaattttttaaaaatatttattgttaacagccctctattactaatggacacctaaatactgactctaaaacacatgagttttaatgcatcagtacgttggatatttgaaaacccttcacttcttcctgtttctttaggggtaaactgatccaatcacatctttggcccaaaacttgactaggtctgtcacataactcttggaactttgatagtagaaaactttttctatgcattaatttacaaaagccaatggggagtttaaaaagcagttagatgtttgttaccttcttttgagatggtttatgtttttttcataagaattaatatacatacacatataaaatgtatacatataaaacatatacattagatttctaatattttgaactatgatcatctttccatcctttattaaagtgtttctgctgtattttgtaatgtgtttctaattgttaaaaattgggactacgtaaatgcaatttgctgttttctttttagctatacttgtaataattcttgttctaaaagtaagcccatttttccccacttagtttttttataggccagttatctttttattcatgtgtattggtacagtttccacagatcattttgttaatttgaataagaatgtaatgctatcatctagaaatatagtaacatctgtatcatatctagataggccattttacaaatacattatatttgtggagagatatctagagctaaaacatttacataggacacatatatacacgtaggtccccgcccaactataacgtgtcttctttttaaattctggcaggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggtaaataccttcaagccaaatcttgaaaagctgaaagccctgttgtctacacaaggccacactgtgtgggggtggagtggcagaacatgttttgtatactctgcctttattctccttatgatcgtacattagttacattctgggtccttagtatcaatcacgttggaaagtatagcctccatgcttgggtggagcgttctactgtagactggaatcatggaacattttgggtaataaggactgaattaaatataatggttttagttttggcagggtccattcaaaaggtgttgtagtcgaggattgtaggcagctgtttcttcaaactaacctgattaagaataaaacacttaggtgatttgagagttaccctagcttcttcctaagattcttagttgtagggcagtttcagagatcttggacatcttatgtagaagtttggtaatgttattttttgtggcttattttcttaagagcaaattcattagcagtaaaaaatctgatgattctagttttttatttttgttttaattgggtatttttgatgaagaaagaacagatttaggcaagtttataaggggaagatgtgtaactgtgtgacttttttctaccaatattaaattgatgcagtttaacaacttggactgtgtttaacagtgttgttcctgtaaagcagtgcctaccctgggtgtaatgcatgtgcctcataaggagcttcattttgtgtctgaataacatgtataggaatcagattttccttacatttgctaagcaatggataaaaatgctatattttagcaaccaagaatattaagtagataaagttagaaggcagaggaatttcattgtgtttgatgcgtaacatttatcatacaatcatttattttttccttggtttggcgaaaacaaagaatatattgatcctgaaatgaacagacacagcagtccgtattgttagatctttatctattaaaaatgggaaaacagcacttcagcaaattctttggcctctactcatgattaccctatttattgattgtttgccaagaatgtatgcatcttaagaaagccagggtaagagcattaaaaatataatttattacggcttttcaaacagagtgcattaatattgtactgtgaagcactggggctgtataaaaaagactttctgacgcctgcaaacatgtaagttccataaattcctaaataggagatttcagctgtctctggtattatgtgatatttgcacagcaaactttaatgccaggacagttttagacaaggattctacagacttcactgctccttatggcagacgtgctgtttacacaggctcataaaccttcagcaaaagcttctaagactgccttcaggtttaaatcatgtggtatttttagcattcagcagtgaccagtgctctcccctttaaatgctggaaggttatgaagttgctgtagttggaactctcgccaaacactagcacgaataatcatacagttcagaaaaggcttgtgttcagcattactcccagaaacgggagggtaaccgcaacagtttgctagaaggtctgtaattagatagtactattgtcactttatagccgtctttattattttagggtacctctaaacatgatcaataaaatccacaataaatccaatatatttcaatagtttgaaaaccctgcagttatttcatagatctaaggaaaagcatattgtagaatacatctgattcatcctacaaaaggaaaaatgaatgtgtacatttttgttgtacttacccaactctttgaagatatcaggacaggaggaggaaaactaaaagtacagtaaattcacttcctgctcaaatgctttttggttttgttttgttttgttttggatgtattctaaaaatgcagtttaattgtaggagggtctcagatactccaaataacaaaattactaaagtctttttgtgggtttttattaacattttcatcttatttttcatgtgcatggtttctgtctgataggtgctaaatgaaaattatggctgagatgagaaaacactactaagaaaaagggattgaatggttttatttgtttaggcgattttgccagaataccttcaagccaaggaaggaatcgccagtttgcatattgctatttttgctgtggtctccccaagttgtcttctgatccccgacgggttctttctctggtataaaacagctgaatgaatgacaaaaatattggcaagctctgcggcttgtttttcatgcctagcctattggtacctccgaatgagtttgtgagtttttctaagtaaacctaaagggttttgtcagacctagaatctcttgtgaacagttcactaaagctttggtgaagactcacatgtagaaagatgtagctgttttattgccggcttttgttcagcagaaacaagcaaatagagaatctttgaagggcctctctggtgtcagtaggaaatcctgatttttagctacggttggtgtgcactaagtcatcttcagaagttggtaggattctgtgagtccagaggacagagcttatagaggcattagtattgtaggactaattgtggatcctgggtgccctgttaaagtaacccttgtcatcatttatgctaaagatgatacccttctggcagtttgccacagtacaattcagatgcatctgcttttaacccttttccgttatcattggaagtctgacagtgcgctgcataaacaccttgagtaccacagcattccgtaatatcaatttctagaagaagcctctttctaatagtagtgtggccggtgcttattaatcatctagctactgagttactgtattggattaaaatatataaagagagagcacaccaaatctatgcagattcctttatcctagtatgtcagtttccttttctatctctcatttttaccttatttactgtaacaaagattgttgattttaaagacttatgggtaccgtgctctctttttagttaggtaggttaaatgagtattcataaaagcaaatgttatttttctacattatgcagatattgaaattgtgtattatgagcaccagtttggttaagtactttttgtggaaccagttagagctaatatctaaaaaaggaagaaaatgatttgtggaaccagttagagttaatatctaaaaaaggaagaaaatgaaaatttcgtggtcgaagataatttgtttggacacaaacccaggaaaagtttattattaacaaaatcatgtaagcagtagaaaggtgggttcttctgaagataaatggtgagttatgtttgcatactgtatactactcatagcaaattagagaagatacatttatttctctttcgtcaccattattatttgatcagaaaggtaattctgcattcattgcttttggaaaatgcactgttaatttagagcacagcttaccttaggaccaagttcatattctacttaaatatttctgttacgactttaaataatatgagaatgtatatatttgtgtgcatttgcctgtactgtacccagtctgccttggaagcacagtgaatctcttgtgattatttattttcatggctaatatttcctcccgccacccccaagctgtatttctgaagattgttggttttccatctcttcttcttcatctttttgataggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaaggtaaataatgtgtacgtggggttggaaaaattgcttagcattctttgtttaccttgcagagaaagcactgaatatttttattcaaagaactgtagcctgtgtattacattggttccttataggctgtggctttaaaaaattggcttaattcagtttggtttagttaacacacattttgctcatgtggaatgtcgaggtagattttttttttaaattacttcagctgaatcattagtatgcttattgaccttaataatctgctccactgaggacccacaaggaagtgaggagcgtatttgagcagatggactgttgagagtcaatttgcatttatgactgaatatctagttctgtttcttttattctgtttctgatggttttatgggctgcaaagtatttttcaatgctgattcccactgcaatagagaatcttatctaaatcataaagccatttagaactggttcggctatgtcttattagaacttcctgtaagttaggaaaatgtggccttatgcataggttttattgatggggttttatttccaaaataataaacaaccctacagtcatttacataattttacaatttggaaagctaagctgtgaatattttcattgacctgccttttagagggaagggaatcattcaaacagaaataacggtactgcttgtggtaggggtagtagaaaagaaaagaacacccttctagtagatatattatctgagggtaaaatatttagtgacatattctctttatctgaaatagggctaatccaggttggaaagtggaatccagttccactgtcttacgtgacagatgcccctgatgctacagtagcagatatgcttcaagatgtgtatcatgtggtcacattgaaaattcagttacacaggtgagtcaagacagcaaatctagggtgaaacattcttcttacctggtcttttgaaatgaagcatttctctctggtcgaccttcaatttttttttagtctgtgtttcagaaaggttaatacagatcgattttgttaccctatccttctgccttttttcctaacttcaatgtataatttaaaagcaatccccccccccacacacacaaaaaatgtgtaggtttgtgcaggttatcaaaagacaagactttttacgtttagtcaattaaataatgcatcacaagaaggcattttacataaagtttacttaagaaaaaaatatttttgcatatcatgaacagtgccatctgtgtacattttgtgaaagactgtcttattcactattaccacagtcttatttatttatttatttttttatgatttttaattcatatgaacagagtaatgaaaggaaatcggttaatacattaaagcttttcatgatggctcaggagaaagcagtacaccttaaattgtcttcccaagcgcatcagagcaggaaggtagaagtaacatgaaaaaatagccaccacaggcagctgatgtataattcatgcatcgatacagcagatgtgttgtataaagtaattaactaatcggaacaatcaggagaccgagagcaatctccagatgcatctgtttgatgcgcaaaatgaaatctgtctgtcttaaaggaatgttctgcagcgggatgcaatcttgtaataatcccctttctaatctatgtctcaaatagttgccccaaactagaagacttgcctcccgaacaatggtcgcacaccacagtgaggaatgctctgaaggacttactgaaagatatgaatcagagttcattggccaaggagtgccccctttcacaggtacttagcatagaatgtaataaataataagacatcatgggcaaccctgatttgaggtttgatggagctccctggtttaaagcaactggtatctgaagcaagaatctgccaaaaatgcaaagtgacttgaccactggtgaccttttaaaatatgcctgattccttgtgaacagagcctataggctttttctcccttggggaaaagaggcaaaggactgtttacaggaaaaacagttcagtggaagactccgctggctaatttttagatttgtcttctgagtgctattagcatgatggctaaattctcctgaatgcccttatttaagaaagagtcgaggtggtactactcccacgaagcttcggtgagagggaatggcagtgtcagtgttaatgtgtaaaacttcaccgtgctatctgagtaaaataacagtacaattcttggatactttactcattaccaaaaaattaaaagtattttagtacaaataattatgaaaataattactcttaactaaaggttgaatagttaattcattaggattttgtgaccagttttgtggctttggtttacttcttttctgtttttttaagtggaattttcttttttccctctgagatgcctgttataccatcagggatttttaaaataaagatttttttaatgattttccttgatttctttttttagaataaatttggtggagggcagctaaaactctagatagagactgcctacctgcttatagacagaaaatcaaacatcatttttgatgaaactcagctgatttcaaataaaaaataaaaaggatgctgtgaatctactcttaaagggctgcttttgtggtcaccatgtaaatgtgttatagtcatcccctcagtacccaaacccgttttaaggccattccatgatacagtataattaaaatgttggtccaactagatttttaccagatttttaatgttttcttttaatttgagttttaattctgaatattagtcttagccatttgaacttgaactgtaggatgctgctgtaaacatttctgcagtggagagatctcaaagtgtatttctgctatattctgagtagcagatattctcaaaatgtgtttctaatgtgaggcttatgaagattattgggtacctttgaagggaatcttgtcagctttgtgcttctgtttcatagaaactccatgcatttcagatttgctaagttacgttccaacacttttactttgatatttgctagaaattttaggaatgaagcaaatgaattgtttataattaatagctttctatatattctaaaataagctatagccacaggttacatattctctgtattgttaagtgtccatttcttgcaattcagagaaaactcttatttgtcatttcagttatacctacagctaatctcctgtcttccctctctcacccttggaatagagaggatatgaatttataaccatcaaataaaaataatttaaattaatcacaaatgaataggatgatagaataaaagggtgactcttacttcagggactttgtttcgcagacaactccagataacatgttacatggttgctaacatatgaaaatttgaaatgatctagaaataaactttttaaaaactcagttaaaatatgatgtaaacacccagtactggaatcgcatgtgtctttatgttactaaatgtcccattgatcttggaagtatattcagacaaatacttaaggcatttactatgagctgaagaagaggctgtcgttacaaatatttattgatacagtcagtgagaactaattgttaaatgacatcaacattcagccaataaactctacctcactataacttataaatagaattgtgaatttacttaatgttatcatggaaaatgaattgcatacaattataacattaagtagaatgacaaaatgtaattcaggacttggttttggagtcatacattggtgaatttctatagagagaggttttcagatatatggcttcctgtggctggatacctcactgtaatcattaagtgatggaactaggctacaatatcaacatcagttataattgcagtattcttttccataaaaaaacttctaaaaattatgcatagtttaggagtgaaagcaaatatttgaaattaatatttaataatatgaaaacatgtaaattgttctctaaatgaggtacttattttatattttgctgaatcatcttctctttttctatgaatctgatactccagtcagaattttttcaacataaactgttttctgtttgcttctttattatgtttttctgtctagagttattaaaatgagagatgcaagttccctaaagcctatgtccaaaatatatgccaagtttgacaaaactactctttttcctatggttaagatttggtgatgaagatgtcatggtgaaaaaagcctagcaaataaatatggcctcagtcttgagcaaaatgggacctaacaccaagaaatgccaagtgttaagccctttcttcccctgtggagtgttgattcattcatgggagagaacctttagcatgcaatacaccatacacattttactgtacagtaagggttttattttgttgaatatgataaagtactccagtagcaagtatggctacaggggccctaaatattatagttagtagaaagttcaccctgtgggcaggtaaattccttttatagagcaggggccaggaggagtggaactggggagccaccaggattttgcctggggtgttgaataagccctgcctccaatgctcttaggacgattgtctaatacttgctaagcaaatgtccatttggacttggattcttagaaccagaagggattatccttcctaggctcctccttttgataattgaaggagccagtgtccctggagattaaagtcacggtgcaatgactaacaagaaagtcctgacttgctaagcctatgtccttgcctgacaataaattttaaagtgctgatttagctacttgggaggctgaggcaggagaattgcttgaacccaggaggcggaggttgcagttagccgagatagcaccactgcactctagtttggtgacagaacgagactccgtttcaaaaaaaaaaaggaatacttacatttgggtacaataatgttttctttgatgatattcataaggttttcttcagctgcagaaattccataagtgggcttagtttgatttacaactcatacctttatttctgttatcactttcctatcataaatctgcccaaatcgattgacactaatttattaaattctttgtaccatgtgtttttttatttttgtaaaatgttctaagacataagaaacacttagctcattataggtctgaggttagatgttttgttgttacttttgtttttttcggtggatgtggttagataagttggatggtgcattctgaactgcagctaaggagagaataaacactgatttggggacaagagagcctgtagtcatgaaacttttgaggatatggatttgggaggaaaattgggaatttaaaaagtaaacatttttatttataataaaacattaacattttgatgcttattttccctggagttttagaaattgcatttaaaaactagataaatgtatatacattctgatacagggtagattcattttgttaagtaaaggtcagctattacttctaccagcgtaatgtcttccttctaaaaatgtttaggtcaaatatttcatggaggttttaatctgatttgcgcatttttaccttccctctttcaccacacatgtgggcgtacatactcgcgcgtgcacacgtgcacacacacacatcacaactttcacatttttaaggcattggattattttctatcttatttctcacctggaaaagatatctttaagccaagtcatataaagtgggtgagaagtgttatttttattttcaagtagcaaaatatatataaaataaatttgaacattccatttagaagtaatattgagaaagatgattttccaactttccttttattcacagcatcctgagatctcaaatatgttggacaatttatttattaatggaaaaataaattttaaaaagaaactacctcgtgctcctgaagcttagcttcagtactgctctcctgaaacatgacagtcatttccgtaggaattaaatacacttaggtgtttagttgatgttcagtctgtattataaatgatattggagcaacaattacaaatctatcatgttatacaaatgtgtttttaataaactgtactttatttcacagtttttggactggaatgacatgtttcttaaaattttaaatcagttttagtaagcacattcttaagagaatagccagcatcagtgttcatatactgcatttcacatgagagtctaatctatgaaatttgttcacattcatatattcaaaagtatgtattgacagtctgccgtatgccaggcattccatttcctatgtagtgttaaggatataacatcttattagttgaaataatagtattacactttgatttagtgcttttgatgtatcgagagcgcctttggtccccctaagtaggatatagtcttatatccccatttttaaatgaggaacctgaggcacagaatgttgacatgagtgagcgtccatggctacatcgctggtgaagcacaagggtgagacttcataccgagagcccgggagcttcaccaagtagccttttcatcacataccacagataaaggaagtttaaaaaagacaaaatgaaagcctctcagatgaattggataggttttataatatgctttgatttctctaaagtagtgataactacttgtagttttccaagtgtatttattctcattgctgaaaattttctttaccgtgctttggttttgtgtctttgattttttgtttgtatgttgtcttgttttaaaagtacattgctgtcatatcaagcccctaatcatgggtgatctagacaggaactgacttttgggataacttggtatttgggacgttccagaagatttgccggtatagttctgtgcagttacttctctttcctattctttcatattctcaagaccagtaggcataattatgctaatagccctttgttttgaaccccaaggtaacattagtcattttcattagaaatagtgggcagatgaatttcttgggtctgtttgaaaatacagactccagtcatcagactggtcttttacgagcagctccattttaaaataaaaggattcctgtttgagatgagctggaatgattttgtacttgccccttcccagtataaaattatcttatgtttaaacatcatatattttgaataaaagctctacagagaatcttctttcctttttaacattaaaaaactttccctagtttttaccctactgaccgtgggaatcttagattataaatatctgctttgccaggcactgaagtacttgatactaattggatattatgaccacttttcagcaattgtattactgtaatggtgggatccataaaggaaatggtaaacctgtcttatatgggtagttgtgtgaattgcaaaacttacatcaaataatttttttgcctcgtcttttgaacaagtcatgacatcattctagttcctttttcaacttagtgagatgtctgctctgtgttaatattataatgtgtataatctacaacagaattgtcctccaaattgcaagttttcctttttgaatctaatatatcaggctcatttttagatgacttagatgcataaggattttatcgtagcttgatgttagctctctgtaacctttcaggtatattaatcaaaaaagccaaacttaataaagcatctaatttaaaatggattgatctcaaatattttatagccactatcttttcacaatagtaaaacataaaagagtttaagctatgccaatttagagagtgcttaacaatgtgtaattactttattttcacttaatagatttttacctgtgccttgtttcagatctgaataggtttcctttgacctcaaaatcactaatgcagggaaaattaccatatcatgagagtatttttcctctttcttttttttgcctgatgcttagaataataaatactcccaaggcttaggagtagacatggcctgagagaaagcctattaaatgctattttctaatggttttaaaaaacaacttaaacaaatcatgctactcaaactgattttcttgctaaaacagaactagttttagagtatattttagacatctttttttctcaattactagttaaacttgaagttgggctctatctggatttgctttatagatctgcttcatttcatgccagatttgggcaaaccatgaacaacccccaactccaggaaaaaaaaaaaaaacctgataatcaaaacaaacagatacacgaactcaatttccccctctttcattggaaactgcttgattataacgtgctctgagtatgaaaaacataagagagcctttaacataacagaggagagcctcagccctggttctgcagctcattgccaattgaagtaaggaacgctctggctgttgggacttttaaatctagacttaaaagttatttgttctgtttagcatttttaaaatgattctattaggaattgtatgtgcttcagttttaattttaactcataatgattgtaaagcaccctgggatgcttgcatgaagggcgctacagaaatataagattgtattgtgttctaatatgcagtcttacggggtgctggagtttcatcatggacaattcataagattgcagaattcctcatggcagagaaggtggctgacttctttagcagtctttttctctcattcttactctgaaactttgttctctttagtcatcatctttctctcttaaaaaaattgattattttctattgtaatattttcccatagaaatgctaatctaatttagtttactcaggttgaagatgcaaaccagttgataggttggaagttaagaaaagattaaagctttaattgctagcactatttgagatcacattcttatctgaataacaagacatggtacttcattactggataccaccaactctctcaggcttgtcccattttactgtccacctactatttgttccaaggaagttcagaaatgtaacaagtattaactttgtgaaatgtcacaatgagactcttctctgtattgaaactcctgtcttatgataacatacgacacagcttgatctagttttctttttactttttaatgggactgtttctttagagtaatggcatttcttcagcaacttcattgtgttactttttgtgtgtttttgtttgtcattgctctctagcatcactttaattagctcctagcatcgtaggaatcaggaatgtgagttatgttgtggccagctatatgagcttgggcagctgactccatgactcaattttctcatctataaagtcggaagataatagtaccaatgtctcgcattgtttagagaattaaatgagctagtacttagaaaacatttagaacagttttcagtcctaaagtgtgccataactagttgtttttctaaaatgtgggcattgagagtttgaaatcacacttgtgcatgccacatggtctatgtaactctctggctacatggaagattttggtgcaatcttcatttttagtgaaaacaaccaaatacttttcatttgtgaaaaaattaaaagactatattataactcaatctcaacattaaggaacacttacagtcattataaagttatgatgtattttaaattggaagtggaagactgcagcttatactttaaataaatccatttggaagtttagcatatatgataccctaggctagataatgtcaagtagaataaagatacctgatgggactgttaccaagaggtgagcttttcccagtgtcttttccgttaactaacttcgcctgtactcccagcacccaaggttctgtcctctccttatgtgcccatcgtagcatttgccacattgttctgaaatagtctggactaactaggctgtgtacactgtaattgtcccaaaggaactaagttgtattcatcactgtcatagatcctgacacacagtaggaactcgggaatattcgtcagacttaaacaatcttgtaggatttgcacatgtttatttcataagccagtataccgtgtcagtagttgtattagtagtactttatacttttatctacagtatcctatcttatgaaatattttcctattatacttaattctgtatttttacctaacaaagaacaaatcacttctgaatttttctctaagaaaacctactgacatttcaagctgtctcatgcttttgtatatttgataatgttcatgaatatgtgtactaaacatttgtaagcacaacaatagccttggagttacagggaactcagaggtctgaatgcttaaaaagacctgattatacatcacagttaagggcaagctttaaaaacatatgcagcatttctaaattttaaaatttttcttccacaattgtacatgtatttcagcctggctaataattttcattttgtctcagttacattatatttgagacccacacttcttcactattattttcatttgtttattttcttctcatattcaagagtaaaataggaaattttcaataacagataatttatagacaaagatactgatgttgccaatacggaaatgttaacagtatcaccccatgttcacttccagcgtccattcctcagttgtgttctaaagtctacatttggcataagagactccatttaaggctataaacatgcagtgttttaaagtcagctgtatacaggtctagagtcacctgaatttagagagagctgcaagggtagataactgttcagccattccataatgggccttagggacttggtttgtccactttctgcgtgatcaccagctcagcctggaaaacacatgtttagtgatggatggagctctttattatatgatttacaacccattccaacacatttttatcatttcgccataacttctaatgagatgattaccagaggatggcattttcctacactgtgaaggattttcataatattgattgagatgaagccagattaatttgatttttctttatgatctaatccagaggtgacattggtttatgtttatctggtagacatgggaagtcttatctaaaagctgacaatgatgaataaaacacagaaatcaaagctgcggtttagccctcagtcttctgtgaagtcttggatcagatctgagaggggtccatggaccccacaatctgtgcagaccctgaaattataagccaattttgggaatgcatggaggacagctttcataggttttatgtaatttccagagttagttctgtggccctgtaaagagctaaaagccaggaggtattttacctccaatttttaggcagtatggcttaaaaatctaatatgctcctgtacagaaggaatgcaaagaggtaatataaagtcttcctgtgaagagttacagaacctaattctaatatttacttttggaaaatgaattgctcaaagtactttagttcttgttttcgctctgtggtttaagggttttttggttttgttttgtttttttaaaaggctctatttaggacctctggaacttaacacgaatttggtatctttccagatactagaaattgtaatctctagagaggatgagcgatttaaccacacaagggcatcagagaaagagatttctcaaatgggtacattggtatagagtgcctaagattcagaatcaggaaacaattttgtcaataaaatcaaataaaattccttggattcatatttatctaatgaaaaacttgtgaaaattctatttggatataacataatatataagttaataatgagtgtattttaaataatcataagcaggatgccaatggggtcgtaaccttcctaaaaataagactctagttggagacatttgcacagtgagtacctgagaatgaataatgtgcgttacaattgaatcttttttagtcactctgtttgagaagacatacagatttcatagacttttaaatctgttagaggagacgttggagattatctagttcagttcccttcatgttacagcttctgtgtgcagttaatttggaatatcacatgctcttaatataccttttaaaaatattttatagtttaagctctttaccagtatattcatttggtttgagttaggtttcagtgtgataagaaaggtctggctaggtacttatacaaaagggcagaatagagaatctggtcagaacatactatctgggcattatgtaagttattttaactatatggaagagccatataaactgtgaaccaacattttcttttaaaagttatgaatcgagtatttaaataaataaaatttctgtgctttgatatgatcacattttcatctttaggaaatatagtaggaaaattaaaatagaattggatgtgttctctttgtgcttccttttgtattcctttggagctttgtactgagtttccaattttagcaatgtgccagggttactttgtatgaaaatgccattttcaggcactaggattgatcaagatggcaagagccataactatgacaactggagtttaagtaaaatttagaagtgattagtctcttctcaacaaattgagattccaaatatgccccagttgtatctcccaagagaatagcttagaaagcaatagaggatccagagggaaagatttgggaaacagaagctgacaagcacaaacagaatattgcacttagaaatcctgccattcgctgtcataaattgaagcccatttcctgtccttcccaccccaaaataccagatgggaactacctgttaattttcaacaaattcatttcttgtcaatatatcatatctcatacgatgcctcttagagcttgtttgtagtatttggtgtcctttgagattaaaagaaaacctcatttacgaggaatccctgtgaaaattgtatttgaatgtgtagttgatgtgaagttaaagtttgacctttgaattttccatggacagataaaaagctgctgtaaaaaatcaggccataggtagtcaggacatgcacaaaggggtgggagattagaatgtatgaagttgaacttctcaaaaaataaaaatataataaaagccagtagtttgacagattgttcagtaaatgctcattttattgaaaactacaaaaaggtgcttaatgcctttgcgccattaatacaatacataaaaaggttactgtcaagattagtgttccatccctgaaaattaactgtagggctttatacatcaccatgcatagactgagaagttaaaggttttttttaaatacacattttgcattgtgcaggcatttatttcagaaaacaattattttagactttgtgccaaagacattaggaatgatgtgctttcatttaaagcacagacataacagatatgtattataaacaggtagaaccatgaaattttccttatagaataaaacctgtgcaagattatttcccttgctgtctctctagagtattccaattcaaaacatacattccttcctacagaaaaaagatattcagattccttagttgaaattaattagcattcagaaaccagatagcatgtttttgggtattcatgagatctctgtttgaaaaaaatgtttttaacttgtagaaatgtgttgcaacacacagatgggaagaaaaagaaaaaaaaatctctttagcaagcactgtgtgtaaaaggaatattacattttgcacgctcctgattgctctgtgtaaacagtttttgacatctgtctttatagttttcgaggagaggaagactttgttaaaagaatcatttttatacagcagtcaccatttcagtcttgctttacctgtattatgaaagcagatggtctgcatgtcttttgaatatttataactatcaaaaacaatctcttgctattcacccttaggcttatgagatgtcaggactgttctggttgaaaaaaatcatcttgggtgtttacagaaagaggattacattaagctgaaatgactatacattttccagtttaatatttgtccatcagctgtttaatcgtatttagataattgtgtaaataagatgttgtagcccttgccctctctgctgatggagcctgaaagctttaaacatgggtgaaccaccattttgtagatgctcttgctacctcctccccacctcagctaaaccatcggcaagtccttgataagttttgatcatgatatcacagtcctgttttttttgttttgtttttaaagtagtgcaaaaaacgcaagcatgtagatcatatgaaatactaggaagctgctggcttccggtacaggctgtttagtttattagggtatattgtaatatgcaaatatggtacagcactccaattaccctttaaagctgacatggttttctctttattttctatgagcatgcagagctctgagggtatttggaaaacttttggtatagtgggggttaactgttttttgactggaagctgagcaatcagtgataacagattttgctgtggttggttgatttggcagaaaagcatgaacagttttggtttaaatgattgaataacctgattagcattgttttggggtggttttttttggttgttgttaaagacacaacaaagcaattttaagggtaatcagatcactgcctttccccatctgatgaatctttttttgagaaggcctcacctctctcaaaaccccttcattggctactgagatgaacaagtaaaaaaataaaaccatcttccttcatttttaaacgtgttatagatatatacctacagtacatatgatattgtagcaggggtttaaaagaataaaattttttgaaacattatgtaaccttaaccgattctttgtggtttttgtttttcaaatttaaaagagctagagtattttagagcaaaggttcagaatgttctatctatctttaagttaggctttagaaaaattccacccttaccttttcacaattagaaaggttataaataatgtatttggctgaaaaggaagctcagcctgtggcagatggtatcattctagagtactggggtttctgtgaagatggcattctttcagatcggaacttcagcagactctcagaaagaaccgaagctcctcatagggagtagacatgtgctttatggatcttagaaaagcttacaacttggctcctaggatgagaatattgtgtcacactggggttatgagacccacagccaatttctgccaactttgaaattgtatttcccaacactggaagctgtggcctatttattggttggtgtaccgtgtagcatttgaacttggtatttcaaccgactgagttttgtcggttggtttattttattctgtgaacattgatgttttatacagaccagccactgaataggaaacttgccatacaagttgtgtctttttcaaagtgctttggatagcttatataaatagacactgagagagaactggaataacataaccaccgagcactgcaacttccgagacatctgtgtggatgtattttgaaaaacctgggaagggatctcttgcaaattaatgaacaaaggttcttgaaactatgatttctatcacgacagccaaagcgatggatttgaaagattcgtgtcatagttaagctgctattatgtttgacctttaaggggaaaaaaggggaagaggatttctggtggcttgtttcagtgaccctttttattgatcacctagtctgtgtccagccctctgatgagtccaggatatattcagatgagacctaaggcccacagtccagtgcaaaataaacagcaggatgagtgctctgctgcaggaggtttgggaagttaggaaaggcctcatggaagcaaggatgcccaggctgtatcctgaaggatgagcagctgttagctagagatgggagagggcatgggccgtgcatccaagccagaggagtggtgtgccttcttgatgctttctaccagatataggccagcttcagaaaacaccaccaaattggagtatgagaaggaaagaaatatttccccgtggtgttttcctttactattccttgtaccaacttgtaacttaataatttaatcagtatacttcattctacattaaaaagactcaaaatactgtatatcatttgaaaattttatctgatactcaaaacatagtcacctgatatgaaatgtgatcatataatgaaagcccagtgatgaggaggaggcaaaggattgtcatagtaattaatatctcttcagtctatatgtaatatgttacaggctctgtgctaattgtatcacatctattatttcctgtccaagggcagataatatgtctcttcaagtcattattttcctagtgacttgcccagtgcttggcacatagtagaatttaagtatatgctaaatgaattttaaaaatgcctgaattgatggattctcagaacaactccatgaggtgtatgctattatcattcccatttagcataggaaattgtgatggaatggtcaactatttgacccaaggtcatactaccagtgtgtgacacatcctcacttgaatatatgtttatttctattctgttttgtcagatgaacatttagtgtttatattaatgcatgccaggcattgagctagaaaataatatggtgccccagacctacgtgaactcacagcttagtgcaatctttttaaaccagtacctccttttaagtgacacaagaatcccaagcctttctaacatggaacttggcctactatctgtacatcccaccacctaggaaaattttaccaatcatgacttttttatttgtgttatcaaaacattacgtgtttttttcctgatattctaaatttaagattacactactgtatatgatttttcaaatgccatgtgcaccacaaaattctgcagtctctttcctgccattgaaaccggctggctggtctactccaatgctatgcctaagcctttagtaggaattttaccacctgaaacacacacacacgcccacgcccacacacatacacctcatgaagtggctataggagcaatctaattggacagattattgcatattgtccaataaaaatagacatgactccaagttacctgaattaggaaatatttcccagtcacccaaaagcacaaaaagatagggaatccaaaaagttgctttgtcatgcattataagttacggattagccttttgatttaagtcttgcttaggctattatttacattaatcagagtttcctaagcatacaccatgtgacagaaaagcacttaagcccagaacctaccaatttagggttaagtagggtagggggaagctttgacaatgatgcacatatggatattattttccatgtacgaataataataaactgtatagcactattacatataggttctagttttataaaactatttcagacattttttcacacacaccatggatgattcttccttccgtcgtcccctatacattttccactgttgatataccaaatcacattaaattgagatgatctatttacatatctgtgttcttaatagatagtaaacttcttgtaggcagaggctgtccgccatctttggatgacaggtgcctcatctttgtaggcagaggctgtctgccatctttgcatccttactaccagccaggcatatagtaggtgtgcagcaaagagcaaatttcatatatagaactgttggcaaactggagtagactggatgtttgtcaaaaacctcggcaaaatttggatattccatacacttctaaaaagtaagacataaaccacatctagaactcatgtgtattattaacatttaaggaactgccagaatgtctagataaagagtaataatttttttaaaaattggaccagagtggaagaacatcaactgtcatccatttgcagaagaatcaccattatccatcagcgatctcaatagtttttattagtgtctgactttattgatcccttattacaagagagtaagtgagattgaagctgacagatcaggtaatcttctggctctggttttggcaactttgctaagtgtctttttacactgtggactgtgggaggctcttagtgaaattgcaagctattggattaatggcagagcatcatgaacacattaagaatgtctttttagagatataaaatgtgaaaatgactatagagagtgtcaaaaaaaaagatatcacagtgcctcttaggaaagatagctgtgttttacataaataatgcgactccagcttatccttcactggaagttctttagagatcccccaaatttacatattccagaaatgtgtgcatgctacagaattaacactgatagtggatgtcaggagaatgaataataactgaaagagctttacattagaggtaacttaaagaagataattatataaaaatacttttgtccccaaactggcttttctggttgttcactgcctcctgaacaatgctgccttctataaattatttcaccatagaccaactgatgtctgaaatgtgagttctcatgtttctgcacataggggtgagggatagattggtgctacaaaatcttactcctaagactcggtaggaaattaagttagctgttactagagaatatgggtaacaggttaatatggaccatgaatttagtcattgaaattaccgtaaccaaaatttgctgggaagattgaaaatgatttaaaaaaagaaaccctcctagtgattcattaaaatcatgtttttcttcatttttgtatgttaaagggctgacagttttccgggcatttattaaaagcaggataaagataagtcacgataggtcatctttttgtggtatccttgagaaatttagaagcatgaaatgtataaatttaaaatttttatgatcggtttgaaattcaaaacttaagctttactattgatgaagccagtaataagattgcagaatgtttttctcttgatagaggatctctgtgaatagtttgtttcttctcaaatacggtcagttaacctttgatcagtgttaatgcgcgtccactttaaatccaaataatagagtggaaagtgcaagttctgtttctcaaattttaatatacatgtgaatcccctgggatcttggtaaaattcagctgctaagtgcactggtctggggtagggcccaagattctgcatttctaacaagcttccaagtgatgcccatattgctggtccctggtctatactttgagtagaaaagatgtagagtccagtcaaaaaatcgcgaagtctcgtatatttatgagtcacaattataaagtcatcttcatgtatttggatttattgggaccagtgagtttgacagcctagtaatagatggcattgatggagattcaatgaatgctagagcaaagtctgtgggtttgatagctttatactggtctcagtgggctgttgctttctacttaaataagcatttgatgatctacttaatgaatattaagaagtcgaagctttaggctaaagtgtgaaaccaaaatgtattggtactcagttgattaaaaaaatacagttgccacaattgagatcatttctgtgttccatcttgtgctgctgtgtattacaaatattctccccccttcttcatgcagagtatgatttcttccattgtgaacagtacttactatgcaaatgtctcagcagcaaaatgtcaagaatttggaaggtggtacaaacatttcaagaagacaaaagatatgatgggtaagcaaaaaaaacattgcagcagtggctacataccattacgtgtcatttgggggtttatcaaagtcacatctaaagccaggtcttttgattgcccaattagagatcaatttagaatgtttctttgggggtgggaagtgggtatgagtataatgagataattaaattcaataaatgtttgtgtttaaatcagccaaactgacttggttgtcagacatgcaggaaattgaggcgttgggaggggagctgtcattttttaacaactcagtgaagacctaaccaggccttgaataactaatattagctgtgatttctttctctgataagtcttgcttttaggttttttgtttttgtctggttgaatgagaaagtgcctatttttacacccaattttaaaggaaattaaacttcttaaattaaactatttatagtttccacagtagagatcaagtgatttttatagctctaacccccagccgccatggatgggcactttgataagcacattgctttaccatccataccagaacaattattgcatcatttctgaacttttaattccaaggtagcattctatcttaacacataactttaggtgaatatttgttatgcaagaagtacactaaaattatctgcagtgtaaaatgatagataaaagttgtgtatggtacctaagcatttagatgatggcattttctctctgttgagtttgttaatgttcacaaaagcaaacactgtgattaaggttaatgttttaatttttattactgttctctttcacctacttttaccctccaaaacatatattttaaaataatataggaatgggcattatgtcctgttttaaatctatttctatttatttctttacattcatttaatttttttttaattttttaagaaaaattaatccaaattttgagcaagttttagctcttaatatttgaagaaaaaccatccatctaccaaaatggattctttgccttttatagcttaaggctgtaatgaagacaatgcatcatttttggaataattgcttgaattactgttctctgtgaatggcccacttgggctgatatcactggtagaaattgaagatttcttccccaattcttagttatattttgcgtatatcaggagctatagcgctatgataaagttcctctaaatgtaaaacctgcatatttaatgaaaagagaattgatgattaaaatcaaactagagtctacatgtgggaagtctgtgtacaatttggaaagtcctgtttatgtacagcttcatgctcagcccttccagccaagagcatcgaaccagtctcctcttcgtacagaaaagcatttacatacttagagatgatgctcagccaatccatatgaggaacctagccaaggaagaagcattcatcctgggtaggtgggaataaattgcaaaatcatgacagcctcaccattgtaccagaacgattccctgcaagattgtctttagcatctggtgatggccatagcttcctgaagaaaaaacatttggatcttagcaacactgggtatgctggcttgatatacaataaatcacttgctttattctaaaaagtatttccagatatacctactgcccatgatggttagaattaaaatgaagcaaggcatataagatattcagcaagtgttcaatatacacttattattatgcccatttttatttattacattaactacttctattcactgctgggtaaaaattgaaagtaggtgactttttatgtcatattttttcttttacacctttttcctagagtactaaagttaatgaatatcatgagaatatatttgtaaatttttttagttgcttattataagcttattttctcagctcagctcactgtttgtagttgtcattaagcaaatgacattcttttagaagccatttttaaaaattgttgcttagaagccttcttggggtaataagtgagagtgaacaactagttggaaagagtttgggtaataattgattttatgccttaaatctaaaccactttttaaaaataagattaggaatgctgtcccatttccaaagtttgtagaattgttcaggaaaggagagcaaaaacacagcctggtaagttgcaacttgaaattttcttggttttattggatttggggtgtgccctgtgcctacccttttttaatttaggaaatggttagaaatctttatcaatgccaatcattgttggctgaatgtgattttactctttgtccactttagttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcaggtcagttgtgtttcataagtggttctgtgctgtctcctattttctctttctttagtcccatctataactaaagtttattcttttacttctgtactaacattttctctctctcttcatgtgatcatattacctattcctggtggagcctcaattttaccactccttttcctatgatatacttctgaatcaagggaacctatgtgcagattgatcccaattcagggcctttgaaagactaattaaatgtcaaacgtactttaaactggcattacttatgcttttatataatggaatcataagctatagtagatggttaagaaaagtttcatgactcagtcaaggctattggcaggattccaggcttctagcctattgtcttttccatttatgttgttactacccatatcaaacttaggtatataaatgttccctcttaaagttctactgcagcgttgttgttgttgttgttgtttgttgttgttaacaccttggaagcaataatccacttaattctaagcagccattttgaaaaaatattatatgacttattaacataaaatatttgtaagctgtgtgcgctccctcatgctattgtcttccaaattcattgtctagaccaggcatcagcaaactttattctgttatcgaccagatagtaaatattttaggttttgaagcacttaaatctcggtcacactgtagagtaataaagcagccatagactataaatgaatggcactgggtatggtagtatttcagtaaaactatttataaaacaggccatggagtaagtgtggctggcaggccttagtttgcagactcatttgtagagatctcactgcctgcttatacccctaatgtgcacacctttgtcttcctggcccaattcctgtgaaggtactatctatcagcctggaagatgtttaagagggtcatggagaaaaagtgatatatatgagaggtcataagataaagatatttgagaagccctaaacaaattgactctgttgaactgtgaatgagaagaatttttttctttgtttggaaactagtatgatacgtgatatatatggtgtttatttttggcccaggtacactaaaacaaaacaaaaaacaacaacaaaaccaaaaaacaaacaaaaacgaaaaaccgcgtaactttgattagaagaaggacattatgccttttcagctcttttgttttaccactgttctttcttttgtcaatttatcttattttttgacctgactcacattttcctttcatatttaagttattttgtttattacatgattatgattatgagaataaaattctggtacagaagtaatctagtattaattcctagtttgcagagtttccatacctaggagaatcccagctgtgacttatttttggcgtgccttaactagatggggagttaggagacctgacaaagcctctaattcagtgtttgttttcagtcgattcatctttttttttttttttgtacgttcgtctgtttttgaaaaggcagttgcacaaggctatgtctcaggttaaaattgtatggttttacctagttctatatctttatagcttaaaaaactgtgttcatcattagctggtgaacttaatatgacacctatattcagttgggggataattattgaaaatgaatggctcaaaagtcaaccctctaaatattcctgtttctggtagcattctttattttagtaaatatagtaagtactaataattctccgtactaggccaaaaaaagtaggtctctacataacatttcaataatgcttttttgaattgagttaaaagcccacaaagacatcatgacatagacacaaattatatatatatgtatatatatgtgtatatatatgtgtgtgtgtatgtgtgtgtatatatatgtatatatgtgtatatatatagttactggtgtcttaaaaattgagcagttatttcttaaagcactaagtaagtgtcctttatatagtgaagaatgctaagacagtagaactcagagaagtgaggataaagttgtcacccatcattacagcttttctccttttgggtttatgatgttacagccattactatgaggagttggccatttgttctgcctttggtccttaaaaggacaaattccacaatatctacaggatttgttactggaagaaaggcaaaattttctcttttataccatattaatctctttgaaaaaggtaatcatctctgtggttaatatcaaaaacagtgacttttttttctgtgagaggagaatgaaaactttaccttgtatagcttgattgcagatacctccttattaataatagccaatttaggaaaaaaagtcattaccaaaaaaatatttagtgccctggattatgaagggtgttttaaagctttatattgataattgatactcttcagtcaaagtagatatagggccatatttgaagatgtttgacttaagaggaaatttgtatatatatttcaatattaattccttgagaactaacttttgcacatgcaggcatgaatttattttcattggtcattcttaaaaaccacacacacatacatacacagctgcatttattttttaatgattatgcattggtatgactggatgtagtgtgttgatttcaaagtgtatgcatttcaataaaagcaggtgcagagggtatggtgtgagtgtggagtatgaaaatacacatgctaatgcgtatgtatagacaaggagctctgcagagttaaatcacacatcacacatttgtgtgcacctagtacaatgtgcagttccaactccaacttttaaaacattaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgacttagtgggtgcagcgcaccagcacggcacatgtatacatatgtaactaacctgcacaatgtgcacatgtaccctaaaacttaaagtataataaaaaaaaaattaatgtaaaatatgtacatacaaatacaaagttacatgatagggtcagatgaagatactgtttcttataaacggcattaagaccttaatatgatagaaaacacttgtatgaattgagggttattttagtcattgaagctctgtataactttaaaaccctgggtcttaggttttaactattgagaattttcttatcatcttaatagggttccctatattaacacattaccctcccaagactttcgcacatgggtttttttttaagcctaccttttctgaaaatttatggtaaacttatatagttacttgttttaaggaatttttccccttctgaattgatgggcatgggttctttaattgccgttgaagatatcagcttttagcatatgtcattcattcagttatgcctacttgatgtctttttaatggaaacctatggctaaaagtaattgccaaagcttctagatttctacttttcaattcacttctctatcttattgctatttaatggttctgatacatgcaaatacattccttaataccctttgatttttaaaagaataaaattcagagtttaactctgatcccactctgtggcttttttcccctttttcttccccctcctcttgtcttttggcacactttattttccagtaaaataaagaatgaagatggattattcaaaactgataacagtaatggaccatcatgtaatgttttattaaatttgagttctgtaaattatgtggtggagagaaatttgcctgcttaagtataacagaaattgctactgtgtttctataattcttcacagtgtaatttaagaaaagtccactatccatatcactattgaataaaaggtaaaaaggtgctattaccccaacaagacagctctctggttagcctgccaaacgacagagataaatgtgtctacttaaaacttacttggcatgaatccatggtagtaggtggagtttgaaaatagtcttttacctggacataggattaaaaattcaccaaacaacagaggcaggtagccttgaagaatattctatgtattttctttttaggagggaggtttcatcaaatcatattttcttcctgagggctttgaagttccatgaagctgataaaatctatttgaatcagtgattatgttcaaagaggagacaaacgggaggccagacagcctttttgttcagattggcagtctctttcgcttatctgctgttttaaagaattcataattagcttttggaaatactgataatatttattggaggttttttctttcttttacaactactaatgaattttacttgtaataacttgtaaactgtttttggaatgtaaaaacaggtttaggaattcagcagtaaattcattctttagttgaaaaaattagaactctgacttaaccgctatgtaatgacaatgcaaaacaattttgtgttttcatagatacagcacacatctaattattggtaagatgtgaagtcccaatgaaaggcagcttctgattttcaataaaatgaatatttatgaggtactggtaacttcctacataacatacaagttctcaggttcttttcagacacaagaatgactaatgattttgtttaatttaattcaacaaatttattgagcgccaatgattcttgatactgatgacatattttagtcctgatgtttcagcatattctatgacataaataaggtacatgatggccttttcatactattttttagcatgaagaatttttggtaaaaggtcacgcttactgtccactgtgtgggcagtactacaaatgaccttggcaagtctgtactatgtcttcaattataggatatgggaactggtggccacatatatcttgaattcagcatataaatatgagtgcagctattcaagtaacaacaacctgaacaggaccaaaacatacattcccatatctgggatctgatagcagtcattttgcatccaaaattattctaaagtgacttttttttttaagtaattatcactaatcaaaatgttttctgacaatattttcaagcatttccaccagggggcactcccctcattgaaagctctgggccaaaaaaaaaaaaaaaaaaacccaaaggtttctgaaacacctgagactgtctacactggctgctttaaagctctttgagtgtttcagggtttgaaacatcactttataccatcaacatatttcagacgaacaaaaaaccttgttccagtagaataattaagtggtagtaaaatgctttgcccctaaaaacacttgtatgcttaaataggaagtcacaccaacatcaaaatataggtagagaacttttaaaattttctcccaagtgacataactaccttccaatctcaaccatatggaaatgacttagtcttatatgttagcaagacttgagaaagaatattattttgtatgttttcctgtatttgactttctcactatagatctctgctgcctcaggaaatatttttgatagaaatatgtgatatagtactttgttatttgggatttttaaatacctaatttcaagtttcccaaataacatcctaaatatttataactatgttttgccctaatctaatttttttaattattagacaattaggaaaaacatctcaaaaaatgccacagaacttttcactgtaggcccaacatgagtgctaataactactactagaattgactcatgggtaacacatcttgttcttaagtttctatcacctgtttgtgattgttttctccattgtggtctttatacacatgatcagtccatttagtaaatacttatcaaacatttacatgagagacattgtgctgggatgatgaaagtgaatattagattattatgctcaaggaatttgtagcatattgtgtttatactgatgttttcatgtatccatatctgtgtagttgagaatatattgctttgtcaagtacattttttaagacataacatttggtggagaggagtaaagagcaagggttatttcattacacctattttcaaactttttttttttgagacctgaatgttttactttcaatatggcacatcagaaacacagtcaaactaattaggtggccttgtgcaaattaaatagctggatgattgactgcctgtttgactgaattttagttaaattgactagatgttttgctcttgtgtagacacagttacagcattactcgttagtatcctaaggacacatgcccttcattcttcagtcacatttcttagggtaaaaacgaaagttcaggtccaatttccaggctttagctgtaagagactaagtgagagacaactttaaaatggactctgaagccctctgcacctgttaaaagttctttttaaataccagcttataaatcattttaagaagtatcagtacttttgtattgtctgcacccaactgttgcatttcggcaacatggtacattatctttaaatttgggaacaaaaccaggtttgtacttctaacaaaccatgaaaaaaacaaatgttttaaccttggggcttcattgttttgacatgacacgttaccttccttcccccaatatacctttaactgtttctgcaggatattggaaagtagatttgcaaattatatagaaatcctgacaaaattttattctgaagctgatactctggctaagtgaagaaaccaaatatgtcttactattccaagcattatttcatgtacaagattaaagagagaagagctgcttagcccttataaaatgaacagaaaattttccaattcttttatttcatattgtctcttaaatgcaatggggagaaccacccatttttgaaagagttcttccaaaagttaaaaaaattagttgaaaattgatgttctgttatttaggggggaaagacaccttaagagttttctaatgatttataaatttcttctatcactaacaatttttattccccaagaaatttgataattacagaatttgatactcttttccttggcatgctgtgatggactttcgcaatgttgaaaattagttaatatatttcaaatcttgtctatggtttttaaagttcaaaatttaaacctgttacccagtggtataatacagcaagatagtatttagaatcatttgtgataatcagtgaggttctctgaaaatggtaaattgaaagggtcacgtagtgtcatgtactttgataagtcagagtttaaggaataattttaaacattgcctgtgaaaatacagcataaaccttaggtgatgctttagtaataacctttgttctaatatgttaaaattcattttctggtattttctttgaaagttctacttctctagaaatggctttgtatctttacatattgggctgtaggcattacactgcctttgtctaggcagcttgggaactatacagttcagtgctgttgcattataaggatttcgtttattcttaacttccctggatcgtctctctgtgaaagatttcatggcaagttaagctactcaaaggaaggagaccaattaggcagtttcagtttatgttatatgtaaagcagatgcttaataaaattaagaatacaattgaggctctcttctctaccacttcagttgtaactaatatattcctatgcagaattaatgcctctgactgttcattttctaaacagagtggagaagaaaagggaaggatcactgctggccaggcaaagcaaggcagcaggctcaccctgtgcctttcatttcttgcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgcggtctccttttcctccttgcccttctttgtttagcttttttttaatgcttgaggaagaatctcaataagaaattagatagatagatacatagatttatatgtttttaaattcgtatagttgcttgaggagaatttggtcccaaatcattaattctgatataaaaacaataagctcctaattagatagagggaagaaaattgctttgtgttccttcattctttgggttatttgggggtgaaagtagtctttaaatgggatatttgtctctactgttgttattaagtaaagtattttaaactcaatagaaaaagaataaagtcagttttttcccaactggtttcagaatcgccatttgaatagtaaataaataaaaataaataatttcatttgtatttatactttccagtacgaactgcagctggtaccaattacacaccatctcatttgtaatctttcataattaagtttaataaaatccttgaaggcagctttaaatggggctgataaggaattctatccatactccaagatacgggcatgttttctctttcttaaaatttttggactttttaggaaagaaagttgccttccgggtaactttgggtatgtgaatctgtattgttttttaaactaagttttaaaagtaacctcataactgttataattcagtaaatcaatttgcattacaaacccttagataaaagtttgctagttagtgtattagactcaaaaaccacaagcaaatatattatctttttttttttttcttttgagatggagtgccgctctgtcacccaggctggagtgcagtggcacgatcttcactcactgcaagctctgcctcccgggttcacgccattctcctgcctcagcctcccaagtagctgagactacaggcatctgccaccacgcccagctaatttttttgtgtttttagtagagacggggtttcaccgtgttagtcaggatggtctccatctcctgacctcatgatcctcccacctcggcctcccaaagtgctgggattacaggcctgagccaccgcgcccggctgcaaatgtgttttcttacatgtttaacttgtgacatttacagctcttaaaaataaggtcagttaaaattggataaaaattgaacatggaagaaaaagtcgaaatattcatatgacaatctcatagtgaaattgtatctcgattttacttcattctcatcaatggtagaaagtggttatacattttcatgtatagaaatctagaaaaaactcattcaacactaaagagtgaaagtactacggatactgcataaataagaaatatttagccacttgttgagtagctaaataaactgcttatcataaggttctgaaactattactttttagaaatgtcacaaaatccattttcactagtttatttaatgaaaatcaatctggtcttgatgtctataggaacagactataaggaaatcattgctataattgtgaataaaaaagtcatgcttctttaggagaaaagcatggcatctatatacgtatgtacacacccacctgcccacgcacacaaagttattgaatttgatctctaaatgcttctataaaatatttcctaagataaagaatgaggaactctttatgtataaaaaatatgacttctaagtatggttaaagagaaaagataaactatgacttctaggaatgataaaaaagaaaaaatatacgaaatgaaataaaataatttggtttggtactttttctgtagtgtttagtgttaatacacacacttttattagttaactttgctcctgaagtcaccactgacagggctctgagcagagaattactttacttatcacttaatctgcaatactaataaaagaatggcttacttaagaccaatatgaacttcaacattgaactgctttaaaaaaaaaaaaaaacatctagccagatatttgactttgtggttccttaatacagcttttgttttctaatttttctaggactctggttttatttattttccaaatgtgatttgggtgtccttactcatcaagctttttcttgagctaaagttataccaattcttattaagtgatatttcttttcatatgctgttaagatactataggataactttcctgtatgtatgcttaaaggctttatctgctgataagttgggatagaatatatgtttaatttatttttgcctgaattattggttaactggttgtgccacccttagctgtatttgtttgttctgaagaggagctgagaccaagcccatagctagggtattcagccaatgatgaaaatatacagtatatacatactgtagattcttagtgaaactctttcaaataaaacatttctattactgcagtattactggccatctaaccaaactccaaaatgactaactgatatgtgtatgtgtgtgtaattttattttgctgctgcaatataaatctttaaattattaatattattataatggagatcactaccagtttgttcacattcttccctttaaccatgattaaatgaattaaattttaagaaatcttaaggtattaaaggtattatcaatgcaaaattagtactttagatttggaaaaacacgttatagagcacttgaattagtgctgtcttgtagcagttgaaataatgaaatgatgcttaaactggaaccagtatgcatattaaaaatgagttaaaataaaggataaaatggagaaaaccacagataacacagactgcaaaattttgtctttttaaattttacattttgccaaagaggagtccatgtgaaatcagtatacatttcatttcccccaaaatgaggagatttgaaacatattttgagacaaatcttgggtttgggttgcacctgaaacctgatttctttctaaagaaccacatgttaaaagcagaggccctcagtggttcacagaaaacccagcccccattaaggcctgggaaactggattctcttccacctctttatagagtgtaaaacatgcagaagatgattttggagtgcccttgggacataccataacaaggacctaaactattgaaggacttgaattctaagtcatcttcaagaaaggacttcctggctagtcagaccccacctggggacacctagcctcaggaaacaccagagctccttggtggcccagtccaggtgagatgcctccctgcagaggtatcccatgtgctccagtagggacagttatgccctgtgcttcatcctctgcctgggctataggctctgggccagacctggttgctgcaaacattttcacaacttacatgctctaattcaacaaataagaatatcttgcacctgataatgattcacaccctaacttgataaaagctattctgaaagcagctgaatacattaattcattgaatcctcataccaacctttccctagaagaaaaatgagaaaaccaagtttaaggttgagtcagagttttcaaatcctctgctaagtctcttgctccttcctctacttcaagccacctcctcagaataaaagcaaacttattttagaaagggaaaagtgaaacttggagatctttttgtttgtcatagaggatgggaggttttcttgttagaatgggaagaggagcatgtgctaaagcattgtcctaatgaaataacttgtttgacaaattatccagttgggaaaactagacaatggcatttctgggattgtggggagaacagccccttttaaactttggtctcatgaaaatatctgggagaacccagtcctcccagcttccttggtcttaaggtttcttttcactataagctttgcagattttcctgatgagtttattagaggaatttttatgaacaataataattcatgattattatctgagaattgtatattttacagaattttaagtgatgatttctaccgtaagggtatactttttaaaatttgatttgtgcattttatggtgtgtgacttttggagttaaattaatttagcagtttgtttccatgaagactgtttgaaagcatataattactgagttacagcttttacatgaattacacaaaagtctttttttcttcattttttacatctctttatgtaattcttcattttttacatctctttatgtaattacctaaagaattactaaaggtatgctatttcataacaatgctttagaaaatttatgaagttaatataaacagtatatgattaatctggtagttgcactattttgtctctttacaagaaatccctctacgatataatgaaacataggttcatcttgatttcaggttcagttacaggcaggaacttaacacttggtaaaagttttatttcttatgaatcccttgaagatcattttaagatgttgcttatgtggttataaaatgcatcccattaattgtcgtcttttaaaagctggaagacttttaaaggctagatttggaaaataatactgttcctggaaggaaagaaatatctaaaaatatgaaaccatggtgctaaagacagtgttaatatattaaaatttgagagtgggaaatattttccatcactaataagcatccataaaagaggacatttcttattttcattaataagaaaatataatttttataccctgaaaaataaatttagattggattttaatcaaaaatcaatagctattaaaaaattagacattaatgagctagatttatcaaagggccaccaaaaaacaagtccagcctgctctaaaaattaagaattttttcaagtaaagaaggtgcaggtaatgtcatgaactctaaataactttgggtttctagttaagtttagatctcagcattgctccaccaacaaattgtttaacctgtttgttttaacggagttttctcaattttaaaatgggacaatcataatacctcctccgggctgttaggcaagttaagaagttaatatacattaatacaatgtccagcacataataaacaactaataaatgtcagtgtttattatcacaattattaaaactacatataactttaattttgcttgtgtaaaagcagtgtgcttgcaggcaattcttcatgcatcagagtaggatgttcaccaatcaaggctgaaatagagttcatttcgtgtaaaatctaaaagcatgattcaatgcatacagcaatccatgaagaagcaaaatagagtttttatggaaaatgtgtgtcctgcggcacaattttagtgaaataaaaagcagactctagtgctgcaccctatccccacatgggagggtaagtagtagaagctccaattcttaactacttccccggcgccgccttaataatggagtagtacaccctaccttgataaaagctattctgaaagcaactgcatttattttacctcctgtgctatttgcggagaagagctgaacagtagtttgttttgcctggaatgaactactttatgaattttaatgtgtgatataatattaaaagctaaaccaggattaaagaagatttttttgtactaagctaaaatagtacttagtagagtgaggtataaaagatttttgtttccatttttacctggggaaaaattcagctttcatatttttgaaaagctgtccaagtcagtttcccttaagcaatagcttgtgtttaggaaaaaaaaaaatgtgattctagaattctaatagcttatctatgataagatgtgtatctgggccaacaaaatggtaaagaagagctttcctaaatattttttaaatgagtagtacagagatactttctaactttgtaattgttaaagtttcaccctcacattctttttttaaaaaaaaatatttcttgtatacttttttcacttttgttttgattgtgttggctactaggaaatgattttttaaaataatttagaatttgtgcttgattataattgctttaaaataaaaaaaaaaattaaccaaagaagtttttagaaacaaagtcacagggttgaaacaaatgattatagcgcacctcaaagataaattcttaaacatcatttttacaaaataatgaaaattactttaaaaacagatcgaaacaccaactttccaaagtctgttcttttaactattgcttagcagattgctaccaaggatctgtttcttcagtgcactggacttggtgcccccatttccataacattcagttttcaaaatgattgaaatggcttttcttttctctttcatttaagcagtgagaaaaataggtattaaaagggaccccatggggtgatcaaatctatccctctgcctcaaagcaagaccaccccagagcaaagtttccaatctcaccaaagcaactttgtaggcaatttatggtaatgtgttgttaactcttctggctcttaaagtggtgtttaacagattattgcttcaaagccctgtatgtgttctagtggcctccagtcattaatatatctctatgagtgcccttgcttactagagtggcaaagctagaaggggaactctggagaggaggcggatgaggccccacctttggtcacctgtcctgccttacctgctgtgtccccttcaggcctgcgggccaactatttcccagcattatcttttccatgcttggaaaggtggtatcatggtgaaagcatctaccagctttctcaagataagcaagaggtgaattattttgctaattggctagaaattaggattcagcaggcacattttaaagggatctcctatttatgctttaagtacggagaattgaatcactgaatattttaggaacagagtaaaataaatcttaaagtcctgcagcttgactcaaaggctatatcatttaatgccaaaaaaatcatttgtttattctacagcatacttcattttctattttcatggtttatgtgagaaattgtccaggatggtaagtttctagaggatagaaacctgagttctgtaaagtaactgaaaagatgtctttaagggatcagtttgctggaagaaacatggttttgtatctgtagtaatttttcatttatattttcatcagtttcccagtaaaaaatcagctacatggtttttatgtaaattttccaggctagttcatactactgtgtaataaaaaataaatttggagttttaaacatgaattatagtatcagtacattttgaagttgagatttgctttcagcccctaaaattttgtggcattttactgccgatatctgcttatcactattactaaaggcattgatgctgatttttctctcaagattgtactttttgaatatattagtaaagtcactgattatatattttgtgatgcttacagcaatattttatttaatattgtgaaacattatcttattgtgtggtttcacaagtcaaaaggaaatagttatatacaggggtgccaggaaaagatgaaataattatacagaacagcttggacatgcacgtgtaaaattcaaccagcctttatgataattaagcaaggcactctacctgcttcatggatggatagaagatttaaatacgcagttctgcaaatggctttgttatggaagattttttaaatgaaacataagaggaagatgcataaaaatagtctaaaattaaaaaggccatagtatgtaatagctattagtgattcaattgtctattaggcaccgggcacccagtgaagatacagcactgtgcattatgattttaattgtgaatttcctttgttaggattgcaatggaaggtaattgggagacaattagtttagggttttcaagtctttgaaactatttcgttttccagaaaacttactttatggcattataattcctggttgtcagctggcagttgctgtcatattacagatgcaatcacctgtgacaatgtgacttcccttaacttaagcaatctgatctcagggcaataactaatgttgaatgactgcactgttgatcaccttgatcataaaaggaacaacagtgtccagtttggatgctgagcctgagaagcttcaaaacaattcagccaatgaaaaatgacagccatgttcaaaatgttttgtaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccaggtaagagcctctgttaggcattgagaatgtttatctgtgttgcctgtagaattttcattaaaaggagtgtctattttcagtatgaacttgcatcacggagaggcctctgtgtctaggattatttccagagctctaaaatgaaacaatattcaaattcaggttataggcacttagttttgttttttccaatagccactcctcagaccaaggattttatggtaaatccccaagtcagttaataggtattttgagaaggatatcataatggatagtcagtttctcagtctggtctattgtagtagaataaataatgtgaattactattatttcattattgcttagatgatctttattttttttcctactaaaatgctacaaaactttatacagtttcttctgttccaattcagccatctaatgtggcattggtggtatagcagtgagcatagttgcctctcaactcagctggctgcaactattaaatacacttattaagacaaactgacacacacacacacatagctttgcatattaatgattttaatttttctgtagagtatgcaagacacacagattgattacaacttgtccaaccctgaattacagctgaatagccttgaattggaaaagttgtaaacttctaccaaactaaataaaaaaggataggtcgtatagtcttttatcagcataactgtcaaatattaataattcatgttcatcaaaagtggaatcatctatatgaacaaacttagttatctataaacccttctccaaagccaagaatactttttaaaggaccagaagaacactaaactcttttcccccttgaaaaagaatttcataacactatcaaggtgacattagaggcaaatagggactccaggtaagattttaacaacttgaaattttacacaagtatatttttattaccattaatgaatcctaaaacagcctggctgttgtcaacttctgatgaaatacacaattgtgggagtatttataatccgatatatttgtaacataataatcttttcagattttcctaaacttttaccctatcgacatttatagtgttacttgacaggagttttgctttagaagaatgttgttcttgtttaagttataggcctgatgaaatacttaagggatatcttggaaatgttatataaaaatgattaaactcaagctgtggactgtaaaaattatagctttataggccacatgcctgcctacccttcaatcactgtcaaagtgataatttctacaataatatgtttcttttattgtgagattctaaacatcaagtgctgtttaaacattaaactgaattgtttatgttagtgctgtactcagcgtgtcatacatcaggccaccgtaatctctcatggaatgtaaaattctgtcatgaatcatggcttgtatatcggaaattactgtaattttgattggaaattacagggctcttgaaatgtttctaattatgatagaatgttagagccgctttaaacctgtgtgcttcttcagatgtcttcatttacatgccaagactacgcatttaagagaaatgtcctggtctcactccccccccccacctacttgcccaccccacacattcttgttttggctctttagcctaattatgatgaggatatcatatttaaatatatattatcttgcctttcttattctacatttttttttctgacctgtccgatcatcagtaataatcagactgcattcctacaaaagcctgtttccctaaatctccaaaatggagaaactggacatgtattatagtaaaggttagctttaaaacaaaaattaatattataacttattaataaccatatttagttatctatcacctgtcatttaattcaatctacccccacccccgccatcattttcctttctgattccctgtgattgataattcctttgctatctttgacttcatccttttaaatgataccccgggttctccccaatctgggctgagtactgattttggagctatttagatagtagcagcaactggctaataatgtcatataggtgatgttctaagccattttaaacatccctgctctttgttaccctgtcctacacagctcctcatgggtctctatttcagcaatgtaaataagcaaattccaagcatcttctgtgatggtgtgtttcccaaagccccaaagcttttagctaattactcattactagttaagagaaaatcaaaggggccaatagtgggctatgggagtcaagcaaactattaactttattcccttggatagttattctcaacttctaatttactctaacgtcctagtagagcatttttgtagtcttgacttagttgttcagtttaatgttagcactaccctgtttatgaaaacatgtagaaagattgatgattgcttaaaaaatgagacagtccaaaacctgtgtatatcactaacaaaagaaacccgacttaataaggaaaagtggccatttacttaggttctgttctcatgctatgatgttttgtgaaggaaacagaaaaactaacaacaacaacaaaaaaacccttcaaatcagactgacctttttaatggtcaaaatattgcacttctaaaatagatatttaggcctcagatgtgtgccaggacttgccaaaatgaggcagcagtcccccaagacaaaatgtgtgtgaagcaggaagaaccagagtctcttctgtctcagcccatctacctacatctgcttctgtgtcttgccctggttgtctgggttgacttaaccatcgtgtttttttgtgctagaccctatcatgcattatagattatctgcattaatttagtaaccctgtgagctattattttcttacttttacacatgagagtttcttaaataataaatgtagtacagccaactccaaattctctgcatttctcctattttagactgtcttcagggttcaaggcagcatcatcactgaagtactaccctgatctgaggaagaggaattagggatactggtcttattgacagtagaaacagtgagggctttcctttcttcattgacatattcatggaacacaaggttcttaccaacacagagccttcagagtccaggctctatcatacctaatggaggtgggtgtacagggtggaggagtcaaaggaggccaactctgatccaggttgtgtcattggtggtataatattggaaaattttaacttttgagcccaggattcttttaacatagaaggcacatgctacaatgtatgcaaaagagcttttaaattatatagcactatacccaaatggtaacgtttcataatgtgctaagcaagaggttcagtcctccacatggatagagatttatttatcaggtatttatgtatcataaataccttccattttaaaaggtaaagcgtgctctgcagtgactaatgcacagtgtattttcggtaaaagaagccaactcgtggattccaccatttcacatgtattgtctcttcaatgaataatagatatggaattgtttttaactctaatagaaacgtctgataaaatatgcaagtaaaaactgaaggtaggctactttttgtgcttggttaggaaagcaggctaatgcaaactttaaaaagatgatatgctttaaacataatgtgagtagctacaaatgaatacactttatattctgggtattcaaataagcagcagtttttccaagtgaatcatattggaattttatcaaacatttagtctgataacattcaaataattatgagagcagaatttgctaattttactgtttaaaaaaatagttgatttgggtaataaccattacagtatcaaggttcagttactgttcattggttatagtgttttcatatgggagatggaaatggaattttttccttaatggtggcagatgttggaatctaattttattccacagcaaacccctcgagagctctgagacttaaggtgtgtgtccagcaaggagacattagcagcactgtaggccttgccttgtatactgaattgttacattgattttcatgtttgcataggtggagcttgcaggtacagtagtgcagtaagacagtaaagggctttcacagaaccacactgcatcatcacttgtgcttagaaaataatttcctctagtgttttattgaacaatgtatttattttggataaagcaactagctggtgaaaattctgtttgactaacatacttttggtataatatttttgcagtctctgagttgtagtactttctggctgctacaactttggctgatgaataggtatgtttttaatacaaaaaaatataaataaagagcatttctgactatgcaaaaataacatggctagtagaagagactgaataatttaaagccttctctttcatctacttttcagtcacttttgtttgtcattgagattcatggcccctaggatgagagagaggggaaaacaaggatgaaagagagaaaaagaatacctccattttccttaggtttgtaggtgaaagaaaacgtcattctgacctttaggtttggaaattctcacatggtaatggatgtcttaaatgcaagtaagacacgtgtcgcaaatcattggggctagaaatagggctaaaaatgtaattttcattgctgaaaatagatctatagtgacaaaatccaggagtaaaatcatggaaccattgacattgcattctgtatgctagcatgctagtgaaggcatcttttattctgttagaattaaattacacttcagtttttaattctgtgctgattcattcttttggaatgttcatataacagactttgctacaacaagagttcacctgtgtagcctcctatttaaggcacataggaggccctgcagatttgagaatcatggtttctgttatttccggtgctacatccttttgtagcggtctgtgggatcttcacattgtggcctaagagccccttctcttgggcaaacgaagccttcttcattcactttctaaagagagaactgcccctttacatgttctccatctaaatgtgtagaggacaccctgagggggatacagcttctgtctccctgggacccacttgcctggaagaggaggaggcaagagaagtatttgtgaggaaaacaagaagacaagtaagacagtccagagtgtggtccctgcatctcagcagtctgctggtgttaagtttaacacagatctttggaggtccctgtgctccattcttgagtaagaaggatgtggagttcatcagtctctttatttaaggtgttctatattagtggccatttataacaatctcttacatcttaatgttgggaattcatattggattcaattttctaaaacgttgatatatttttatatttctagttgaatgccaaacaggactattaaaattaatggctttaaatattgacattaatagtttgaaggtacatgattgtgtatgattttttaagagctaattgtggatctgaatatgccttcttttgagattcttgcctcctaaaaataagtatgtttgttttagtgtatctaggatttgatctgtgaggtccagaattattaaatagaacaattgcttacttatcatatttctggctaaaaagtcgtatcaagaggtgatttatcccctagacacttggtattacctacctttaaaaaaatgaacagaagatctctggttatcgtgttgcttctttgaaataatttaaaattttcaccttttccccataaatttagaattaactgaaagtcaaatatattttctcttcgacccacttaataagcttaactgttacaaatatagacataactcattaagcctcatttctgcatctttagaagatgtcataagaaaatttttagaccagatttgaagagaattaatttgtgaatattgagccagctttaaggaggttcatcatgtaaggaaacacaaagaagttcactgcaagagtggtccctttacagcaatccagcatatatgttctgaagcacggctatgccaactatgtattcatagaacctgctttaatatgagagcaccttttgtcctaaaatgttagtgtaagctgaaaagtgtaaactaagaatattctataaagttttctctttttggaagctcttctgtattcagctttgtcagttgaagagttagttcttcaggacaggttcgggtgggtacagaaagtagggaaaacagcaaatcaacaaggtttcactcctaacaggaattaatcttaaaactgagtgtcattcagttaaacttatcacacagctataacactgatataatcctttaacaatctaccaagttagaagatgaaagtgttttttcttaaaagtctcagtagttgtcttttatgtttttgataatgaaggtaggttttattttaactttatcttcttttttcctcacatgagaaacgaaaataaagaccctgtgaaatgaatgagctatgaaaatgcatttatactaaaggacaatagaaaaatagctgtggaagaaactgtaccattaaaatttcacatcagtgaaaggtgctaagagaggaatggaagaacttacgttagtaaaatgaatctaatgtagaaattttctgccctgccaagaatatcgatggtatcttaaaaagtaaccttagagattactcatttttctaagtatacttgttatacttttagatatgcaacccatttgcttggcagaatgacacaaatcatagaccacccatttaaaaatatatatatctatattttagagattagtagacatataactactctgtaatttataattacataccatgtaaaaatagaagttgtaaaccatttatgaaatcagcatacaattgtcaaattgatgttttttcccctaagtcttaatctacttctgttgtatattaatagaaaatctattctcctttgattttgtgattcacctattccagttgcctttgtgtatttttttaacaattcccttttcaaccaagatgcttcaggaattgggtttaaacacactgtttcataaactgccagcctcctcggccgcctcagtgcctctgatttcgtaaatcagatcataggcagcatgctgtcatataataaggtgtctgatccttattaccagtttgttgatgcacagactccttcaaattgaccattgcaacacatggtttcccctgaaactagctgtgataattagcgtggttctaatgagacagaatgtcactgatcttgtgctgaactgtcgagtatcgacgctacggatgggaactgtcagagcctgccatctgtgacagcgcttggcatattccagtggcaaggtagagcatgctcaatagagtattttcaaacaaatggcccttttcttgatgaggcctctgttttctgttcaacaggaagaatgcatgccccaactctgtcctatgctaaacccattttgaggtccaaatttgagtaaatatttaaatctgttatgtgttacataagagaggaatcttttgtttagcaggtgaatcttaagtggcatttctttccttgtttttagggttttttttttcttttcttttctttttcttttttcttttttgtttttcctctttttttttttttttttttttgcctctctcagttgtcccatattgtcagttaacagtaaagcagtcatttaagatacttttccccaattttaaaattgccttgtttagaggagatttgttggggagttggggatggctcttagtgataaagcagtctgatttaacagagggaaaggggaattgaaagaagtagttcagaatgtatataagaatacacaggttggatagaagaattaaaatggacaagacagttagatctgtcggctccagagaaaagaagagattttttgctatagtaaaagtccagcgctgcttatcattccaaaatatgctttgttgctttttatttcctcctctctggcagaccacacagggcttgttctgaagaacattttcactaatctgatcaggcagccaaatacgccgggaaaactgctttaatgatcccactaattacctcaagtcaatatgaactgtattattagactgagggaaaatattccattaggtctcccccttgggagtttctccgctttgtgatgtcactgaagccttcaccctctcgcttgtaattaattttatttacacacgcaggcacgcacaaggtcacacctgcacaaccggcgctggccagggagcttgtggcactccggcttaatcagatctgtcataattaccattctgcatgtttctgacacacgctgtgaaatatttcaatttaactgccgctaccagcacaaccagatgtagtgcgagtgtggctgcattggaaatattattcctcaggataaactctctcctcctcctttttcctcccacccccccatcccttacagctaatgtggcacagaagctgatgtatcctgtaaatcttgaatgcagtgctagattgataacaggcgattagacagtttaaccacaaacagcttgttcatttttcacaaatgaaaaccacatgtggtgtaactaaaatttcaggccccccttttttttaagggttggggtatgtatgtgtgtgtaagatgttcttaaataaaaataaaatgcagtcaaaagaagttgtgtctagaaaaatggggttgtctagtttttttccaggttattttatcaaaaccttcatcaaattccatttttatacttttaccaaaattcaaatggtaaaaagattgtattctgtgttgggcttttcattttttttctgtaagtttttttttgtggaggggggtgggtagggtgcataatgtcccttgattctatgccgtattatgttttcagtgttaaactgtttatttgaacctaaattctgaaaggatttctaagactggacacaggtagttttctaaaggacagcttttctttcttttttttttttttaatgcaaagttgttacttcaggctttatagtcagataccagacactcaaaaagcaaaaatggccccagttaggaactttatttcatggagatatttgtggatttgtgtaattgatttgaaaggcagagttggaaaccctgaggattctgcttttatagaaattggagataacctggcgaaatgcaggcacagtaggtaactgtttaaggctaaagttatcaccagtctcggaagaatccccctataaataattggatccataagaaggcagataagctggtggaaaactaaagctaagagcggaggaggaaataggatcagtggtgtttttgaatcatacgtcctggaaccagatcacaacaatccactttagagaccatttaaaacatagatatagcctacttaaatatcttttaactccaaataaaatacactctttttctttttatctttatttttgttttatgacttcagttatgaacctagcttggaagctacttagaatggtggtggtggtgattcctgctgtccaactgagagaaggtgtactttcccaaagaatagtgggggttttttgattccttactcattttcccttttgcttagtagtttcctcatgtcgtgtttctttttcttctttgtataatctttgcttcctagtttttttctggaactttcttcccacttagtctattttccatgtgttttgtgtttactccacgataactttcagctttaaaatctgatattttttcttcctattcatagtttcttttggcctaaatatcactttaaagggaaaataaaatactgtctttgccttttagttagaactcttcttccatctaatttaggtcatttgtttctcccatcttaatctacctttgtaatcattttgcaagatatagttattgtagaatatttgattcaattcctatatcacaacactctcctgatgagtacagatatcacctcagaacccttcttaacacagaagtaaaaatacccattgctaatcagggagataaacccatccctgctgtagtcacttgtattttaggattcccaaatgggggtttgctattcaaagcatagttgtgtgggataagtcaaagaaataagaaaagtggaggtaaataaaatttatggtttcattgctaatgcccttgctttaataaccctgaagttttttgtacagctacttgaaggtatgttagggataagccagcatgcaagttcagtcactttttgcaatcactggtggagctcaccattaaaaggagtcctaaattgttcctttgcaaatgaaagatttcacttgcaagataaaaaattatcccccagtttttcatgtttgcaaacatttttgtgtatttgtatttctttgcctggcatgcctgttaatacaaaagggaacagaaaagagaggggaaaaaagttgcttcgttagggatgctgttgtgtatacggagtttaacaagatcagtattctcagtacaaagaaagagcacatcttttcattaaattaatcgttagactacaagaatcctgcgtttcaaagacaaattatttatttatggacccttccaggtccctatctaataagaagacattttccatttgtctgttaacaagtcaccgatgaagaatcaatagaagtgttacaaactttatcttgccccaactgaatccaccatcctcagtcactctgcaattgctattcttcagtgctctcatatcttcatgaaaacatacaggaaggaaaagtgattccttttaatgttctttgttgttttcttctggacccactgtcttcatttttcatcatcattgttgaagtcatcagtatcatttgcagtgtagcctaagctgaaaggaactagagggcatggctcctgattttctacataatacagaaataaggtaatagtacctaatttgcaaactcaccgatgttttacctaacaacttgtacatgaattgcatcattcatggaaaacattgggaactgcaaagagtggtagtcccagttccactgctaacctgctgtgtagtcccaggcaagccgtttaacctctcagacattgaacttccccttcaggaaagtaaaatagattaggtcatattatatctaacgtcccttaaagttctaggtctgtgtgtttgtgactgaaacaggtacacaagtattacagaggatgctattttgattgaagacactgctgacaggtgttctagtctgggaaacaaaaggtaagagtttggataatggaagggcttagtttggggggtaggcggaaaagtgatattttggggtctagagccaagaagggttatttacaggtggcatataatgggttgaattgattgttggaatccagtatatgaactccatattacatggtgtgagttgagctcatgattgatatacacttttcatctgagacttgttgatagatgactgggaactctccctattatcatacagagacctagcagcatcagtacagtatagagtatgagatgagccgaattccattggggaatgggcttggtttaatatgtggtagggtggtgattgctagcatgatatgatttgaaggttgctaaagactttcctctttaaatatgtctcttttttgtttgcttttcaattgatgcctgaaggtccacccttagctgctcttttgattgattgattgattgattgattgattgattgatggaagtttttttctggcacattaaaaactttaatagcacattaaacgggaaagcagggcaatgtgagaatactcgattgatgagaaatcacagatttggaagagattagggagatagggagtaaatacaaaggaaaaggaagcagggagtgacagctcatttgagagaataccttgaaaaaaaaaaagaataccttgaaatccatttttgcaagtttataaattggtacctgtagcatttaatagctgctgagatgtgtccatccccaaatgtcgcgtttaaatgtttacccattttacttatggtaccaacaggagtgctgcttgtcatgggtgttacttgactggtttactgatgaagtatttggttgtttaaatgaaatgcagattaggtaaaaataaattactttcaacaaggtcaaggaagtgaaggttgtaaataaaatatacattcacaaacagacaaatgctatttggaaatctagcttagtccatgccaagctgttactgtctaaattaccttctttcttcctggcttgcaattaatttttgcttctatgtttggagattgggggaagggtaatagcctaatgggtaatgattttattttagtattttgattaaagagactaaatagcttggaccctggataaccataaggacgaaagccttatccatcaagcttaatttctaaacagaagtttatgcttgtatttctgagcaaattagcattgagccacatataatataaagttatcagacggttatgtgctcaattattttctacctgtctccccccttaccatcttttctactcaccttctttgatcttctgttagactggaggacaaggcacaaggcagctagttagacaaagactgtatagccatgtgctctttgagaggcagtgatcagagagcagggactggtatttgatcactgctagtttcctagcatttgcagagccactcccctccccgaccctacccacccgcacatccaatgcttgtgccactcttccattctgtatcctgcctctatcctgtatctgtcctaccttatctccttctatttggaaaacccctgtgtctttggaaaaacttgttggtgttctcctggcaggtagacatttctgaaaggatactctgctaatcttatttacctttaaaattacttggatgacatgatgtcaatacccgtaacaatttagatgctttattcagaaattgtaagcccaatctctgtgtttgtaacaggaccaggaaaacaatgaggtatatatgtgctagtgcaattgtaaaccaaaaattgtaagctgtagaaccatcatttaattaatgaaatctcattcagaactgaaatatataaatgagatgaaagttttctccattttgattgacctgaggattgaatgggggcagggaccttctcatcaaccccttaaccctacacatacacaacgcgggtacttctgaaacacctctaatggaaacctggggctactgaggacacagtctaggaacccctgtggtagtgactgtttttctctaacccatctctaagaggcatggtccttcagtggcaaaaaaaaaaggaaatttgtttcacaaatccataaatactaagattttctaatatgttaagaacttataggagatagttctggaacagtatttgaagtgtgtctatacgtacgtgtgtgtgtgtgtatatatatatacatacatacatatatatttgatagctatgtatgtatacacacacacgtttatgtggggtaagaggaagggtcacccatttaggggttcttaaccttggcccaccttctcccccagggaaccatgaacttggatgaaaaaaatgactttattttctccaacctcttcttactgaaagttgacattttattcaattatcaatataggcaacaaatgacagtagcaatacctatgaatttgtcaccattaaaaaaaaatcacaaaatattttcctgtcctattatgttgttctagatatcttaaaatatcatttatgcccatcactataaaattacagtagttattagatctgttgctaaaccttgttatttagtgtgttaataaagaagtatatatattactgtatcacaaatttttgatacctgtatttcagtataattgattttctttgtaatcttatgtattttatttcaggcacataaaaacgctgttctgaaaaggcatccatgggctttaccagactcccagaagggtccatggcacaagagatgagatcaatgattagataaattttgtagaggaaaaaaatatatatgtattttatcacatgagctgagggattctcaaattaacctgagaaacatttactttttgtttattgcattttggtatgcttgctcttcaagcatccttcactccaaagcatgtaaacagaggtaacaatgatgcagtgacatttaaaacaaccaccaaaacagaaaccttccagacaaccttttctctgatattcgcatgcccacatgcagtgctgtaggactttgtgagagaacgcctttgcttttagattagacatttttttttccaattgaactaactatacctttagtatcaacttaaacctgaagtttaagtggttcttacctcactggacaagaagttttgtccccacatctcctgttagcctacacaatgactagcacatagatggtactcaggaattctttgtaggaggatagaatgattcagaagtaaattttaatcagctcccaatattaccctcacaaatgccagcctattccaaagggagtcagtgtgggacagtgggaagaggcgctggagtgggctcacaaggatggagtagggtcatgcttcactgctgccattctcccctggagccttctctgagcttgctttccccagatgtaaaatgtggtcagaggagtgattgagacagtctgtgcaaagccccagtctcccttgtctccttttattggtaaaattataacccggccattgtcactgagacccacatgatgcttctagaaatatttatgcttgccttttttaatgcctacttgtaaatcacaagatttgggtctttcaaattaagccaacttctgattagcaagtttgtataatggataaaatgatgcggttttggacactttatcagcaaaatcataggcaagttgggagctcatagtgaccctgcttgcttgttcctcttagggtgtgattccctaacttttacagtcccaaattgccttgccctgcttttaaaaattttttgttatctctcctaaaacatcatagagggaatatttaaatttttaattcccagtccctaaatatgcataatagggagtgtagctcattttaggatatacatgcagtgttgaaaagtttcacataaatcaatgtaaaatgcagtggcagaaatatttatccaaatcaacctggtagtaaattatttttgtaagcagacaaactaccctgtcaggtaaattgtcaccttaaaattattctttttatgatttcttatatttatttggggttttggtttttttttttttttttttttgcacatggcatatatgaatattcagcaatattttttcttaatgaccattattttgaataggaaaataaatattataaatttttaatagtgactttaggaagcaacataataaatttgcttcataacattgcaatatgagagcacatactcatttgggttaagaaatttaggaaaagtaaagtttcctagcataaattcttctttttaaagaaaataataattttatttgcctttgacagagttttttatggtgctgtcctgtcttaaacctattatgctgagctcaatttgaaccttattttttttttgaatacagaaacatcattatgaatacagattgttggactttgctactatacatgagccctcagaaattgcagaggtgtatacagtattttaccactaaatagcccagattgggccatttttgtatctttctgtgtacccgcatttgctgccgcttgaatttgttgtggtgaatcctttgccgcatttttacatttcactcgttgaagtgtgagcctcagggtgtttccaagctctttgggtgaaggaaagtgaggagtttgccactcaaagggctgtttgtgttcacatttgtttgtgataaatgtaactcaaatagcagggttgggggtgggctggaataaagaaggccatcagaattagattattgaagaaatgctgtgggactgaaccacagcaggaggaatggaaaagaaggaacaaattcaagagatgtttgagggagtattgacaggaattcatcagttatggaagagacagacaagaaaagttagatttttagttaaagccacttgctatatatttttattacaaaactaatacctagctactatagaaaaagtagaagatataggcataaggaaaaacataaaattatccataaatttaatcacctagagatgaccaccttaaggatcctgattgacgccctttatacatacacacacatgcacatgtatctatatgtatatatgtgtgtatgcatgtatgtcttgcatttattcatgtgctgaacataccatttaattccccactgagatgtatttaggctatattcaacttttgctagtacaaataatatgaatgtaaacattatagttaaatatttgtacatatccttatttccttaaatccttaaaagtgaaattattggatcaaaaaggcatttgtgttttacaggtgattgctagatatttccacattctgcaattcacagtgtccttcagaaagactataccaatttatgcttcaaataacagtctttcagcctaggtgattgggtatgtggtaatactattaactgagtaaaacttcctaggagaacctggcttaggggaagatgcttggttcagactggaatattataactgaattattttcattagcccccttgatattcaaatcccttgtgtgataataacaacaataaaataataatagcttacattcatcatactgttactgtgtgccaagcccttttcatgaattattttacttaattctcacaaccctgtgaactaagtggtaaaattagaccccattttatagagcagaaaattgaggtttagcgaacctgagtaatctgcctaaggttacaaggctatgataaatggtagaatagatattcaaattaaaacccagacttcttaacaaatagatcttaaaagtccagtagaggaaatgaggttacagtaactaagtagtattctcaagaaagtatggtaaagagctattaaaaaagggtcatagacagttcaaaagcaactggtctgttttcccagccccctgctaattcatcttgttctgttatttattatttttcctgttttaaatattgtccccttttcaaatccaagccagtatttctcttcatcaatgaagaattccttgacaaccctacctcaactcttcttctccatgtggatccacttgatgtctgcccatcaatgacctttatcacatgctatcttgcactaatagttatttttgaattccaggttttcccaaatgtgcttggagacatttaaggcaagtgctttcagtaaagtttataagaccttttggtagttaccatggagcaggcattgggctgaatgtattctgtttcacttgtactggctactatcctgtgagattaataccattattatctacagtttgtagaggaagaatcttgaggctcagaaacattattcaagttcacatagataaatgcctatatgagatataatcattttattggcatacagaagtgcttgagcgtgtcttgaaagacaagtagtatttgaatgggcaccaaaaaaaaaaataggagaaagggctttcccattagagagaattgtataaggaatggagaatagaatgtagggcagtgctcagcaatagctaataaatagcccaacagatttggacatcagtgtcattgggaggaacctcgaaaacagcccctgagagggtgaacttttctcctaccttgggaagccactgaaggtcatggtgcacagtagggtaactatgggcagtttgaaagtggaagactaatgtaaagattctcactctgggatctgatttacaaggatatcacaaacatggttaagaggattcaagaaagcttaattaaacccgtttctttacctatcagtaagtttcatgggcgaaattaaacatcagattaatgtgcttttttgtaggaatcacatcaactctgtgtgatgacactggttctctattcttcttgaaaactctggtcatcattgacttacttttcccctaacttaagagaggaaaaggaatgattacttaaaagcttttttgttcagaaatcaaaataattgcccactggaagtaattaaaaaagaatgttgttgtctaacatagtaattcaaggaagaggtgctccagttctgacaagtcaatagtggtagaatggaaaggagtggatggttcttaatgatagaaagagacacgaaaactgatgaaaatgttacaccatgaaccttcggagtactgagttttctgttttttttaatgataccagctatgaagaatgaggagaaaattaaaagttaacatttgaagagaaagtgcataaatgttaaataggagccagatcatatcactgaaatttatgtaatgtcaaaaatatatcttaggctgacgagaaaaaaaacgggaacattttttttcagagtccttattcaagtatcagatatataagccagaattttatttgttttgtttcagctttgactaaactaccctaaaagcaggtttgacgtatatatgaaaattaaactttcaaattaggtattttccaaatctaatgttttaaaaataaattcagacctttttttggggaaattctctatttcaattaagagctcctctttttgctaactggtttagtgggttgtctagaattttatacttttatgttcattcctgtttgtttttttctccccccttctcaaattctccctctgaaaatattctttaaaatgtgagatctccttgctcaacaacctatttaagtcagaaccatttgtatctgctctggccaggttgtcatttgataatcttgttatggaccaaatgatttgtagcctaagaaaaaccaccaaatccacatgtgccctaaagttagtggctttgaaaaagtagagaagaggtaaacataaataccattaaaaacaaatgatttgcacctttttatctgattaaattgtaaataaaattgaaaaatgaagatcatttaccagtgactgtgagtattccttccaagttcacaaaattttaatagaaatttttctccaggtttatgctaataattttctttctgtgtaacctttagaaactctggtagaggtgtttaacttcttaatgtctaagtggcaaaaatttactcaagcaaaaaattttctgatagccattttatgtcctattattaccccagtattggaacgcacaaatttttggctaagatactgagtctcttaaataaactggagcctctagagagaattcaaaaacagtaacagtttagaagttaagaatagtaacatttaaaaagaagattattattatttttttctttcagcaaatatgagtatcagaaaccacactttgaaaaataaacatattgggggatacatacatgcacacacatatgccttttaaaatatatttcctttttaaaacccgtctttgaatcaagtggatgtaatgtgctacttttagaatggaaaatgcatttactggcacgtctctgttcaaatttattttccatgttttctttaataagaccaatgttaacttagcaggaaaagttacttacagtgccagctgaggttcttttcactttacacaaagtagatgttattaagctggagagaaagattaatgcatttcctactaattccatagaggagaacatgtatctttattaatgttaatggtgggggcctctcataatgttatagaataatctgctttagcgaaggtttttcttctaaagaacttcataacatttaaaggttaatatgttaggtaaagaacaatatcttaagacaagtgtttttattacaggacatgatgggatggtttatattaaattatatgatgatttgaatgggaaagaagaaaaagtgcatcgcttcttgccctcaactttaatgcctttaatcaaataatgaccttctggaaaatagttaattttaagcatttggaaagatcaataccactttgccaccaaaaaatggtctagatgatgaaatttgatgtatttaaagtatcagttcacccttttaacctagtaaataatttaaaatgctttcagtattgctttgccactgtttctcactgcacagtgttatgattcttcatgaaaaaaggtcacaagtgggtgtgtgaagcatttagacctcacacctagaaatggggttgtatcttccttaggtcttgggtgtttctgcattagccaccccctcaaaagtatatatatttaaatagtacctttgaggcacagtgtgcataaaacatatgaaaatagaacccttctgtaactatactgttgtaatattgttttagttgttttttcagacagaaaaaggggtggtttaaaacattattaatcacttggcatctttgtgatatctttaaacctttatgctaaaggtgaaggatttggtagctctgacaattagaactcattttcccccagcttgtagaacacactgatatgaaattacccttgagtgccgacagctttatttaaaaaaaaaaaaaaaaaaaaaattgccctctattagcatgtttgtgggcagattaaaaactgtcttcattagcataagtaacacttacagattcttttaaaagtagaaaattatttgctgaatgataaattgctagctttatagttagttgttgttgaaaatgtactcattcaaatgcctggtgtagtttagtctacaatactgaattttttgttagaagtactatttaatggattatgtacttaatccttgttcctactacttgctgaaatgtaattcatgctttccactaaaatgtttgtatcaaatactttcctatttagattgatttcttttaatatcatatattattatactgtatgccccagagattggaacaaactattcctgcaaataacacataaaagatgagggtgagggggaataaatacagactgtaaaatgttttgctttttagaactcaaattaccattctgttttttcagatgtatttttccttcttagttgcagtaagaattgtcattttctttctctttttatagctcttagttttaaaatgtatatgtacataatgataatatatacatatatgtatattgcattaaatgactttttttctcagagaataccaaagtctgtttcctcctggaaaagtagttatgttacatactcccagctttgtcacagaacaggccttgttaggggttctcattctatgcatgtgaggctttataaagtacaataaattcatttatgaaaggaggttactttcttgactcaattaaaatcattgtgcaccccttccttatctgttaaaatgttagaagcgaattgacttgaattaaatgttgtaaaaagagtggagtggaaatcagagattgagtttggttggaaattagcagctgagagatgaaggtgccaggatttttatttaaatgtggtacaacaagattttgtcagtaaagcacatcattagaatattgagtttagaactgctaatttttcctttaaaatgagcatacagtcatgtgtttcatggaccataataaattgccattgtgttatcattgagtttgttttgcttttttgcagtactgatttggcagttattctgcattttctcttttcctttttttttttttttcaatcttacatttctttaatagatccctaaccaaaaccagtcaaaagaatgttatttatttcgtacagtcttaggtttagcatcttttgcaccattttcttgcttacggtagcaagacatttgcacatggttcttggttactataaagtacataacagtatttcctttgtggcagatggatttaagacttttagttctcaataaatgtaggtttacaatacataactttgcaggatttgtgttgtatataacaggtttgaacatattatctcagaattcatctgcatggcattttcagcttattcagcgtccatgccagttttttttaagtaatagggggagcactgtgattgattgcaacagctcaaggcgtgattttgaatagaaacaaagggtttagaacagaaggtgtcaaattaaactttgtcagtttgaaaagtagtaacatcctgaaagttttactaatttatttacatgtggctactgtttatattttgccctctttatatgcagtgtaatgttgcttggcaaatttactacatttaaagtttaggttgttccttgtaccattttagttttctgagaatggatcggtctcattattttaaggctgttagtcccctgtcttttctactgttcaaaacagttgtgagctcatttaatttagagaacagttccctgttcttcctatggtcttatgtatatcaagtcccagagacctctcttaaaaacgtaattatgttttgttttgttttgttggtgttttttttgtctttttgcaacaaagcactgcatttcattcctcatctctgctcccccacataagtctatgcagttaacacttaaaaactagtacagtactttggggaatcattatttttgttagatattaaaaatattgtgacatattcattttcttcccaagtttatttgttctaacaatatcacttgtggaaaactgacctagaaaaaggtactgaagcattagaaagcatttggcttctttagtcattttctgcaaaacataaatcagattactgtcattattaatagagtaacaatcaatagaatttgaggtagtcaaaatattccaaggtatttaaatagcattagaataaattatcttatttttgccagtgtaaactgggaatgagccaatttatttctacactgacagagagctaatgtgtcaaaatgtctgttttccattatttttttaagagcaatgcgcatcaagagaagcatcccctcccccttttaaatttttttggaataccctttagagcaaacagttcccagctgcaccgttaaatatttttctaagaagcatctgatttcagtctcttaaaatcatcgcatttcttgaaaggctagcggagacatgcttcgacttataattcatcaaattatttttagataaggaattagaagtattatttaagggcagaggttaatagcaaactactggaaatgttatgttagtcatgggcaattaataaaaataaggatctgtctcgtaagtctagagacacagaagtgacaatatgagcaaaatatttgttgaatgagtcggggctctttttctgaaatatttgttaaaccagcatgagtgtgattgtttaggaattagctatcattattagccattttaaaagaactaatgattttcttttccaaagaacatctgtgatccacatgtttttttcacatatatccaagtgctaactgatctctgcattactttaaaaagttcctaaaggatgtgaaaaatcactggagtttttcagctctctccaagaagcttttcttacatgaatcattcttaatttaacttttagcaatttttagttacaagcatttatttctaaaaaaaaattcttggatgctcaatgtttagcatttattgcaatagtagaatgctagctgagtttaaaaaaaatcttctgtgttctttatgaacctctaacttcttttgaaaggtatataaaactgtgtgatttgctgtgttcgggtagaggggttctgtcaattatgatagctaaaggaggcagacaagggggagagggaaagtaatctcacccacagttaatattcaagcctaccagaagataatctatctaaaacatacatagcaacaaaatttaaaggtaaagtataaagaatagcttagttgtaggaaaatgtatattttcatggcttaattcagatggcaaatatttaccagtaaaagctaagtaaacatctgcagggcaccatatgcaagtgggtctcagatacttcagatgttcacataacagttttatagttaatatattcacataaatagagctgaaatatgtcatattatagtattctggaaataaacatagaattgccatggttagaagagaagcaaattcagtgacattgccatcacaatgatttttatgttttatttagctaacagtctttcaggtaaatcttcagtttactgcctgctgtcttaaccttgaattatgcattcagtggcatcaaatgagtgcatggttacaagaccatgacatgcatatatttgcttaattaaaagacatgttgaataggaatactagtagatgtcatgagatacagcagtcgtcacgatgagctgcttagcagataggccttaggaagccaatatgtcagttttctaccttttcttttaaaatatttcaaggaggccatttttgggagaacaggccatgcttctttccactatacatattgcagttgaagaattttctctctaatcgtttcagtttgagaagggaaggaaagtcatgccatcctctggcctcactcctggtaacataagaaacaaaaccctccttggctagatctaaaaattacataattaaaaaaaaaactatacttccattttcatccaactaatttatttaaaatttccgagaaatgtctttgtcttagatcaagttccctaaatgcagagcctaggatggggagtcaggtgatcatgatttggtaagggccctgggaagaaaggaggaggatagggaagcgaaagaggtcccataaggatatggtctcaggcaaaatctagccccagattgatggagggagcaagaagaatggggatgactgtctctagagagtaaattgaagggtagagtaagttgtccattttcagaaacaggggcagagactttgtgccactgggtcagccagtcactggccacccggggtgaggaggtcaatgaagaagtgtagagttggtttcaagacattttttgagagcagagtgcaggtgagaggtattagcaggcagcagaacagctgaggggtagctgccttggctggtgggggtctggatcagacacccttactcttccccttcactccattgtttagtgtccatcatggcagccaaggtgaagactcgagatgactggaaaatatattcttcatgatcattcagttcttgatagataacctcagggtaaaaaaactgggccttggaaacatcagagaggtgcagattttggcagtcattggacatttccttctctcttagcccaagaaacctattaaattcttgcctgacaaatcatatgctcccactgcagcaggcggaaaaataggactccagtgtctctctttggagagttctttcatagcaaattcctgtaatgcccattctaatcattatgccttatactggaaaacattcttgctggtgtaattgcacctgtcctttctgtttcatacatgtacacacataaatattcacacacagttttctttcaaatccaaaaagtacaagcttaggaaatccttttagaaaaaaattatttctaaaatctgtcctgcctcttaggcacttccgtatcctcagatggccagccactcgtcagatagcaaagttgtgcaagactgaagcacatcaactttgtttttctcctatttcatatattaaaaaatctgtgataaatgctctgttaccctcagagtctgaaaaaatatgtccctcctttgagatgcaaatctgaactttgattagaaacagagtctgcctccttgacagccacagataacctctcttaacaagttaaaaacaatttttaaagcagaatggtgtgttctgagcttatgaaaaagttaattcatagggtttttcctttttagctcctaatggaaaatgccagcccctctcataggcacaaactgacctattatgcccttgtctctaagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcaggttcgtttactttggccaattcagtatagcaataagtaaataaagctttaaacttagcagggaaattagcgtttctcttcctcctgccagtctaaccataggctttttagcaagagataacaatacactgccatcttgctcagggggataaaatgaatattaacatactttttccagcgtatgtatcgtgttcctctttcctcatctcccagccaccaaagcaacaggaaccccttttttacactcgtttggcaaatgtgtctttgttggtattgggttttgtgttaagagcttaaaatttttgtgtgttttttaaaaatcacaatttaaaacaccacctattttttaattaataccacagtgcccctgaggaaaagagcaaccgctgttgctgtaaaggaagtttgtagaatcacaattttatacattggattctgtccagaaagaggaggggagggaagcttaattggaatcttgccttacagtccttggcccttccttcaccttgtatgtaatagctgtctccccacactttacagaatgtaggttaggggtgagtcatctctgtttgtctttcctttagagcccctctcccaccacccttgggaaaggagagtctagaggcgttttcttaccaggcctgccgacccctgcaccatggctcggtgctgctcctcaggtgagcgggcacagttacctatgccaccaagggacacagagagggggtgacctaaagacctgctccccaggtcaggattttcaaacctgtaaaggccctactaaccatggtcttgggcagagctcactgtgccagcagatgcagccttatgctttgtttgtcatgtcatgggacttgtcaccattcatctcctgaagacactcttctgtgaatttagatggaaaagttctgggatcaggtagtcattagcgctcttagggccccagttgcttagaaagcgtgttgtcattgaacttgagttgtatagcttatttttgttaaaggggatgattttagctctcttttaaagtaaaatgccactgccttccagagtcctaaaattctacctctgttgagtcacctacattctgcaatttttttgtatttctgtgaaaaattatatatatgtgtgtgcgtgtgtgtatagatagatacgtataactaaaaacagtaataaagttatttatctaccaggataaaaaaattctcaagtgtgtattaaagataaaacaagttgacaaagagcttccctttaggatatcaagcactaaaataatcgtgaaagcctgaaaaacttactgtttagcaaaaacaaaaaagagaacgatatatgttaattaatttaaaaagtacttattcgaaaatataaattgtttttaataaaattgcttcttaggggtataaaaggaaatgcatagacacggtatcagcattctaatattttgccacttaggttgatttactttgctgataagaattatggatatcgagtgtacagtatgtgcatgtgtcacatatttatgtataattgtgtatggaaattgtagcacatatacatatactaattatgaaaaagtgtctgtatacactaaatttaaatcctaaccacatctgagtttgctatagacaaaacaattcgctagctgtcgtatggtggattgaaccttttgaggtaagaaaaaaacttgcagtgtcagcctagtgcaattcggtaagaaattgtgtgtgtattaaattggaactgtctgatagaaaattcacaagtgtgagaatatcagaaatcctttagtctcatgacagataacactgaataagagcataagctcatcttctgttcttcctggccatccaatgaaacggagcagaacacaaatttctttccccgctgctctgtagctcacctttctgaaatgtctttgaaatcctttcctctccatcttcattttaaatctttgttaattatttacatcataatttgatgtgctgtcttcgcctttgatgcgtatcattctagtgaattttatggctcacattttcagagcactgagttttcacttcctctgctgatctctgataagtaagtgcagtagccccccaaagctgtcttaattcatcccttcctagtcatatcattttgatttttttgtaaatgctgtcggccatttcgccggcctaccttttctttctaaatcttcatccctatcaaagaagctatatgtaggatccgggaccacatttttcctgattggagacggctttgtgtggaactccacgatagcagagctctgattgtctccttgtttctttgcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgt

SEQ ID NO: 36405 - DNA, 25374 bp, Homo sapiens
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcggtgagttcgcccaggtggctgcgtgcctggcggggagtggagagggcggcgggccggcgcccctggccggccgcaggaagggagtgagagggcctggaggccgataactttgccatagtctcctccctccccggaactgcccccagcgggtgactggcagtgtcaaggggaattgtcaagacaggacagagagggaagtggtggtctctgggagagggtcggggaggatataaggaatggtgggggtatcagggacaagttggggctggggccggcctgaattcggtcagattgggatttgccaactatttggagccggggggaggggcttgagcaaaacagaactagccctgccagctcgaagaactctgggcacccaggacacatcggagtggcagaaagggtcctgttagaactttgttagcgggcttggcactgtgctagctttgcccaagctggctctgaacacatgatgcccactaagacataactctcaagttggcatctgtccagcgtgttggagcgaggtcaggaaggcagggcaatcccccttttccctcccaagggcttggcggtggccccccctcagcatgaccttgtcctgggttctaagggttgggaagttctccctcactctgccactctgcgtgtctgggaccttccttgggctctgacaggcccaccaaaagagctccgggagatgagagatcggctcccccgcagctcccacagcccttggcctgcttggcccaggaatgcaagggagggagggaggcagagggcagaggctcccagctcaggaagttgtgttatgcccaggtctggccgcactcctcccttggccctctgcctagtgtcttcgagggttgggggcactgtccttccctccttggggtgagccactttcattttcccagcggggccaggcagtctttgctcgggcccatcctcttagctgctgacgttttgatctttgtcttattgaagtgctggaatacagtgacatttttgaaatccagccgttggaagattcaggccactcccactttacccacccctgccccaccctaccccaccctactcaactgcaccttcttcttttctaaaaaagcctttgggagcttggaagtataggccctctcttccagccccatcaaaatttgtttcccttcttcctgccttccctttctctatgcagacccaggccaagagcactaagggtgcttggagatccgtaaagggctgttggctttgacttcttctctctcttttatcatctactccaaacttctgctcttcctagaaccctttgctaggtgtggttttgttgcccaggctggagtgcaatggcacaatctcggctcactgcaacctccgcctcccaggttcaagtgattctcctgcctcagcctcccgaatagctgagattacaggcatgtgccaccatgccgggctaattttgtatttctagtagagatggggtttctccatgttcgtcaggctagtcttgaactcccaacctcaggtgatccacccgcctcagcctcccaaagtgctaggattacaggcatgagccaccacgctgggcccatcacccttctttctgaagagtcaatggaagttgtgtgtaggaagacaggcttaacggtttttttttgagacagggtcttactctgtcacccagactggagtgaagtggtgcgatcttggctcaccacaacctctgcctcccaggctcaaaagattctcctgcctcagcctcctgagtagctgggattataagtgtgtgccaccacacatggctatttttttttttttttttttttttaatttttagtagagatggggtttcaccatgttggctaggctggtctcaaactcctgacttcaaatgatccacctgcctcggcctcccaaagtgctgggattacaggtgtgagctaccatgcccggccatcaacctttattttgtttttttgagacggagtcttgctttgttgcccaggctggagtacagtagtgtgacctcaggtcactgcaacctctgcctcccaggttcaagccatgctcctgcctcagcctcccaagtagctgggactataggtgcctgccaccacgcccggctactttttatatttttagtagagacggggtttcaccatgttggccagggtgatctcgaactcctgacctcaagtgatctgcctgcctcagcctcccaaagtgttgggattagagacgggagccactgcgcctggcttctttttttcttgagatagggtttcactctgttacccaggctggagtgcagtggcaaggtcatggctcactgcagcctctacctctctggctcaagccatcctcccgcctcagcctcctgagtagctgggaccacaggcaggcaccaccacccacagctaatgtttttgtattattttgtagagatggggttttgccatgttgcccacagtcttgaactcctgggttcattctgctgaaagagaccacacctgtccttttctttatttttattatatttttcagagacagggccttgccctgttgctcaggctagagtgcaatggtacaatcataacttgctgcagcctggaactcctcctgggctcaagcgatcctaccgtctcaccttccggaatagctgagactaagggcaggcaccaccacgcttggctaatttttttttttttttttttttttttgctttttgtttgtaaagatggaaacttgctatgttgctcagctggttccgaagttttggcctcaagcaatcctcctgcctcggcctccggaagcactgggattacaggcataagccaccaggcctgacgccaggcctgtcttttttctactagtgatatgaacaatttagttagcaagacagataggaagcaaggaaggggagacccagagaattcgttgcattctaaactagtccactcatctaccaaagccctgtgaaggacatttttagcagttttagcagttttctggtcaaaactttgatcgagaaacagattgagtggattcgatattctcttgctcacccagccacgccagtttgtctcctctgcctcctagtgcagctgtccaggcctgggacaccaggcgggtatgtgcgcatgtggggcagggcggaggtggtgtgtgtacttgttatatttagccacctccctctgttctcccccactgatcctggctggaaaggctgggcttccggaaaagagaggtggatttgcacacctggatcccaagctgatagaaagtggggtgaagacaaaggggactcagactggggtgtctgtcctcttctatgcccacagtaggaggagccaggattggttactccctgctgggtctgctgtgctcagagtgaggtagagaagtgggtagagtaaagaatttgggagaggaaaaaaggcattttcccaacccctcccaccaaagcctagagagaaggtgttgtctggtttaatgtttaattagagctcagagttcagggccagatttggagttgggatggaaagttgtttttaagaccctgtagcaatttttgacccagcctgggtacctcaaccacactcaggagtttgggggaccttctgttgggctggattataggctccaagaagaaacccctttcgccaatactctctctctcttctttttttgagacagggtcttgttctgttgcccaggctggggtgcagtggcatgatcacagctcactgcaacgtcagcctcacaggctctggtgattctcccacctcagcctcctgagtagctgggattacaagtgtgtgccaccatgcccagctaattttttttttctttttttttttttgagacggagtcttgttctgttgccaggctggagtgcagtggtgcgatctcggctcattgcaacctccacctcccaggttcaagcgattctcctgcctcagcctcccgagtagctgggactacaggcacatgccatcacgcccagttaatttttgtatttttagtagagttggggtttcaccatgttggccaggatggtcttgatctcttgacctcgtgatccgtccaccttggcctcccaaagtgctgggattacaggtgtgagccaccgtacccggccactaatttttatatattttgtagagatggggtttcaccgtgttgcccaagctggtctcgaactcctaggctcaagtaatccacctgccttggccttggcctcccaaagtgctgggatgtataggcatgagctaccgcacctggtaccccctgccccttctctgtctctttctagtctgtagcccaagggatttggatacccaagtgcaggcagaatgggaaggttgtaagcaccagggaagcctgtctggagtccaggcttgcagctgggccccaccccaggcaaggcagctgggtggatgactcagatgctgcccccctccctcccaccctggtggctttacagaagacagcaggagacagggtggagacagcagttgtcttaaagggaggagtggtggtctgaatgtctacctcttctgcccccctccccattgcatcctggagtcccttgcctggctccttcctgagaccctctggtggtgtctggacacatagctctctctggacaggtaacatgcacaagtaattagaatccagagttgagttcagagttatggattgggctgcaggatagtgccagggtctgtgccttcccatgtgaaactgatggaggaaggctgagtcagaagtggggagatccgaggcccacaaagcagaagcgctacttccactccaaaaaggccctggtgcttgacaacttcctggattgcccactgttgcagccccagtgtggacaggcagggagatgcaggctccagttcatgtaggctctgatcaagacaagaacagcaaaggccacagaggcacagatgcttgtcccatgtcacacaataaaggggtcagcacttgatcacaggccttatgacttccagctgggtgtgctcttaccattaagcctcacttctctagcttgggggacaggttggagggaggatctagagggtgaggtaaggtgaagtcaggtagctgaggctcacttctgcagcctggaaactctgctctggggccagtgacaccttagtgctctatggccatacttcgtggctcatgcctgtaatcccagtgctttgggaggctaaggcaggaggatcacttgaggccaggagtttgagaccagtctgggcaacatagcaagacccccttctgtacaaaaaaattagccggtcaacacctgtagtccagctgcttgggaagctgaggcgggaggatcacctgaagccaggagtttgaggctattgtgagctatgactgcactactgcactctagcctgggagagagaaagaccctgtctctgaaaaagaaaaaaacaaaacaaaactctgctgtcctgcagggcctgttagcatatgatcgatagcctttgctccagcctatacctggacccaggacccctgccagcccctcaatcgtgagacggtcagagctctgggaggctggtgattcttgtcttgagactatcttgagacttgtcatgggaattgtccacccggattgaaaggaagctgtgccttttggcagacccattaggttaatggggttggagacctttgaggatgcatgggccctgggctttatctgagggtatctcctggtgttacctctccaaccctccaccaccaaatccattctttttttttttttttttttttttttgacagtctcgctccctggcccaggctggagtgcagtggcatgatcttggcttactgcaatctccacctcccaggctcaagtgatcctcccacctcagcctcccaagaagctgggactataggcacgtgccacatgctcggctaatttttctatttttagtagagaccaggtttcaccatgttactcaggctggtcttgaactctggggcttaagcagtccacccaccttgacctcccaaagtgctgagagccactgagcctagcccaaatccacgttctgattcaaagggaaagaagaagggtgcagctaaacctggggggtgagaagtacttaaaaagcccaagagaaacaaaagagagaataattcctcactaggaccccctattgccttcccactattggtgcccttgcttggcacttcccctggcctccaggagtctgagacttactcttccatggatgtgcccattgcccccacttccaggtccaccccccagtgattcggtagcttagtgtctgcgctgaagcccaggacagctggatggacaactggtagatcccttcacctaccaactgtgctttctgctcccctcccccttgcttccctcctccccagcccctcgccacccctagcagctgcagcagccaagaccaagtcttcagagacccagacacaagggcagggttcattccattctcacctccttggggtcccagtgtactgataggccgaactctaatattataggagatctctggaagattgcagggtctcttatccctcaataaggggcaaggcaagccgggcgcagtggctcacgcctgtaatcccagcactttgagaagccgaggggaacagatcacttcaggtcaggagttaagagaccagcctggccaacatggtgaaaccctgtctctactaaaaatacaaaaattaaccagaaatcgcttgaacccaggaggcagatgttgcagtgagccgagatcacgccactgcactccagccagggcgacagagcaagattccgtctcaaaaaaataatactaataataaataaataaataaggggcaaggtagtccaccaacaaaatgacaggcagtgtgatatagtggacaccctagccctcggtgcccttagttctgtgtgtggccctttcactaaattgctgtgtgaccttgagcaaatcgcctcccctttctggctttccttagctgtaaaagaaagggattggagcggaaagtctccagagaccttttaggttccaaagtagtacagtgacccacaaagtgagaaaacagtcttctaaaataccaagttattaatagtaaaatcaaatataaataatgtgaatatagttaatagctaatgttgttctcaatagaaatgtttcccacaagctgtggaattaaacatactaccacatttctctatttccccgtgaaagtttgttagaaatggttaaattgtgacattaccctcttggcaaatgttttgttttcattgctactaggaaagggcaactcgttttcgatgcctctcccttctggacggtggaaagggctgtgtcatagagtaggaacgggagatgcggcacaggaatggctcccattgacccgggttgggggctagggcgaaggcctaggagaggcagaactgttaccttagagctggccaggattagagaacagtgcctggaaccggggggaggggcacggtgaccttgggctgcccaccttctacccttccagcacccatactggctcccccaacctgcggctgggctgggaggaggtcttggcccctaccaatcccttaaggaaggggaaagagtttgggaaggggagtcctcccttcacccctgcctcccccaagttgtgagagaggaagccggaatcctgcctgctgaagccaggaataattctggctgagatcccaggcccggcaggggcgctgagtcatggtagagggcagagtggagagtggacaggagaccctaagcttgtccagtcagaaaagcagaggctgaggggtggccttttcttgagaactacattcaagttgcagcaagaaggacagtggtctgaatttgacggggacaaatggaagggagataggacacatgagttcctttaggtctggctcaggggagctagacttcatttcaaggggtctaggttctgggcagttgagaaggaggctatttggggtcaccaaggctcccctttcttcccaaagctctaacactgccaccttctgctggctaggagagagctgtgtcttctgaggctagagctggaatgcagtgagaccagactgcctaggtcctccctcacttcttctcctgaccttggggtgtggctcccactctctcccagtgtcctcagggttaataactatgtgccaccagatagagagttaaggggctgctgaattggcttcttgtgaagggaatcccctaaatgtccctcgttttggtcactggcctccctcccgcccccttcaggacattctactatcttcttaggccatccctccctcctccaggcactacttcttttgctctatccccaagccccacccctgcatttttgtgacaacaccggaatgatttctagagagagaggccaggaagaaggaaagtggcacttggcaggagaccttgcagggggcggctggtgaggaagccagccgcccattgtccaggaccccagtgccctggcctccggcctcaggcttctcctgcctctgtacaatgccacgttgatacgcccagcagctgtgactcaggcctggccccctgccaggcccagcacttctactggagttgcgtctgaacatgtcaacaggcttcctatccctctctcagcaccagttctccccacttcagcccctccctctgcctggaattaaaacctggctttgtcttagggaaggacagctgggagcctagtggctctggtaggggatctgagaggcctcagaccctaggcatatttggctgtttggcaggtgtcacgcccaagggaagcgtgtggaagcagagccatgcctgctgtgggtgcacatgcccgcgtgagggagtcggggtgtttcatcctggggcacctgtgggcttttgaggtgtatgatattcagaacttcacaggttggggtttggggaaggctcaaggggcttctaagtccctggaacagctgcccccctcagttcctctctctctctctctttttttttgagatggagtctcgctctgttgcccaggctagaatgcagtggcgcgatcttggctcactgcaaactccgcctcctgggttcaagtgattctcctgcctcagcctcccaagtagctgggactataggtgcccgccaccatgcctggctaatttttgtatttttagtagaaatggggtttcaccatgctggccaggatggtctcaaactcctgacctcgtgatccacccaccttggcctcccaaagtgctgggattacaggcgtgagccactgcgcccagcctcagttcctctctttaaggtctcctttccagagagggatagcacctcaaatgccagggaggggaattctccacatcctgcccttacccgagttgtggcagacccacagactagccaagaaaccaagcagtggttactttgccgggttgggggggaggtaggggctatcaaacctcatgattggccgcacacaaaggtgtgagtatgtgtatatttgagggtgggtgggagtggcactttcactaggcctccgtatcactctctgactggggtatctcccagcaagcgagacagaggcagacacgcttcccagactgtcttactgggtctctctgtgttattctctgcagtgtctgtgtgtatcgtgccattttctatgttttgcaccaatctgctgtgagtgtcctcaggtgacctgggggcaggtttttagtgcctgagcctacccgtctccaggctttagtttccccctgtaaaagtataggagttggttcaagagaaggttcctctagaagccttgagcctgtgaaccgtctagtctccgggtatttgtgggacacacagaaaaagccccacgacccaacaggtagaacactggctgaaatcagcagggcagagctgagacaggctcaagtaggctgaggggtagggaggttttgggtgaatgggagggagggacagagagaaggaggatatattgcagtaggaggagttgctggaacaaaaggaggggtggtaggagtggcttggggtggcagcagaagacgccctgtcacatggcgggaagtcagcctgggcagaggtctaggtgtccaggaggggctgggtgtggtggctcacgcctgtaatcccaggactttgggaggctgatgcaggaggatcacgtgaggtcaggagttcaagaccagcctggccaacatggcgaaaccctatctctactaaaaatgccaaaaattagctgggtgtggtggcaggcgcctgtaatcccagctactctggaggctgaggcacaagaattgcttgaacctgggaggtggaggttgcagggagccgagatcgcgccactctactctagcctgggcaacacagtgagactctgtctcaaaaataataataataggggctgggcgcggtggctcatgactgtaatcccagcattttgggaggtggaggcgggtggatcacctgaggtcaggagtccgagaccagcctggccaacatggcaaaactccgtctctactaaaaatagaaaaattagctaggcatggtggtgcaggcctgtaatccagctactcgggaggctgagaagcaggagaatcacttgaacctgggaggtgaaggttgcagtgagatcacctgggcgacagaatgagactccacctcaaaataataataatagtaataataataaatgaaaaattttaaaattaaacaattaaaaattttaaattaaaattaaacaaattagatgcccaggaggatacaggagagcatttgccaccaggcggactccctgtacccacccggccacagggggcgatgttcctgggagacaggaaatgcccaggggctgggagaccctctgctcttctgctcccttcctgtgtgctgcctggcaatggggaactctgagggctggtgagcagggctgctgaggagtgggtctaaggagtccctgcagggctgggccagctcctccacctcccctttgtcttcccctcccacttgttatttttagctacagtgtctgtccctcttgcttctcccccagattgggagaggaaacggaggcctctccctccgggcctagcctgttgcccccagcaaccgggcccaaacaggcctgtggccggccctggcttccatatctggcatcagagttgggctgagcagggtgactcagagggtgggtcagcgcctggcccggtgcccacctagcccctttgctgtgctggtgcctttcttccccaaacagccccaagggcccgggcctgctgcagctggggagccggacttccttgtcccaccaggcacagctcttcagacccctgccttgggtcacatttgcaagtgccaactctcatttctaccttattcttttcctctctgttcccctccccaccccctctcttccctctttctgagatcagatttgccagtgatgggaagagttagaaacaggatgcccagcccttctcgcctcaagaggccactgggatgcagccactcctgtgcttggggaacctggaggatgcaagggaaaggactggcactctgctggcacagcacccggcctggggcaggacacgggcgaagccagggtctcccctgtgagcactagaggatttcccgacccctgcccgggtattgtgtgcctgagcatgagtcacctgaggggcccaggttcccacccttcccagctcctctggcctgccccaccctgtcctccctgccaacccagcacggggacggcactcagcgtgtgctcagctttcctgatgccaacccccagtggagtgggctgcaccaccaccctgggaccgaatgcctggctagggtctactttggtccctgctaggtctgaggacccctcctaggaaggaaatggcacttgggggcgggggcagggaggagggaggagagacactgggctctactgtacccctagtcatctcttggggtgtgcgtgtggctccctggccacagagctcccaaggtctgagtcatgagcccatgggtgatagtggcttcttccccgcagatgggagctccccgtgcctaagaaaaccacaaaggttcttcctcacttccctctctgctcgtggtttttctcatctgcagggtgtgtcttagtcctttaatctcctctctttgcagtgctagtcaaaacctccaccagggaaagacaaataacccccttactgtttttttttttttttttttttttttttgagatggagtctcgctctgtcacccatgctgtagtgcagtggcacaatctcggctcactgcaacctccgcctcccaagttcaagtgatcctcctacctcagcctcctcagtagctgggactacaggtgcacaccaccgtacccagctaaattttttttttttttttttgagatagagtctcactctgtcacccaggctggagtacagtggtacaatctcaactcactacaatctccgcctcccaggctcaagcaattctcgtgtctcagcctcccaagttgctgggactatggacgtgcaccaccttgcccgactaatttttgtatttttgatagagtcagagtttcaccatgttggcaggctggtctcgaactcctggcctcaagtgatccacctgccttggcctcccaaagtgctgggattacaggtgtgagccaccacactcagccagcccccttactttccttggagaccatatactgtggcttgtgccaaagtggtacagcatggatttccagctcccctatctacttgctgcgggaccctagatatagctttctgtgcctatttcctcaattgcataggaatagcacctatcgcatagggtagctgtgaagatgacgtgagttaacataatatttagagcagtgcttggtacctaataagctctatataagtgtttgctattatattattattatcactgccaccaccgcttttgcaagcagcagaaggtgaagaggttagactgaagaaaaaacttctgtgctcatcagcccataagctcgcagagcacagggatcatgcatctatgttttcctcagtcagtgtctgccaggcactggcaaggaaaggctgttaccagggggaactccaggaattcctcctggcacctaaggaggctggggagacaggactagggaaaaggtgcccttgagacaccttctgaaatcatcccattgccttccagcttctttcagctcaggctggctggtcagggaaacgctttgtgccatagtgtctgccctcttcctcctcctggcttctccattctctctggaacttgtggcttaggaaagcagtgaggtggaggaggaggaaccctagatcagcagctagaattgactggaatgctgctgctggctttcggtaattgacactgggccattcaccttcctcctttgcacctcagtttcctcatctataaaagggagagggttgagctgaatcaactctaagctccttctagttctctaaattctgagagcctcctagtacagccagcagcagccattagccttcagggtagagaggcctcttctgggaagccccagccagcctgggggtcagcccaaggagctcggaatctaagttgccccagttgcttcactttaccagcggtttttcttcattttccctcctccccctgcagctgcttcagcttcggaaaagttctgaagtcatggaaagttggggctgtgctcccagccaggggctaggccggatggcagccaaaacctgagctgggttttgactttatttttagcttttctgactgagacagaggagggaatacattctccggttctggaaggggctcttttttgcaggagacagacacttacattaaacaacttgttctgaggtgtggccagaggcctggactgagcaagtgtgcaggctgggggagcttcctctggcttctcatgtccttcccctgcccctctgagtgtcactctatcctcctccctgcctggtggggggaggtgggggtgactccttttttggactctcctaagcagaacactgcctgggtctcgtcctccagagcttctgcaaatctagccttccctatccctcttcacagtgaattgctgggcctcttggagtttaggacttttgtggtagaagaaaaatgttggcagggctgcttttctcctttccaggatagatttttccttctgcccacgcttggttttccttttttccatctgctgtggtgggctcatgcttaagcactgatgagttacagatggcagctggaaccaggtcctctggatctttccctccgctccctgggtctgctgctttctctcaccctatatttgtgaagcaattgtaacatctagaaagttcttgggttctctggaggtttttaagaaaataggacctttctatttctccagtccactagcaaaaataatcaggggcccagaaaaggtgagggaggtggcagaggcagcgctgttcgactggttatagctaaagctttacccactttgaggagcagggaggcttaaagctggggcccagatggacctggaggcctgggatccacatctggaaccagatgctgaggctatggtagatgggtagggctcagccttctcccagggcacggatgaggcaggagggagggaggcagggacccctctgttcagtgcagatcagggcacccagactgggtcctgagaaaggaaagggtcaatattgtgcctggtcatccttgtctgaggtccctctgagctctaaccagactttccttccccacagtcccacatgtgtaaaagggactaggagaggtgaccagtacctttggggctcagatcgagaagtgctagggacatgtgggccatgagcttagttgtcaggctcctcagagggagggaagcttggccaaagggaagtgagtagagtccagggagaaggctaagtaaggccctgtgtgggaaggggcaggagacaaaggtacccctgtctctttgggaaagaatgggaggagagagagggaaaagcattcatatcacggggtagagctctgcccttggccccaggcacgttcctgagccctgagtcatgggaagggtggagaagcaggaagggggttttcaaggaccttggggaggtgggagcccagccccagaggcaagcagatgcaaaccaacctaatgcaaggatgccctctcctggtaattgcaggcatagcagcgccagcccccatggctgacctcctgggagcctggcactgtctaggcacacagactccttctcttaaatctactctcccctctcttctttagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaaggtgaggccaccctgcagggcccacccatggccccacctaacacatgtacactcactcttctacctaggccctcccccatgtggtgcctggtctgacctgtcacctgatttcagagccattcacctgtcctagagtcattttacccactgaggtcacatcttatcctaatttggctgccaatgggatctaccacagtgaatttaaaataatccaggaggccgggcatggtggttcacgcctgtaatcccagcactttaggaggccgaggtgggccgatcacgaggtcaggagatcgagatcatcctgactaacatggtgaaaccccgtctctactaaaaatacaaaaaattagcctggcatggtggcgggcgcctgtagtcccaactactcgggaggctgaggcaggagaatggcgtgagcctgcgaggcagagcttgcagtgagctgagatcatgccactgcactccagcctgggcaacagagtgagactccgtctcaaaaaaataataataataataataaaaataatccaggccatgtgtggtggctcatgcctgtaatcccagcattttgggaggccaaggaggcaggattgcttgagtccaggagtttgagaccagcctgggcaacacagaccccatctctagaaaataaaaatttaaagaaattagctgggcatggtggtgtgcacctatagtcccagctacttgggaggctgaggcaggaggatggcttgaacctgagaggtcgaggatacagtgagctgtgattgcaccactgcacttcagcctgggtgacagagggaaaccctgtctctacataaataaatacataaaataaaataatccacaagccatttctacttaactttgcaatgaactgtacctgaccctagatccctcccagtttggccctccggtatacaagggcctcctataggcccttgtgatttctctggggaaaaggaggactggagttgatcatttattgaggccatcagaagcggatggctaattacatatgggacatgtgttaataatgctttgtgtatatagagtggcctttactttcaaaacactcttctccaatttatcatgttaaaagctaggaattgggctgggtgcagtggctcacgcctataatcccagcactttgggaggccaaggcgggtggatcatttgaggtcaggagtttgagaccagtctgaccaacatggttaaactccgtctctactaaaaatacaaaattagccaggcgtggtggcacacacctgtagtcccaacaactacttgtgaggctgaggcaggaaaatcatttgaacccaggatcagaggttgtggtgaactgagattgcaccattgcactccagcctgggcaacaagagcaaaactctatctcaaaaaaaataaaaaatagccaggcacggtggctcatgcctgtaatcctagcactttgggaggcagaggtgggcagatcacctgaggttaggagttcgagactagcctggccaacatggtgaaaccccatctctactacaaatacaaaaattagctaggcatggtggcagccacctgtaatcccagctacttgggaggctgaggcaggagaatcgcttgaacccgggaggtggaggttgcagtgagccaagatcgggtcacagcactccagcctaggcaacagagcgagactccatctcaaaaaaacataaataaataaaaataaaaataaataataaataaaagctaagaatcaaagaagcagtttattcctaatttcacagtctcatctgttcatagtggggccaggattagagtcagtggccaagcttccatcctgggttctttcccttcccaggccctaccatcatagtataccagggaaagacctggagaagccagcaggttgaccaccgaaccaaggctgggccaccttcctcctgggtctggtctccagcctcccagttgtacccttcccccagcccttcctggatgcactgatcagcctgtgcttccttgccctgtttttctttataaatagagccatgttctcctctctctctctctcttttttttttttttttttttgagatggagtcttactctgtcacccaggctggagtgcaatggcacgatctcagctcactgcaacctctgtctcccaggttcaagcaattctcctgcctcagcctcccgagtagctgggattacaggtgcccaccaccatgcccagctactttttggatttttagtagagacagggtttcaccatgttggtcaggctggtcttgaactcctgaccttaggtgttctgcccgcctcagcctcccaaagtgctgggattacaggcgtgagccaccacgcctggcaagacgtgttctctctatgttgttgaggctggtcttgaactcctggctgcaagagatcttcctgcctcagcctcccaatgtgctgggattataggcatgagccaccacacttagcccagcctgtgctttcttaaatgaaaatctaagcatacggctgggtgtggtggctcacgcctgtaatcccagcattttgggaggccaaggtgggcagatcacgaggtcaggagatcgagactatcctggccaacatggtgaaaccctgtctctactaaagatacaaaaattagctgggtgtggtggcccatgtctgtagtcccagctactcgggagactgaggcaggagaatggcatgaacctgggaggcagagcttgcagtgagctgagatcgcgccactgctctccagcctaggtgacagagcgagactccatctcaaaaaaaaaataaaaataaaaaaaagaaaatctaagcgtggtgctcccctgctcaaacatcctcaggttcttttcatggcagataagggcatctcttcatgagccagcccctgcctactgacccagccacctctcccatcccttcccaccccgtacttcaggcttcagcagtactgatctttccaaagaccccagaacacacatgccttcatacctctgtgcctgtacatgcttgtttctgcccttgaaatcatgacagtagctctctgtaggccccgctagcctgtcccttgggtcttagcctcttggaggccttcccagagccccccaaaagtaccccaggcatactttggttccttctctcatgtcccctcagtactttgcacatacctcctttatagcagttgctatgttgtgccagagaagggagtcctgtggctggggggcatatatcttttctttttgagacagagtctagctgtgtcacccaggctggagtgcagtagtgcgatctcggctcactgcaacctccacctcctggattcaagcgattcttgtgcctcagcctcctgagtagctgggactacaggcgtgtgccaccatcatgcctggctacttttttgtattagatatatattttctctcttagcacagtacctaccaagagtgagtgagtagatgtcctgacccctgcaggcatccaaggccctccttccctggacctgtttccacatgtgtgaaggggtgcacaggcagcagcccacctctcagcttccttccagttcttgtgttctgtgaccccttttcctcatctctgcctgcttcctcacagcttgaggcagccctaggtgaggccaagaagcaacttcaggatgagatgctgcggcgggtggatgctgagaacaggctgcagaccatgaaggaggaactggacttccagaagaacatctacagtgaggtggggactgtgctttgcaagccagagggctggggctgggtgatgacagacttgggctgggctaggggggaccagctgtgtgcagagctcgccttcctgagtcccttgccctagtggacagggagttgggggtggccagcactcagctcccaggttaaagtggggctggtagtggctcatggagtagggctgggcagggagccccgcccctgggtcttggcctcccaggaactaattctgattttggtttctgtgtccttcctccaacccttccaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaaggtgcttgctctcgattggttccctcactgcctctgcccttggcagccctacccttacccacgctgggctatgccttctggggatcaggcagatggtggcagggagctcagggtggcccaggacctggggctgtagcagtgatgcccaactcaggcctgtgcctccacccctcccagtcaccacagtcctaaccctttgtcctcccctccagctggacaatgccaggcagtctgctgagaggaacagcaacctggtgggggctgcccacgaggagctgcagcagtcgcgcatccgcatcgacagcctctctgcccagctcagccagctccagaagcaggtgataccccacctcacccctctctccaggggcctagagtctgggccggatgcaggctggaagcccagggttgggggtgggggtgggggtgggaggttcctgaggaggagagggatgaaaagtgtccccacaaccacagagaagggtcgcaggatgtggagtcagatggcctgtgtgctgtttctgtacactcttacctcaccttcacttctcagggctttggttttcccattcgaaaatggaggctgttcttaatctccctaactcagagttgccacaggactctgcaatgtgaggtgttaaaagcatcagtatttttctagttggctgtgctatttgtgacaggagaaaaagtctagcctcagaacgagaggtttcagttagacaaggggaaggacttcccagttgccagccaagactatgtttagagcttgtgatgttcagagctggctctgatgagggctctggggaagctctgattgcagatcctggagagagtagccaggtgtctcctacaccgacccacgtccctccttccccatacttagggcccttgggagctcaccaaaccctcccaccccccttcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggtgggctggggagacgtcggggaggtgctggcagtgtcctctggccggcaactggccttgactagacccccacttggtctccctctccccaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggtaggctcctgctcagggtctaaggggatacagctgcatcagggagagagtggcaagacagaaggatggcatgtggagagaggaacatccttgccctcagagggtggaccagggtgagcctgtatatctcctccacactctggttccaggcctggctcctggactctttggctgtgagaccttgagcaggttatttaacctctcagagcatcagtttcctcatctgtaaaatggggatgaatactgatccctaagtctttgagttgtcaggaagatgaaagataaggtatccgtgtgcctggtgctgcgtatgtgtccacagatcatggctattatccccgggggaagggcagtgacaggggtgtgtgtagatggaaggagaggcctcaattgcaggcaggcagagggctgggcctttgagcaagatacacccaagagcctgggtgagcctccccgaccttcctcttccctatcttcccggcaggaccagtccatgggcaattggcagatcaagcgccagaatggagatgatcccttgctgacttaccggttcccaccaaagttcaccctgaaggctgggcaggtggtgacggtgagtggcagggcgcttgggactctggggaggccttgggtggcgatgggagcgctggggtaagtgtccttttctcctctccagatctgggctgcaggagctggggccacccacagcccccctaccgacctggtgtggaaggcacagaacacctggggctgcgggaacagcctgcgtacggctctcatcaactccactggggaagtaagtaggcctgggcctggctgcttgctggacgaggctccccctgatggccaacatcggagccagctgcccccaacccaagtttgccaattcagggcccctttctagagctctctgttgcaggctccagacttctccacccagtaggcaaaccaaaagatgcttcctcaacagcacaaggggtggaagttagacagtgaggattgttaaaggcagagccatactcctacccggagagcttgacagtgtccctctggggtggaaatgagttccttagctccatcaccacagaggacagagtaagcagcaggccggacaaagggcaggccacaagaaaagttgcaggtggtcactggggtagacatgctgtacaacccttccctggccctgacccttggacctggttccatgtccccaccaggaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccaggtgagttgtctctgctttgtctccaaatcctgcaggcgggtccctggtcatcgaggggtaggacgaggtggccttgcaggggggagagcctgccttctcttccgcagcccgggggagtgggagcctcctccccacagcctgagtcctagacagcccacctctgcatcctgcccctcttgtctgagccccagactggagggcaggggcagggctggagtgtgagggatgggggagatgctacctcccttctaggggccaggggagggagggtctgggtccaggccctgctgctcacacctctctcctctgttttctctcttagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttct

SEQ ID NO: 36406 - DNA, 368074 bp, Homo sapiens
ggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcaggtgagtggccgcagagctggggctggggaaagggatggctcccgcctcggggcagcatgggctggctggggaagcctcgcttttcccggacccaaagtaggtctggagtgggaagcttggagtaagggggcgggtttggatatggattttttttttttctgtgcttgccttggagaccgcgaggcggatcacgcccctagtccagggtcggagggctgagggggaactttgcagagagaagggtttaaaggaggtcatggaaacgggactgggtgctccgctatttaaagcttggctgctgatctcaggtaaggctctcggcggaggaggaggcagtcgcctctcatcttcagttcccaatattgtcgcgaaaacgcggttctttgctgccctggaggaagagacttgcattttgatggagcttttcctttttctctctcccacctcatacccctcaccagtttgggggcttggtgtggacccttccctacagattgacgtcttaacagagttagaacttggggagtccacgaccggagtgcgtcaggtcccggggctgcataatgggacgaaagcctttctctttcaaggtatgcccggcgtgctgcatccccactgtgatttcagttccgataaccccggcaggagttgctcttgccgcttgtcctaactttgtattgcctcatggatgacagtactttagctgaggtgtagaagggccagtgtgagacacatatccctatctcttttaagtggttttttctcccctgcctcacccttctccttcgtactttgtactcttgccagttctaatggatagtcccttaattactgagcagaaactcctatggcagatggttgattttagaatctggggaacaatgaattataacacaaacgcctcgtttgggtgaaattgatttaggtaggaaaaaggatagcttaatcttagttaagacactgatctctgaaagtttcaggtacgatggtgccctgcttggaggaattgttttatgggggtagctttctggaaaaattaatgcctctgaatatttttacttactgcatatcacagtcgcagtatatttgaggcaaaatttatctttgaaagaccctcattcttccttcatccaccaataacaagagaaagggaataatggtctcaaaagtattttggaaagatttcaagtaaatgttaatctagaagtgtatctcatattatcattaattgtgtacttacgattttacaacttttttttgaagtcaatggatattggctgggcacaaatgtctacatctcaaattatatttaaatgtgttgtgcagtcagaagcaaattccaatgcagcaaaccttcaactttgattagagcttttgaggattgcttgtttgtggaaagttgccgtaataagagcttctaaaaggtagctaaacgtgtacagacagactagattcatgtatggtgaagaatacatgaaggcaaaagagaatggagtttggtttaacatatctaatggactaaagcttcttgccctacctcacccagatttttgttgttgttgttgttattttggtgccatggctttgaaagtgcaattcataattactaaagagttggatatgcaaaaggaaaccacttcggaaaatatgctaccaagaaatagaaataaaataaaacttgagtgtttctgtagtggtgttgttgcctgatatagccagtatgtgtcaccatggacactaaaaccaaagcttagagttgggaaaggaggaaattcacatgtgttacatttacttaaaacaagtttgctcttataaaaaattaaaatgcaattttctggcttaaaaattattgtttaaattttatgtttaagttaattttttattgtaacaaatatttatggtaatgttttattcacttaagggtcttttataagagggtggggcttggatattgaatcctttaaaaacaatgaccaaatataataaagaagataaggctacattgtcagcagaatttcacacagttgaatagaagtgtcagtagggttaaccttctgtttttttttttttgttgttgttgttttgtattgtgttgtttttatctctgatttttaatccctatgaactggaaacaaagttatttcaggactgccaattcgagtaactggaaagctttatggaatctaaagctcctaataaacaaatggtattgtagtgctcttaaaatttacaaagctcctttaaattttattagtattctacctagtttcctctgaagagtgtctgatctgtcacaaatagaaaccttcaggactgtgcattttatattctgatgctagaaaattaaaccatttttaggaaatagtctcaggaatcgataacttttcctggttaattaaaaatgtttagttattcatttttatttaaattgtcaaattcttcaaggtaggtgttcaaaatacataaggcatataaaatgttttgtttgaattgtccatagtaactagatatccatgtacattgatgaattggttgtttttccttccttgttgatgccgagctcaatatttagacagagtaaatgcctaacaaatatggtttatgagatttgaaggtgtaaaatttcattttctgccaaattatggactttatttaatataaccaatcaatcagcaagtatttcctgcatgccatgttctcagtaggcatatattactgatgtattgattatgctcttgtgatttcttttattctaagattcggattatgaaattgacaaaaggtggccctttggccatgcatggaatttcgcattaccttggcaaggtctttgctaatagcatttggaaacttgttaagaagtcagttccgagtcttgctgcttcattgagatttcctttggctttagagagaaaaaaatatacagactgaagattttatagattctatttacagtgagttgagggtgctgcagatattttgtacggtatatacatatacactatacatagtcatagcaggaatagtaacaaattacaaaatccgtgagatgctctcaggtttcatatgaacctatcatataagtttctttgtgctatcagatatgttctaaatagatggaagagatttttggaccatcaaatttttcctgcagtaatgtaaccatcttcttctgtcttttagctttaaaataaagaaatctcaacatatactttcccagtgatttttgctcatttaatattgcttttccttgtgccagtttttctccttagtggattttgagatgcatgcaattcaataccttttgaaactcgtaaatttattattatctatacctaataaaaacaaatggaaatatattttaaagtcatatgttttaaaaataataatagcaactatagtatcactaaaatggttttgttgttgttgaaatttgatttatagttgttttggaaattcaagtaataagatgctaaattagattacaccttaataaatatggcttttgatctttgccaattaccataattttcaaaaaaggaatccaggcaattttctagtcatttctagctataatctgacttgcagccacaaaaatacacttattatgcttttaaaaattagaggagtgaatgtagacaataaaaagacctatgaaaggttataaagggttctactttctaaaatctaggaagtattccccaagataatgatcataataatgtttttttcctctctgtacatgagggatcaggaatgagagtatacagaagcaccattctaggactttctagcaatgttagcatgatttttagatctttgattttaacaattaatctggccaggttcccaaagtagataatttcctctgttggtttaatacaatttcttctgaagtgttaacagattttataatctcattaatccatagaagagaagtggataaaatcaaagcatgttttttttacaagttgttaagttgaaaataagcttagtagttatttgtaaaaaactttaaggttttaaagggaaaaaaaggtcgtacgtctcctcttatgccagtgttacgcagagtgaaataggcatttggtaatagaccatggactttagtaggcaaaggtaactgcattgaggaaatcgaggtggcactaatttgtcttcagtatgatggttggtgagcatctgtggactttgaagtgatggctgttggtgcccaaatagtgtggaataacacagtgtttaagagatgcacttagaaacaagatagactgaggtggaatttcattagttgttttactgtggtgaagttacttaatttctctaagctccagtaccctcaattataaaatgatcattgttatgacaattaagcgagttactttcattctttcaaataagttatttttgggaaactagcatactgctaggtgttaggcacataacaaatgaagacgttagaacttaactttgatttcatagtgtcttaaaaatagccgttgaacaattacatagttacagacctaatcaccattaagataaattatatgaagaaaaactgaagatataatgggaatctatattttagttaggggagtctcaggctcagggaaaccatctttgaagaatagtcatttaagctgatagttgaaggatatgtaagagtagtccaaagaagagaagctatggggataggcaaagggactagtgtgtgagcaaggttctgagcatgggatgaatgtgcatttgagaacgtggaggaagtctagagaagtagaaacatagggcatgtgatatgaaataaagtatatgaggaaagcaggaaccaggttacatggtaggctatactaatagagcagaattgaaaatttatcattatggaaatatatattatggtgggcagaataatggtcctgcatagatgttcatgtcttaattcttggaaccaaacaataggttacgttatacagcaaggggaagttaagtttgctcatcagctgactttaagattaggaggctatcataggttatctgggtgagccctgtgtaatcagaagaatcttttgaaatggggagaaggaagcagaatagtcagtgtagagtgatgtgatatgagaaaaactagtctggccactggtggctttaaaggtgatagtgggccacaagccaaggactgcaggcagtttttagatgctgaaaaaggcaagaaaatgagttttctcttacagcctccagaaggaatgtagtgctactgataccttgattttagaccaatgagactcattttggacttctgatctccagaactgtgagataatagatttgtgttgatttaagtcactaagtttgtggtgatttgtttgagcagcaataggaaacgaatacaaattttcctgcatggaagtgtggtgctggtgtaagaaatacctaaaaaatatggaagtggctttggaactgggcaatgggcagatgctggatgaatttttaggagcatgatagaaaaagcctagattgccttaaatagactttcagtagaaatatggttattggtgactctattattgaggacttagaagaaagtgaagagcatggtagagagaaaatctaaatcacctctgaatattcctaaattatcataagcgagcattggttaggtatagacattgaaggaactgccattgagggctcagatggatataaagaatttttattataaactgaaggaaaggggacccttcttacacagtggcagaaaacttagctgaattgtaccctgtggttatgtggaaagcaaaacttgtaaacaatgaacttagattttagctaaggtgatttgtaagcaacaaaagtgttgaaggtgcactctggctttttcttgctgtttgtagtaacgtgagaggagagagagagatttagggaataattgttgagcaaaacatattcataacttgatatttgagaaattatcaacctattcagattccaaaacatgttaaaataggatattcactgttaggaatacctagtctgaaaagaaagccaaggatgtgactagaaaatattttgctagtgcctcagaaatatcaaaaggtcagagtattcagttacattgagggctctttgaagaacatatgactcatagatcccctcaaccatttcagcagaggtcacaaatagagatggaattatccaagaaatatctatggaggagccttttttgtttaatggagtgaatccccatgacatacatgggagatctacaaggttcttaagaatattatggcagtaaaattgctgctggtgtggcctgaaagaatcagtgagagaataaaatgaaagaaggtgttggatccccaaaattctacaagcaaaaaacaggctgacttggctgtcaacatctttctatgaagctacctttcatgaaaaaagaaggttaattcaaagggcagaactcagagcccagagcatggagctgactccagagggtggaaccaataattacagaagcttatttctagaccttgaaaccaagtggtgtttgcctggctggattttaaagttgcttggatatggcaattgtttttttttctttcttccattttctccctttttgaatgagaatatttagaactatcatctttatctgccttaccattgtgtttttgagagcagatactatgtttcaaggtgtgcctcagaatggattatatgcagcgcctttctcatacctgttttagatgatttggatgatgagatttgagacttttgtttttgttttatgttttgttacttaaaatttaattatttttaaattgacaaaattgtatacatttattgtgtacaacacaatattttgaaatatacattgtggaatggctaaattgagctaattaacatattcattacctcatgtacttataattttttttggtgagaacacttaaaatctatttgaaattttgaagagtacaatgtattattactatagtcattatgttgtaccatagatctcttgaacatattgtgccatctaattgaattttggtcctttgaccaacatctccccaacaactatcccccatccccaggccctagtaaccagcattctactttctgctcctataagttcaactttttaaggtcccacatataagtgagatcatgtggtatttgtctttctgtgaagggcttatttcactttacataatgtcttccaggttgatccacgttgtctcaaataacaggattttcttctttgaggtggaatagtattccattgtgtacatataccacattttctttatgtgttcatttgcattcgtatgttctttgcagcattattcataattgtcaagatgtgagatcaacctaattaatggtcaccaatggatgaatgaatacagaaaaatgtcattggaattttaataagggtcgcagtaaatctgtagatcattttggatagtgtggaaattttaacaatattaattctttgaatccatgaccaaagcatatcttttcatttatttgtgtcttcttcatttctttcatcagtgttttatagtttcagtatacagctctttcaccttcttgattaaatttatatgtaagtattttatctttttcatagccattgtaaatgagattgttttcatgatttctttttcaggtagttcattttttttttttttttttttttttgagatggagcctcactgtttcacctaggctggagagcagtggtgagatctaggctcactgcaacctctgcctcctaggttcaaattattctcctgcatcagcctcccaagtagctgagattacaggcacccgtcactacacccggctaatttttgtatttttagtagagacagggtttcaccatgttggccaggccagtcttgaactcctcacctcaagtgattggaccgcctcgggctcacaaagtgctgggattacaggtgtgagccactgcacctcaccagtttattgttaacatagagacactactttttgtttgtatattgatttgatatcctgaaactctactgaaatcatttattagttctgacaattttttggtggcatcttcaggattttctagatataagatgatgtcaaatgcaagcagggataagttaacctcttccttcccaattttgatgccttttatttctttctcttgcctaattgcaagtctaggacttacagtactatgttgaatagaagtggcaagattgggcatccttgtctttttccttattttagaggaaaaactttcaactttttactgttgagtataatgttagctgtagatttgttatatctgaactttattgtgttgagatacatttcttctatacatttattgagagtttttatcatgaaatgatgttgaattttgtcaaatgttttcctgcatatgttgaaatgatcatgtggattttgtcctttattctgttaatttgatgtatcacatttatagatttgtgtatgttgagccattcttgcctccttgggataaatcctacttgatcatggtgaatgatacttttaatgtgctgttgagtttggtttgctagtatttcgttgaggattatttcatctctgttcgtcagcaatattggcctgtaattttcttgtagtatccttatttggctttggtgtcatagtaatgctggccttataagataaatttggaatttattccctcttcttcatttttttggaagagtttgagaaggattggtattggttatttaaatagagtttagcagtgaagccatcaggccttggacttttctttgatgaaggactttttattattgattcaatttgcttacaagttatttgtctgttcagatttttcattttttcatgattttgtcttggtaagttgtatgtgtctaggaatgaatacattcctagacatatacacttaaacttctaagtttatctaatttgttggcatataattgtttatagtagtctcatgatgttttgtatttctgtggtatcagtaataatgtctcttctttcatttctgattttatttatttgagtcttctctcttttttcttaaatttcttagctaaaggcatgtcaattttgtttatcttcattagaaaacaactctctgtttcatttattttttctattaattttagtctctctcatttatttctgctctgatctttattatttcattcctttggtcttactttggtcttattttgtttttctttttgtagttcatttatttgtaactttaggttatttgtttgagattttcttctttttaaatgtaggcatttgttgctataaacttacctctgaaaactgcttttgctgcatcctttatgttttggtatgttgtgtccattctcatgtgtttcaagatgtcttctaatttccctaatttcccctttccttctaatttcccttttaatttcttttttgaccaattagttgttcatgagcatgttaatttttatgtatttgcaaattttgtggaattctcctgttactgatttctagtttcatatctactttaatcttgtctggctactacaacaaaatatcttagattgggtaatttttttatttctcacaattctggaggctaagaagtccaagatcaaggtgccagcagatttggtgtctggtgagggccattcctcatagattacaccttctttgtgtcttcacatagtggaagtgatgaatgctgtatcctcacatggcagaagggcaagagactctagggtgcttccttcagtctctttcatgagaccattaatcttattcatgaaagtggatcactcatgactttccaaaaggccccacctcttgataatatcacattatgcattaggttccaacatttgaatctcggaaagacgtatacacttaaaccatagcaataccattgtggttagaaaaggtacttgatatgatttcattatttttaaatttgttaaaactttttttttttaatttttttttttattatacttaaagttttagggtacatgtgcacattgtgcaggttagttacatatgtatacatgtgccatgctggtgcgctgcacccactaacgtgtcatctatcattaggtatatctcccaatgctatccctcccccctcccccgaccccaccacagtccccagagtgtgatattccccttcttgtgtacatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttagagcagcatgatcagagtgaacaggcaacctacaacatgggagaaaatttttgcaacctactcatcggacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacattgttaaaacttttttaatggtctaacaggtgatgtatcctggagtgtgttccatgtgcacttgagaagaatgagtatgctgctgctgttggatgaaatgttctttatatgtctgttaggtccatttgatgtaaagtgtagtttaaattaaatgtttccttattgattttccgtctggatgatctgttcattgctgaaagtagggtattaaagttccctagtgctattgtattgtattgcagtctatctcttcttttagatatattaatatttgctttatatatttaggtgcactgatgtaaagtgcatttatatttacaattgttatatcttcttgataaatttatctctttatataatgtactttgtctgattttacagtttttgacttaaagtctactttatttgatgtaagtatagctatcctgttctattttgttttccatttccatggaatttttttttattccttcactttctgtcttcatgtgttgttaaaagtgaagtgagtctcttataggtggcatgtatctgggtcttgctttttattttttaaatacattcaaccactttatgtcttttgatagcaggatttaatccatttgctttcagggtaactattgataggtaagaacttactacaggtattatgttaattgttttatggaagttttggacatatttattcctttcttcctctcttgttgtcttcctttgtgcttaggtgatttcctctggtggtatgctttgattcctttccttttatcttttatgtatctattgtagatttttttctttgtagttaccacaaggcttacgtaaaacattttgtagttaaaacaggctattttaacctgataacaacttaactttgatctcataagaaaaactctacacatttacagccaactccctgcctacattttattttattttttaatgcaccgtttgcatctttttatatcatgtattccttcataaattattatagcttttattatttttaaatagttttgacttttaaccttcatactgaagatataagtgatttacacactaccattatagtatttgagtattctgaatttgactttgtacttcattttaccaatgagttttatatttcagatgttttcatgttactaattagcatccttttctttgagcttgaagaactccctttagcatttcttgtaagacaggtctggtgatgatggactcccttagcttttgtttgtctggtaaagtctttatctctccttcattgttgaagggaatgtttgctgggttcaatattccttgttagcagtttttttttattacttctacaattttaatatcacccagctctctcctcgtctgtaagacttctgttgagaaaacttctgttagctttattggaactcctttatatgtgatttggttcttttactagttttaggattgtttttgtctttgatttttgacagtttgattataatatgtcatgatatagtcttatttggattgaatctgattgaagactgttgacctttctgtatctggatatctttctccagatttgaaatgttttctgctactatttctttaaagaagctggaaaccatcattctcagcaaactaacacaggaacagaaaaccaaacaccacatgttctcactcataattgggagctgaacaataagaacacatggacacagggagggaaacatcacacactggggcctgtcgtggggtggggggctaggggaacgaatagcattaggagaaatacttaatgtagatgacaggttgatgggtgcagcaaaccaccatggcacgtgtatacctatgtaacaaacctgtatgttctgcacatggatcccagaacttaaagtatatgtatgtgtgtgtatatatgcttttttacttgtctctttcttcttccttcttaaactcctgatgccgtcccataaatcctgtaagttttcttcttctttccatttccttcttttttcttttctgactatatattttcaaataacctgtctttgagttcacagatcctttcttccagttgatcattctgttggtattactgtccattgcacttttcattttgtgcactgtgttttttagctgaagaatttgtgttttttctaaatataattttaaactttccattaatcccttttctgtttagaaaaaaaagtgcagctcactgtcagcactcattgaattttgcataaacatgctttttgaggctgaagcaaatctgactgattttcaatgtgaaaataaaatataaaaactgtttttagagttatttattaacagaactaacatcagaattatttgaatcaccagaataatcaattctggaaaaatcagattcatcagattaatctttggccaacaactgttcaagaacaatgttaacatctgcatggcaatgctacattttctaggatttgacattttcagcaattgagaattactatatttttaaatggaaataccactattaaaaacagaatgctataaatagaatgatgtcttttgtttctaaagcctatatactggagcaatgtaaaaataataataaaagcaagatatttcatggcaaagttagctcagagtaaacactgcagctgcaagcgctgctggtgagtattcgtggggcaaatgggaaaagagttaaacttctaattttgatctcttattattttcctgattttattgaattatttatatgtactttcttgaggttttctgagcttcattaaaacaattgttttggatgctttgtcatgaagtttatatgttttcatttctttggggtcagctattgggagattattgtgcacttttggtggtgttatatctccttggctttttatgtttcttgttgcttgtgttgaagtcagtgcatttgaaggagtagggacttattctagtctttgcagactggctttgtctgggaaagctcttcaccagtcagccagttcatagattccaggaagactgtctggcatggttggtgggaagacttattgctggagttctcagacaggctgtcctggtgactgggttagcagtttggcaggcctgttgcctggactcactgattgggtctgtggggctagcctggagccatagtccatggtcgctgccctggtgatggaatgggcatccttagacccagctttgggctggcccctgtggatagaggctgccagcttggtattagggtaggcctgaagcctgggacagtgagggccagctcagctctcggggtagtccagagcccatggctgctgcagctgcttgtttctgggatgggtctggagcctgggtctatgggggccaatctaatgttgagactgtttcagagcctgaggctactggggttgggctgacagtggggcagcccaaagaccaagtctgattggccagcctggagcctgaggctgtgggatccggtttggcactagaatgggtttggaggctcaatctgtgggtaccagcctagagtctgtgactgtggagtcgtgcctagtgttgagctttactgagtcaggcctatttttggggtctgaaacaaagtcaagtgctcatttttatttcgtttcctcaagattattgctttccatgctgtgctgcctggcactggggaaaggtgagatgggtaacgtaaaattgtccttactgctctcttcagtatgccttttcttagttctgtgccacacccaggtgctgcaatctctcacctggttttcttagcttttgtgatggtatattgttatgtgttgatagttgttctaattgatgtttctatcagggggatgagggctggaaagttgtattccaccatctttctaatgtgtggttcttggtacttctgaattaattaagatttagatgagattttgaactttgagttgatacttcagtgggctggaaatttgggggacttttgcatgtacaatggatgtgaatctttgggggtcaggagaaagactgtggtaggctgattgagagtcagctgtccacatactaatccccagaatcagtgaatatattgttatgtggcaaggggagattagatttgcaaatgaaattaaggttgttaatcgactgacttaaaaataagattattgtggattatctagctgggcccaatgtaatcacaaggggccttttaattgtgggagagggaggtaattgagtatgtgtcagtgtgatgcaatgtgagacttgactggccatctctggctttgaagttggaaggtggccatgagtcaagaaatgtggacattctctagaagctgtaaaaagcaagaaaacaagttttctcttagagcctccagaaggaacatagccctactgacaccttgatgtctgcttagggagacccattttgaacttctaatctctagaactgcaagacaaatttgttaatttagccactgagtttgtagtatttgttacagcagaaatagaaaactaatatatatcttgaacattagcagttatttattttataaccaaattaaactttcttttgagttctcatttaactatgcaacagaatgtgtttatggagtggtttgcaacttggtattgacagttaccatgtcatattagtcatttgggacgtacaataggtttctttacatgtcaattcagtctttatggtaaatgctaagtatttaagggattctccccaccatttatgaactaattctgagaacaaatagagtaaaatcaagtgtctagttttttattgtatttttttttcaaaaatacaccctttctcctcaaaatgttaatctggatgtggaggggaaaagtcagaaagcattaatattttgaagatagaagggacaacacttagcatgctatttggcacccagcaagtgtggtagctgtaattattgacagggtcaaacataactagaagacccctctgaaaagtacaagggatatcagaggaacactgccttgattttggaggacctggagcaatcttgacaggctctggcaggtgaacgactttcagtgtcatggctgaagtacactctgggtaacagctgaaatgaagagtttctatctttctttggctttattccacctctcgttggcttattctcttcatgttgggtctggatcccattcttgtaggcatctattctttctcttattctagattatctgtctataattcaatacctaccaaggtactaactgataactgaggcattagacaacaaggctttatggtgtgatatgtctcctgtttatttttatttttttcttgagatggagtctcactctgtcacccagactggagtgcaatggtgcaatctcagctcactgcaacctccacctcctgggttcaagcgattctcccacctcagccttctgagtagctgggattccaggcacctgccgttatgcccagctaatttttgtatttttgtggagacggggtttcaccatgttgggtaggctggtcttgagctcctgacctcaggtgatccgcctgcctcggccttgtaaagtgctggaattacaggcgtgagccactgcacccagccttcctgttgattttaattcaattcaaattaacaaatatttattgcactgcttctattttaaggatggggatcacaatataatagggaaaggaaaatgtctatataaattattacagtaaaataggaaccaaaattttatcgtaaatcatgaaaaagaaaatttgggactttatcttgaagaatgattagaaaactaggaaaattgtatcctagtctatatatgacaaattgtaggtaatcatttaaccacaagcgaattctaagaagaaacagagtaaaatcaagtattgagtgttttgttgttgttgtttgtgtttgcaaaaatatctgaggactctctcttaatccttgaatgtgaaatcattctattttgaagtacttatcattctggttaaattttaattttaatttaaaaaatgtatccacctgcatcagataatcataacttagggcctttttgtgtcatttgagcacttgcttacattgcttttattgacttcatgaaatttttcatcttttgctagatttcagtttctaattgacattgccgggatagacattagtcttagatggaaacattttctaagcaaacaacttattggtgaatactgttgttgtggtgactttcgcttcaccatataaactcatatttgtagagacttggatattgattcttgtaattaaaaaggattagtgaaggagctgttggggaagaaaaaagtatagcatagcttctccttctttcatgtggccagctgtcaggaactgggcacttgggcacatattccctgaactgtttttgatgacgcctctgctaatagtcttcattcttgggaaagggtgagtaacccagggcaaccatgtgtctctccctacaaaggaaatatatggaatgaagtctgaaaaatcactgctctgaaaggtcacattgtattccagacaaagggaaggaatgatggaggtaattctgagttcatattgatgtgcagtagcatttaggagcacggcctgggagctagacatcttcatctccagtcttggctcctttactagttgtatgaacttgatcttgttacttatttctgcctcaattggcatagtaatagtactacttcttagggtcaatgtgtgcatcataggaacaaaactatgcctgacatttactaaacattcattaaatcttaattattatttttattttggaattagcttatcagaggatcatgctcccttggacttttgaggggctttcaggtggaaatgctagattttgtgtaggagctaaagtcagatgactttcatgtgctaaagggaggacaggtgaaggtcatctgggcatggggggaaactgcccctaaagcatcttctgttctacttttgctgtttttagttcttaatggggagtaaaggatatatggatttgggtagaaagggatgaggataaatggcagattaggaaaggaaggaatttaatctgccttgttgtgccaatgttttagaagttggggagcattgagaaaaccagtaaaggaagattcagggcatagctcctctctacagcaaccccaacataattactttacaagcacaattaaagcttaggttttgagttctatattgtggggataagttttagaagttctgaaaaacaaatgacacaattgttttacctggctctgtctggataaccttggcgttccttggtattgatttgatctgttggtgggagctggtgatggaggataagatttcagggaaccttgaatagtgtttcaggggccggtggaatgttgacggatctcctgtgaagtggatctttgtgaagtgggtttatttttccctacatttcctgttacttctttggtattgtttcttgattatcattcttgcattactacttatttctacaatctaaagtccttgtgctgatttcgattccagtagcacctgtaactgtagtcgttacatgatttactgtcttttaatgagaatgtaggttctctagggaaaacaccatttccatctatttctcttggcccccagcaactctgtgctggcctccttctttgccattcttcctggttccttttcctggtgaactcttacatatcattcaggattcaggtaggttgtcactttggctacaaattcttcctttggtggaattattgtttgttactttttatgtgctctcttagtatcctctgatacaatacccaccacactgtattataatttttttgtgtaaagtaatctgatcacttctcctttcctccctgtacctctttggtccaagctaccaccctctttcacttggattactgcagtagcctcctaagtaatctgcctgcttacactcttgcttctctgcagtctgtccttcacatagttgccagagtgatccttttaaaatgtaatacatatcatgtcactgctttgctccaagctttcaggggttcttcgtttcactcaaaataaaagacagagttcttattatgccctataaagtcttacctgcacactcccactcccacccttttacttttctgacctcatctgcttctctctttcttgcttattttgctttaacgccagtggcatccttgtttctcaaacatgccaggcaggtactctcctgctgcagggcttttgcactggctgtccaccgtgccctggaatgctcttcccccagacagctgcatgttttccgccttacttctttcaaacgtttttctcagataacaagtttttaatgaggcctctaatgatcacagagtaaaatttcaacttgtcttttacctcccaaatattcttgatactccttactctgatctgttagtttccctaacacttattatttaccatactgtataattcatttacttatcatttgaattgtttattgtttgtctctgctgctaaaaagtaaagtgcatgcgggcagggatttttgaatgcttaatttactgatatgaatcccaaatgtctagcataggagaggaaggaatttaatctgccttgttgtaccaatgttttagaagatggggagcatctctatatatttgttagattaatatgcttgacttcttgactagattgtgatctccttggggcttgagtctctgcattgtttcttcttgtagcctcctggcctaccatggttgcacacataatgtgcttagtaagcccttgctaagtgaatacttgtggcactgaattgagcccatttgttcatgacaaatatgattactttcgtgactttatgttttgtatttatgtaactttaatgaaagctgaagagctctttctaaaaatcaaaatacctgctttcttctctagtcataaggaaaggtaagagggtggagaggcatggaaaaaatggtagttctgtttaactttgaataactccaaattatcctgagagggtccttctccagcctatgatgaagtgtgccacagaggaaataacagcattttgaagaacctggacatcctgaatgcttcttgatgatgagagtttaaatttttagtttgaagtattgcgaattcaacatttagcagagacactcatattcatatgacagtcctgagaaacatttccaaggcagataaagattaagttggattatttatgctatggtacttctccattattgcaaataagccagacaaactggagtgcatccagggtacagcaaccagggagttgaaaggtttggaaactatgccagatgagggatgattgaaagaccttagaatttttagcccgtacaataaaatacagtggcagtgtgacaatttctctaagattttggaaggacagtcatgtatagaaagacttagactgattttgtgttattctagagcaataattcccagatgtcagcttgatgatcagtggtttattgaatgccttgttaaaaagattccctggctttcctaaacttagtgaatctaaatttctggggatgaatcccaggaatctatatttttaagaagtttcctgtgattctgatgtttagccaagcttgtgaaccattgtctcaaactgagctctccaatacagtagccactaactaccaattgctgttgaatagttgaaatgtgcttaatacaaattgaggagtgatataagtatagaaatacatactaggtgctgaagacttagtataaaatataaaatctcattaatatttttatgttggttatatgttggaataatattttggatagtgggttaaagaaatatattattcaaattaaaatcacttgtttttacttttttaaggtggctactaggaatgtaaaattacttatgtgactcatctttatggctcttatacttctattggacaacactggtgtaaacggcaaaactaggtctctgaaaaaagttgggaatagtcattttaagataaatgctttcaacaaagttccaacatttaagtaacttttttttttggaatagctatccttctatctgtccatctatccagtcatccatccacccatccacccatccatccatccatccatccatccacccacccacccatccatccacccatccatccacccatccatccatccatccatccatccatccatccaataaacatgtctctaataatacttaagtggagattagataacagtattttagcaaaaatgtttcaatgatgtgtagatgggagttagattaaacgatttctgaagtcacttgcattcagccagaagtaaatttcgtccttccttttagttaacttttctttttcttgtaacccctgatgtccgtaacatcctctttttcatctctctgacaatctttaacactatgttcaaaacagttccctcctaaagagcatcttggattgttctaatgctttctttgctactgagagatatcctgccctttactcctgtgctgtgcattgtgtatctgttttataaatatgtattcttaatagtagtgatctactttatttcttccatacactggtgttttagggcttaatctattttgcttgtctatttaaattgagaatcccctaggcaagcactgtgtctaattctatatctgtacagtctaacacattgtactgatggaccattaagtgtcccagaaaaaatgccaaataggttaagtatttcagagcagaacgtaacctatatttttagaacttatttaaatttccagtggtaattagtagctggatatctttactatgaattgcgtttgttgacacatacttgtaactgagcagagttcttcctggagactgatggattgttaagaaaggcatataaaaatgtttcctttaggctaccaatgagatgcaatgctcctagtaactgaacgttgaacctggatgttttctgagagcctgttgactttgtttggaggaggacatgtccttcactgatgtattcttctcacatgtcatcagattgctaattatactataaaaatagatttatttaaagtatatgagtactccagagaggcagcttattttatgacactatcattcatatgtttgtttttccttctgagactgattttcataagttctgttgtaatgtaagtattagtgttactgcttttgttaatactttctattccctgatgttcagattgaatttttatgtaggatacctaatagatcgtttaattcaaccaactcaggaaagcactatgactctaggctttatgtttttgcctttcaaatgaaaagagggattttttcactctaggagaagaaatatcatatcccaaataaaggggagaaatgtttaaaatgtctcaaaggaggaattgttcagtccaaatttgactctaaagaattcagacttgggtttgcctgggatcttaatacacttaatgtttcactattattttgaaggaaaatgcgtagaaacaactttaccaatttccttaaacttaaaatccaaaggtcagaaattggacttttaaaattcctaactcaaatctggattgtcttcactgaaatctttctgaagcttattattaatttctatgataaaccataatcctgaagatatgagacacttttaagttatacatttttataagactattatgttatgggttaaaatgaagacatatttgaagttgaaatgcagtggatataagaacttgattggataagaacttgatttggagcatgggaattcacaagaaatgaggcctctaaagggaaagaaaagaaggcagagtaaatgtatatttattgccactcaccttgaagacactaagcctctgatgtagaggtcaattttttaaaagttgctacaaaaatttcattatccttatcataggtgcctctacaataaagcatctcatagtacattttcatccctttgctgctgtgggttcaatttttaataattgggttgcatttccaggaaaattgtgcaatttaaattgttctttgataacatactttcaaattagaacacgtttcaaagactaatggaaaaaaatgagcattcactctgaatcattgaccaggcaggaaactgtcgagtggggagaacccacctatttaatggatgattactttttgttattttggtcagcaaattagtaaagtcagagggtgaagttgggaaaatgccagttagcttgtggaaacttgcaggcttatttctaaaacttttcaggactgatgttaattacacaggcatctgaaaagcaaaaatgggttttaaatgaacactatcttagctgtctcatgaagaaaagagagggaatgtttaaactgttcccatctgtgtgtaacaaagcttttctctcaggggaaaaacacagaatagaggtgcaaatgctgagctacctcattttagactttctaaagttatataacaacatgacaaatatgtgctactggaaaatattgtaggaaaggattaattttctcttccacactgtcttgatagaagaagtaggtaaggaaaatctaatttgttaacgtttttttccagcagtgtatgttaagatatgaatctgtagaaatacattctttagataattaaattgagatacggaatttcaggcaataggctcttcattcaaagaaaaagagtaaatcaaatccactgttgatattgacggtgaatgcatttatattttagtggattaaatggagagaactcattcaaaataaacctgtaaaaatacaagagggaacaatagaaggtgaaataaatgttatttttgtgttttttttgcagagatacttgcttttaattagagaagttagaaccaaatgtacttaaaaataaaagatcaaatgcttttgaagggcaaaatctgttcttatggcattgtaggttttgagcaagaacaagatatggcataagactccacaaaacagattcagctgtcagtatgtgatgcgtgaaaagacctgggcactgctggctctggaacttggtctcgctggtacagattgttgccaaccttggaaactgaaataggccatttcgcacatggcacatcatccctctgtaggaggaatggggtttataaatgttagttggctactattccctcctccagatagactggtgaagcattttttgcattttggttttgaaagcactcttatgtttagagctgtagtttaattctatctttagctatagctgtaaattaaaaaaattactggtagtaaaaatgacagcaaagtcataagcaagatgctaaaaaggattgaaacaagatcatacttgacttcatttatatcattctattttttatttgtgcatattttgttattggcatgcaatcataaacaaagagtccaaattttggcttgtctgaggttttagaacatttaatatttcattattctgaaaggaaatgcatagaaatgactgttaaattctgtagcaaattcttcctgaagtttaaccattaatatttatttatagatatgaattcattattcctcttgatttatggtagggggtggcagtgggtgggtgagtttggaagactaacccaagcagatgtcattacggtttccagtatagtagtgtgttgaccagatggattcaggtgtttctattataaagcaataactatttagagttctcttgttgattcttcgaacaaaaaggtaagtgttgaattacttggttaatataaaatgtatagcactctagcctagtttcattcatagttatttaggtatgtacatataatatagatattttaagtatactgtgtgtaagagaatcttggactcccacatcttcctaattagtcccaagagcaaaatttgtctgtttcttctaattctttcacctggaaccaccactctcctcctaaattgcacttcatacttcctgatatctttggctgttctctttaacattggcatctatattatcaccgtagccaagggtttatgcagtccctttgggagcagattccatttaatggtattgcaagggctttaatggtattgcctatttattcaaattatttgttttgttgctgggttttatttttctgtatttcagtttggcagattttgcaatgactctgaggtgctttagtttcataaacttactttatacaatgagccctacataactgttttagtatatgtttctgacgttaactttttacgtaaaaagaattactgttttgcattgatgtcttgtttgataaatgaaagataaactctaattgactgtaatcttcaaaaattaaattataacaatttaaaaataacaacttgttaacaaaccactaatatattatagttttagagcaaataaaaatattttttaaatggctctcctgattcttttaaaagaaaaattactaataagtgaatggaatagacatccttgtcactctatctctaacactatctcatttacacagataattccttttctacttaaatcatttttgtattgctggaattttttataaatttgcattacttgtataattaattatgaaaaaataataattaaaaaactattttttaggactactaaattagaagttatgtccctcaaaattatcactatccctatgaagttatacctgtctactctgtgtttatatctactttcactgaggtataattaacatgcaattaaatgcacaaatcttgagtgcttagtttgatgagtttagataattgtatacaatcagataaccgccacccaaaacaagatttagcatattaccattcccagggaaagttccatgtgcccctttgtagtcagttcccacctctcccacacaattactctctgttttttcacaaaatagactagttttgctatatttggattttatacaaatggaatcaagcaatatgcttttgtgcctggcttttttcacttaagttaacatctttaaatttatttatgttgtatgtatcagtaatgcattcccttttgttgctgagtattatttcactgtatgaatataccacaatttgatgatcaattttcctgctgataaacacctgggttttttctagtctttggctattatgaataaagctgccataaatattctctaaaagtttcttttggacatttacttttattccttttggataaatgtctgtgagaggaaatttggggttgatgtatatttaactttttaagaaacttccaaacagttcacctaagtgattgtaccattttgtactgttcaatactcatatagaaatgtatgagagttctcagtgtttcttgcagtctttttgatttgatccattttcatgggtatgaagagatatttcattctggacttaatttgtatttccctgatatctcatgatgtattcactgatcattatatattttctatttgtgaactgtccatttagttgttctaaaaatgagatttgcatctttttatttttggtttgtaggattttttcatttattatgaaaatatgccctttgttagatgtttattttgtggatattttctcccagtttgtggcttgtctattttcttcatggatttctttgatgagcaggaatatttatttttaatggagttcaagttatcattattttttgttttgtggtttcaatattttgtgtcttgttcaagaaatcctacatgcatctaattttaaaaaccttttaaaatttgtgagttcctgtttcccaatgtgtaaattcaacagaaagaaacagacctaaataatcttaaaattttaaagcagcctgtcacaacatcgttttgcttacatgggccaggcaagtaatgtaaatgagttcactgaaccagatatgagattatgaggggtactgaggtcagtgggtgagtgggaaggaaaggtgtcacttagagctattcaaattcaaatttacatttctgtagatgcgtgggccacttgggggttactggcttgtgacccttgccttaaagaattgtaacacatttttaataagtgatttttttggtcctgtgaccactgcttaaagcatgagctctttttagatgtgaagtagtgatcagtctattgattaaaaagcccagtttctcaaatagcctgccccttctctctctctctctctcttttataaagtgatgacagttcatgaggagagaggtatggtttttgtgacctcataactaaaacaaagacttgagatctttgggaggagtattctctggcttctgtccaggtgggatgggggtggggaagaagagggtcttgtcctgtgtttgtctgtgtgttgctctgggggttgatatcctttgcccacctgttgctgtgtgttctgctggcacttgtagctcaagtctatggttgctgtcacttgttcactggatttttgttagctccatcagagcccagtggcatctcctggctgactgccttatcttggctcccattggtgctatagaccctggggagtctggtgctaactcatatttgagcctagcctgggaggttggtcctctgcatcgctttctataaagtcacttcaccacttctccagtgtcctttctggcaaggtccccagccaaacattgggacagttaaatttcaggacatcccctctccttagccttaacactgctgcacttcagtgtttactttgatgtggctatgccctaagtttatacactgcagcccccacagccatcatcttcctgagtcaacaggaagtgggcaagagtctttttctgccttttttttttttttttttgagacagagtttcactctgtcgcccagaccggatgcagtggtgcgatcttggctcactacaacctccgactcccaggttcaagtgattcttgaacctcagcctcccgagtacttgggatgacaggcatgcaacaccacacccagctaatttttgtgtttttagtagagatggggttttgccatgttggccaggatggtcttgaactcccggcctcaagtgatccacctgctgcagtctcccaaagttctctactctctttgatacttatttaatacagctccctctctccaggccaaaaccccaagagaggaaaaaaaaatctcttctctttgcttattttcttcacaaccctttccagtcttgcatggagtgggttaaaaaaattttttttttaacttctcgcttctcttttctgctcccttggtgtcattgtggaaggagtacaaggctttttttttttttcccccatttcttctgtacttagccaaaatctttcaggcagaagactgcttaggctagctaaggtaaatgcatttagaaaggcacattaataatttataaaatattatccctgttacacataagaaaatagaaacaagtccactgtgttaaatctactgaattagtctcagcagagttgaacaataaatattaataggatatatgattataatacttaaggaatgtacagattggtttcgaagataggattaatagaagtaaagcacacacataagacagataataatctaatacccttacttcacgagaatgagggttcaaatattctacttttaatcctgtttgcttccttacttcactggtgaggttggcatggggtgagttgctgctctgcccatggtaataatgagtcccttgcccattactgtggtcctttttctgtcctggcctgtcagccttggagctactggaagcatagaatgttatgtaatactctgagttctggtatcaggcattgcatagtatgggagaaaactttgccaggcattaatcagctgctctctgtaacactcccacaagtgagcttaaaaagccactttcagaagtcctgtggctgacactggcttcggaacattattgtttatgaaatctcagaatgccacagtatatggatgggttgtttttaattttggaaggttgtataacttaaaataaaccaaataacatttgtatgtgtcatacatagagagctcaaatggaaattgaaagatcatttggacaacttaataaattggcaagtacaaatatgtacacttgcataacaaaccacatatgctattggcatgggaaaaaactagaaaaaatatgttttaggatttattttgaattgatcatcttaatgggttcagttgcttacaatggaatatcataatacttttgcatattgtctgaaaggggagaatttggaagaaaaattggaagtttttcacctagaacctgagctacttcactactgcagccacttaaaatgcaatagggtgcagtagcaacattattgacatgacaaatgataatggttccagaggagccatgctgataaatattgctagtgatccataaatggaggactctcttagcagggtttgacatgattagaccacagtggcactaaagaagtcattcccctctgcagagtcaagaatcttcataaaaacagagcatccgtgttgatgctgacaccatagactgtctggcaatgctggaatttttccttattgtaagtgcatcattaactacgatggctccaaagaaacttttgtggtctttgggcgtcaataatctctaaatatacacttgcgtaatgaaccacagatgctatgtgaacattttcacagacatctggcctataagttgtctcttaaatggccttaaaccatgtgcatggccaagtcagtaacttcaagggatgtactccaatcattagtccatatggttattagtgctcctggtgtaaatgttccaagtccatttttattatattaccattttcataagtccagaatgagcactgccatagtgtggagtaaaggccattttctaatctaaagtcttgaattctgaaagccttcaggattaaacctttgacatgaatagagacgaggcagtccaataaaatgtacaccttggctcaaagactttccctggaagtggaggtaaattgaattttgctgcttcaggctcttcaggataactctcatggaacctgagagtagatataataataaaactgactgacctctggtttttgccttagtactgtgtgtgtgtatgtgcatgtgtttatgaaaaatctctggttcacaaagttccaaatcttaattgttagctttgggtcatttccttcacttcagaaattcagtttccattgaatttaaaatgaggatttttaccttaggactgcctttcaccccagcttctctgtaatcaaagctgtccaacagaatagtgtcatggaaacatccagtccaatatggtagccactaactctgtgtggctgttgagcacttgaaatgtggctaatgtgaatgaagaactgaattttagaattttatttaattttgatactttagcctttatgtgactagtggattgatctagccactgtacgctatgcactatactgtactgtgttgaacagcacagttctaaatgctgttcaccactcctgtccccttccatgtgcttggtgaactttaagtcaggaattataatacttgattagcaaaggctatactcagttaatgggcactatctttttatacatatgctcatttgtgatggggaaagtcttgtttgacatgtataacaatataataggaaggctagagtttctagaataaaatttggagtctgtattacttaatgacaatttctaaagttacaagtgctcaaatactttgaatttttctagtttataaagaaggaaagcttaccctagattgaggaaactatattggaattttgggactctcatttccattttggaatggaaagtattaaggattaaaagggtatgtaaaaaatttcagcaagggataggctggaagtatgtggcaactttctggaattgagataatagaatgattattaattataattttaaaaaattagattccttttatattaattgtgcacagtgaaaaactcttccagggtattatccttcactaactggaaaaaagaaagatggaggtttattgtgatcagatctccagaaatgactacttcctactaaattagtgatttatttaggattttgaactggattttaaaattttatgtacttatatttgtgctcatctgttaacatttctttgagttctaatttatatacagtgaaatgcacacacactaagcacatagctcaaacctgtatatgccatatctcttcactggtactccaacatttctcatataaaaaaaattcgagcatgtttgtgcatctttccaggtgaccctgccactcctccttccccatcccccacctttgaggaggctgatttttacaattgcttagttttctatgttgtagtgctttgtctaaatggcatcagagagtaggtagtttttttgtatctagattcctttgttctccgtaatgtttttgagattcatccatgttgttatacatctgaagtttgtccctttttattgttaagtaataagtcattgtataaatatatcccaacttgttttttctcttcttttgttgatagacatataagtgtttccaatttgctattgtttgaatgtgtcctctccaaaattcagttcccaccaatgtggtaatattaagagatggaatctttcagagatgtttaggctgtaaaggtttctcccttgtgaatgggattaagactcttataaaataggcttcatgcagcattctactcttttgccctttcaccttttgccacatgaagtcacagcattccatccctccagaggctgcagcaacaaggtgctgtctttgttttttgtttttttgagacagggtctcactctgtcacccaggctggagtgcagtgacacaatcatggctgattgcaacctctgcttcccaggctcaagtggtcctctcacctcagcctcccaagtagctgggaccacaagcgtgagccaccacacccagctaatttttgtgtttttcatagagccagggtttcaccacgttgcccaggctggtctcaaactcctgggcataagcaatctgcctgtcttggcctcccaaagtgctgggagtaaaggtatgagccaccacgccaggccaaggcttcatctttgaagcagaaagcagctctcaccagacagccaaacctgctggtaccttaatcttgaacttcccagactccagaactatgagaaaacaaatttcagtcttttataaattattcagtctcagatattttgttacagcagcacagaacaagtcttttctgaacgtatgctttcatttttcttggtaaatacctagaagtagaatagcaggcttatatggtagatgcacatttagtttaataagaaattactcactgttttcctaagttttaccattttataatcctgccagcaatttctcaaagttccagttgttccacattttcccttgcaattgattctttaattttgtcattctaaccagtgtatagtggtatctcctctggctttaatttgcatttctctgatgataaataatgttaagtactttttcatgtatttatttgccattccaatagattcctttatgaagtttctgtttaattatttattctactttctaattagttttttttttaattgttgagctttaggagggttgtttttttttcatattctagttacaagttacctctccccttccccaaataaaatattttctgtcatatgtagcttggctatttgttttctgagtgaagtcttctgatgaacagaagttttggtttcctagggctgctgtaacaaattaccacacacttagtagcgtaaaacaacagaaatttattctctcacgcaaggccagaagtatgaaatcaaggtgtttgcaaggcttcctctgaggagtcctttcttgcctcttcctagcttctgctggctcctggtaattcttggcactccttggtttataactgcatcatctcaattcttgcctccatctgcacgtgggcctcttccctctgtgtgcgtgtctgtctctgtgtgtctgtttgttcatatggccttcttgaaaaaaaaaaagtcattgaatttagggcccaccctaatccagtatgatctcatcttgttaattgcaaataaggtcacattctgaagttccagtgggcatgaatttttggggggacacagtttaacccagaacacttatttattttcttaatgaagtcttttgatgaagagaagttttccattttgatgaaatacagtttatctatttttaattttgtagctgcttctttctgtgctctaacaaatctttggctataccaagttctcagagatattctcctgtgctttcttctagaagtttttcgattctaccttttatattgagatttataatacattttgaattgatttttgtttttgtggtatgagatgaaatccaaggatgatttttttctatatgtatatccagttgttccagtatggtttattgaaaacaatgtcctttccccattgaatttatttggtagtttgtcaaaatctattgaacacgtaaatatgtctctgttcctagactctctaagctattccaataccacactatcctggttattatgaacttataataaatcttgaaatcaggtagtgtaaggccttcaacttcccttacttccttcttcccttccctttcgtctcttccttctttccctttccttccttccttccttccttccttcctccctccctccctccctccctcccttccgtccttacttgctttcttctttcctttcattaatcactttcaaagttgttttggctattgtaagccctttgcattctatttaattttgttatcttcctttgaagaatactgttttctttttcttttttattttctgtcaggcagccattttactggaagattatccttattctcttcaggcttggtttaggatgtgttaaggtggctagaggagctagagcaactccactcctaaggcatgatctttctgggagtgaattctctgggtgttcagagagattgctccactctggatggtcgtaatccagtgtctcccagcactgtgtgagccctggaatctctgttcagcttatagcccaggagatgtttactgccagtcaagtagagtcttgcactacacatatacaccttagccattggccacatttgagaaatttatagagttcttggggaaccctatgcaagattcctagagctcttcgtctacacatttttcttctgcttctctgtggcttctagtttgaaaagtgtccctaggtagaaagccagagttctttcaaggatcatagctatgtgattgtttcccaatgcctaaaaatagttactttccatatcttgcatagctttatagtttcatatagtggaaggtaagtctgatagccattaattcattatgtctgggacagggagcctatgctgtccctttgtgaggaaatatgtaaataggattgccagttagttagattcttgaaagcatgtgatatttaaggatttaatctatagaaagttgattatgtgatttagaagtaaggcatgtgaaaaggaccatggggtacacttaaagaagctcaattgcttctgataatcagggaggtcgaagcaattttgaaatgccatactacatagcctgccaatttctgttcttttctatctattgtacttttaactaaaaggtttctgagatattgccgagtgtacaaggtgtgcatcagtctactgagttttaaactgttgaatttttataaaattattatagttttcctcagtaggtcattatgccaggcaacaaagaacactatttccagaatattaaaaataccaaatataagggtctatctgccacagtgttctacaaaactacttgttatcgcctcaaatttacacacataaacaactaccataggaaaacattttcagcattttaaaagacatcacttctccatgtatttgacctatttctaccttaggaaaaaaagaaagaaaatgaattgcaacatgtcctgtagcacttttgatttactcataatacaatttgttttaagctatagatatatagccaaaaatggttgaaatttctgtggttaggaaatgcctatgtttctttgcttactctgggtttgttaagaaccaatcaatacagcatatattatggcttttttttttttttgagacggagtctcgctctgtcgcccaggctggagtgcagtggcgcatctctgctcactgcaagctccgcctcccgggttctcaccattctcctgcctcagcctcccgagtagctggcactacaggcgcccaccaccacgcctggctaattttttgtaattttttttgaaaggaaaaaagagccttgcttgggaaagtacaaataaacttcaaagcaacacatatgcattttgtacctcctctcagccagtgtggaatttaactttttggttatagtggccctttagaaagggaaagtgagaaaatatagtgagagagattgacatgaaatcgagtaaataacttgcaatacattaaacttgtagagacagctctcaatatactgacactctgaggaataaatcaccaactctatcaacttgttggggtctttaggactgcctcctcaatcaagcaaggtgtttgactgagctggaacttggaaagcatttaggttttgacaggccaatgagataagggaggacattgcaggcaaaagcacagcatctgcaaaaatatggggagttcaagaacttgatgcatttggaggcttgcgagtggtttggtgtaggtagaatgcagcacacatgtgggagagtggcccgggatgaggttgaaagggtagtaacaattagataacaatgaattctgagaatcagaatgaaaacctgacctgaggcatgtgtctggcaagttgtgacattggtcatgggaagaactgagaaagcctgggcaaagcagtgtaactaagcccaactgatagaaaaacaatccaaagctgtgttcccagatggcagaaaatagtgttatcatgggtgtgaagaacagcattcttatggtctttttcagtggactcattacaaaaactttatgatcatcgccttgacggcaaacttgaaggaatgatagccctcaagcgaacacttcactaagttgtttcagaaattagaaaaaaaattctaaaagacaaaaaatattggaattagataatgacatcacatttcatattagtatttctgcataaaactgagagccctttttggaaagcatttttgttattcttaggatagtgcaaaattttcctggctttatacacaaatgctcatattcttaattaatattaatgaagataaatcttatggatgtttaaaccattgatctgggtcattgttacaaataattcttttttaatgtgttctattgtatatcattagtatatacaggtcatttttgtttcttccaatatagtcttgtttttatttatcgccattattttaagcagcatgaagatataaatatagactgattttcctgataatgactataatgccttaattttctttataatttttctttgcggttgccaaggttaccaggggtcacataaatattctgtagaagcataattagtacaatggcacataacagtctttcacagatagtatacaggaatgatagaattttaaagatcatatgagaacaggaatggtgtaatataaattcacacgtgtggcacagattgaagcgtgcgcggggaggtgtgggagttgcacaaaattaaaccccctcattacaccatgtaaattgccatcttgcagttatcaggtcctcctccttctcagatgctgaagctaggcttctagaccagcagaagaaaatgttgtagttcaatgtattctcacttagctgatgaactcacttacagttgtggctattaaaagctgatggtctgcatattgaaatgactgtttatatccatttatcttaaagaagtgttctacacttcccatgacttttctgtactcataatataataaaaatgtcagtattctagttctgctagaagagctgtagacatgtctggttatctggcattgagggctgggctatttatccacattgtaataatacaccaatttgaatacaaattatcaaaatgtgtgtgtgcttctatacatgtgtgagagatatgttaatccagcatttattatgtttcaagcactgttctaggtggtttatatatattagtcctgaccatgaacctgtgtactattattattgttcccattttacagatgggaaccaaagtaaccagggcccagtgaggttaaataacttgtttaaactagaaaatgatggaactggcatcaaaatgtagtatacactgactctagaatgtacacaattattaagaaatgatgatttcaaatgtaggtaatttgtgtggcaagggactgatacaatttgtacattacctaagtaattcatattgacattcttacctttcaaagcatcctctgttgacataatttcagacacctttttgtgcactggggaacaccatggtaccaaattttgttaccatatttctcattggggtttattacctttaataatggatattttcatgatgcatcttctaaatactaagagacagctaggatttgaaattaaaccccctagacttcagtttctagataaattttaaaagtgagaaaggtaaactctatggattgtggtttgctgatgttgttattagagtccattcttccatgaagtgctttggcaacattacaatcaaggattcccccgtgcaggtttcacaaaggccatagttcacatctttagaaactattctgcggcgatttgtacttctactttaagatgattttagggtattataataaaactggcacagtgtaagtctttaatgccacataaaaatcagaattgatttaatgtagaaattaaagctattttttaattcagtaaggtacattgcttttaccaaaaatgggatagaaaagtcaaggccttagcaatcagaaaaccaaatgtagttctgagtcctgcaaaagtatttggaaaaggatctggcagatatgaatcaacttaagaaaaaaaaaaaactttctttgaattcttctatagtgtttggtttcaaaggtagctattgagatctacagctatggtgataatcagatgagattatacagaaagcatgcagcattgtgcctggctcatagtaagcagtaactaagtgctacctgtcatacgctcatctggccattgtagtgtagaggttaagagcaaagtctctggagtagactacctgggctcaagtcctagttctaccacttatcagcggaaaacctaatcagtggttctcaacctgccggcagttttgtcccccagggaatgtttggcattgtctggagacattttagattgccacgattagggatgaggttcccctggaggacataggtgctgctaaacatcacgtgatatacacagaagctccccacaacaaagaataatgtggtccaatatgtgaatattgcagagattgagaaactctgacctagaacaaataacttactctttctgcaaaataaggacactaatagtaccaacatagtgaattcaaaaaaggcacttaggaaagtgcctcacatagtaagcagtcagtaaatagtagctcttgttattcattcaacaagtattgataaaatgctcactatgtgccaggcactctcctagatattaagcatccagtggatgccaaataggcctggcccctaaccttgaggatcttgctgtttatgacggtagtggtcgctgtgaggtgacgtctgcttcctagggacagcagcatctatcactgttagggctacctcatgctctctatgcccgcctcctctcaaaatacaatgctccttcttcatctctttttaaaaatctctcttctagacctagaagaatctatagttatatttcaaaagaacataattaatcccatatttcccaaaacactcatctaaacttcggcattgtagacccctcactctgttctatgagcagatattgctaatctctccaagcatactttgaatttgaggaagtttcattcatgccaatggctctccagttagagatttttctttgccttaggactttctctcttccttcctctgactatggaaatcctagtttttctctatcagggctgggatccctgagtttcttctgtagcctcctccctttattccttcagaatttcaggttcctgttcttgcttatatagcctaatatggcccagggagggaaagtctctatttcttttgcaggtgctttttactgaggaaacattcttggggttctacgtgggaagtttgagtgtggtttcacctggaggccaagctataaatggtggcctatgtcagcagttctaggcttgggtaactgtgtgccaacaattcccagttccggagccagttctgacaaggacagagaatagattgggatctcacccgcctagtgtgggaatagaattggaattcactgtgctaatgactggttcctggtgttcctaagaaaagccccgtgctgttacatgctgactgagtcatagcttttctgtgtgttccaatctgttggcccagttcttctgctttagtttcctctcagccttgcaattctctgagtaacacagtgtctctctgaaaaggctgatcacagaactatgatctgttcctaaccacctgtctagactccttccacccccctctccctttctcccacataccttatgccctagcagtgtataaaatactggtaggttgatgaatatgccatacttcgttgttcctgcatgctttgtacatattcttcctctgcctggatttttcagcttgagcaggtctgagttcacatttacttctttcactgttagacactgaatgtctggcttcctttgtcagtatctagcttacagcttgcatccctctgtctcatcttggcttccgcatttctcctctgcccaccaaagtgtcaggtgttgccaagtttaccctgttggattagtgaaaccaggatgtactgaattgaaatcagtcacagcatgatccagtaaattgaatcttcagaggacctaaccattatatacaatactgcctctgtgtaaacattaggacaagatcctaaaaatagatcaaccagtgatgttttagaacacagccacatttatgagttgtagattgaccagagtaagaatgcgtgtgttggccctgagcggctgcagcctgctttgggacgatggtcaggtcccatgtccctgctgcctctctctggagtggacacttggccaaagctcccatccacatctggaaagtctgagccgcagcctgctgcaccgtttctgctctgggatcttgtgagttacttttttaggctgtggtttggtgaaaggaaccaacacattaatgatttttccccccagaagccactgaataattctttttggtgtatttctgccttcctgttggctgtctggccttggagcacgtcgggcgagtggagtacataatcagtaccacacagaggcagggcgtgtctgagagactaatgactgtcctgcctctggcctgtgtcctgggtgtgtacggtacctgccgggccagtcccacccatttccaccctgcccctggagcagcagctttgataccatgggtgtcccttgagtctgagctagagtgtgtccccgataaactgtgagacctccctgttcttggtgaccccaattgggctttggcccctccagcaaccttgtgtcccagccctgcccttcttcccaccccctcaatctgctagtccctgaagcctttaaccaaacgggagtgggcacagaaagccttctcctggcaacacgacaaggactgcccgcgtgtccagccctgttgctctcctggcgctgagaggtgggtccaagcagagttgatcagtccctgcctgccctgactgggtctagccaggggaggttgtgtgtgtgggagaagaccccgggatctgctggggtgggatggaggttattaaaggtctaagtgaggaggggctggggtttggatgcggggtgaggcccgagcgctcacacttcgagtagggcaggcaggggcctgacctcttgcagggcagtggccttagtgccccacccctgccctgcgcagtatttattgctaaattgttgtccaggaggggcagcactgggcctggccccctgggtatttgttgctgtacatagcgtatgtttgtgatatataaggttttctttattttgtacatgatcaataaaccttttaaagagacaaaaaaaaaaaaaaaaagaatgcgtgtgtctgtgtaggtatacatgcaaatataactagaaatgtatatatacacatttttataattgtatttatatctttactatatttatattttatgaaacaagagaaaagagtgacataaatgctacaaataagaaattgtgagaaaaacaaaattagagtatgtgtttagtgaatgagattgtacagatatgagagagaaggaatgaaaatgagggagtatgtgaatgagtcattggatgttagtgtttaaataggaaatatattattgatgtttgggcctaatttcctaaattagaaatggaaattattgtatcttttacatatctgtatgtaattcagaaatacatctatctaagtgtggtattgaggtggaaatgcccatattatcatccaaatgccagaaagaaaattttatggaagtgaaatataaaccaaaggggaagaaatacgtaacttagactagcattcagattggaaatgctgggatggaagaaagcagcttgttttaaactccactccgatactttcgtttcaataggattttaaatcctaacaactttcctagcctggactaatgagatagttggaccgacctggtaattagtatggactgtgcctcccaggacctcccataaacctttgtacagcataaattgtgtctgtgtgtgagattatcaggtattacctagagctgtaccgcgagtccaaggttgtaaaccttgcttcagtggagaattaggagggaaggggagtaacttattcttacacagcaagataggcacattgttttgtcttccaagccttggaaaagaaaattcattgaatttcattcaacaaatttttattgaacccttctctctgtcttgggctataattgctggtagttattggggtagaagagaggtatagtacacagttttgtccttaaggagattaaaatcagtctttctgaggatgtaagactggcatataaagcaattaggcaagaaacagagaaaactataaggcagcacaaagtagtacactgaaaaataatgaaaatgtgtagtaaagctatcagagctgtggactatcatgaaagggagagaactgtcaagaagatgggatatgagatgtcaaatttttattgcagtataattcctgtatgattttgatgcccagttctcctctgttttaaagcataaaatatagtgaagaaattttctatagaccactttgtagaacacccaggttttgcttgaattttaaaaaaggaatgttatacaacaaaagaaaacaaaaagcaaaacatttatttgttaagtgttctgaacgttctgtgtaggccaactcacaactacccccaaaactggtggtggaattgggaaaaagtaagtgtgaagcttacatttagctctggaaggtgtttctgggcattcagttagtaattattttctctgataatctagaaatttataacattgctaagaaaatactcaaaccacactattaccattgtacctgtcagaaatttaggtcctccgttattcctttttctagggagatgttaatcttagaatgctagaaaggactaagttcttttcatagagctacagtcctcatgcagacctgccagttcataatttccaaagggaaaggagagtcttttggtcttaatatgtaacaatataaagcactattttaaatgtttttgtatgtgttctagttttgttcattgtggttgttatctactctacctttaaatcataatattaaaataggtggcaatgccaagaaatgttgaggacaaaacgaatctgtaacttttacttagttacttgggcagacaatatgctctttgttatgaaaaggcgtggaagtaggtggcaaagtcatgaatgaacaagacggtcagctatacttattgattgttttctgcatgcagatcactgtgctaaaaaggagaattacagaattgatccctacacctggaaagcatatcacacaatgagagaagaaaggatgcacaccaaaatatgcatatcaacaccagtgatgaaaactagttaataggcattttcacttcctgtcttttccactttcatgacatctagtacttgctttaactaagcctcttatcacattgttttggtcttccattctagacataatcaactaaagacataaagaatttctttttatctttgggaaattatatccatatctgttgattccaggggttggttaaaactgtggccccaaaggccaattttggggctcattcttatatggccccttgagctaagactggtttttacatttttaaatgcttgtagaaaagaaaaaaagcaatatggaatagaggtgtatgtggcctgaaaagactaaaatttttactctctgtttttatacagaaaaaaattcttatcctcattttacagaatgagacccacggggaacatttgaacgagtcataggaagcttggggagatggattacttagggaataggctaagttcctgtaacaaagagacccaaaatgcagtgctcaaataagaaagaagattatttcttttttatataacaatctagaggcaggcaggtggttccgggctgatgcacagtcctgccacctgaaattactcacggacacagtttttgtctgtcttctaactccacactgccattttcctcatggaggacattccagtctgaaagaaaagaagagtggggacaatcagttcctttttaataataaaatatggatcataacgcctgtcacttctgctcacatcccagtggcgaggatttacatcacctgttcactttagctgaaaaggatataggggaatgaagtttctatctgggaaaccatgtgtgccctgataaaagtagagagttttatgacttagaagaggaagagagttattgctattggaggacagttagcaatctgccacagagaggtaaacagttcatggtactggattattcctgatcttcattgcagaattctcaacatgatcattatgtaatatatactgaatatttactatatactcagtatatatttgttgaactcattaaagtgagcagaaaactggaagcaatacttagtctaggaatggtcacttagggagtaatctgttcgtgaaatgggaaagacacaagcatggtggggtcagatgtgtggctcctgggaatggttaaattagcgctagagattatagagctcccagtaaggtaaagtacagagattagtttagacagtaagtgaatcttctgtattttatacaggggtaatattggtatttaaatagtgagtttaatttaaagaaaactcacaatggtgggaaaaacttcaagagggtggtaagatggggctggtggtgggttgtgagtataagcaggagttgggtgtggtgtccaatgtggtaaatggggcaagtccagtccccccacagattaaagtcatgcaggcagcatgtgatagatctagaattctgacacttttaaagcaaaattcatgaattcctgagggacaacagagagagagggagagaatgagatttggcaagatcctgacagaatatcaaagcctcaaccaagcagatgggtgtgcagggcagagtgtagagttccaggctgggaaactgaagcagaagctcaactttgtagactgggccaacatgatggggctgggaaatgatttattttagaggctgcacacattcccagagctctttttttgtaaaatctctgagcagcaagacttgtgattttctggcatcatgatcataacaggctcagaaaccgggagatggcagatttggggcctgtggaaacaaggacagggactgacatgaaggctggtgtctgaaactctggtttgaaaagttgattacaatgtgccccatgccctgtggtactttataatgctgttttctttcttgcagtgaaaatactcatagaaaaaaatgtagctcaattttgatagggtgattaatcatgataactgatattttggtgtcttgttattctgaaataatttgattattataattaaagaaggataaaaacagaacaaactccccaaattgatgtttcaggtcaaattagcctattaggtagaagatgaaattgtgcatttcagtacttcagctctgcataattgatgggacaccatgtactatctctttggctattcagcaacaattctgttagaatctgcttgtggagtctgaggttgcactattcataactttcagattttatagatgtaaaaatattttatatgtcattattttttaatccttctaattaatatgtatgaataaaatgttaaggatatataatagaaatcttaccttcatcttgttttcttctttttatgctaatcattttactagagccatgtcaaaacagtaacacatacgtggttagaataataaccagttttttgaaagaacatttttttcctattagggactatatgaatatttgatcagatctcaaagaaaataaaagaaagccttgtgattcagctttcattttagaaactttaacttataaacatttctcttttgcacttaatggttactatcttaatagatgaacactttgcaaacgctaagtatatgtgtgtttaagaaataaccaggtactatctatggggtaattttaaaatgagaaaaattacctaattattaaatatataaactttaatgctaaggagaatactttgttaatttaagcactacttcatacagtaatgactggtgtcagtatacgaaggtgcagttgaaacttttcatgtactcttaaagataagaccagtgaaagctcaaggttttttcttttctttaaagaaattcaaacatttcatttgttcaagtttcagtagctttcatcaaggcagatacatattctataaattatgatggttcatgttcatgaatttaatgattcttgggaatttaagacatgggttaatgatattagctgaaaaattgcaggcattcagtttgggttcaatttgatataacattttggattggtttaaataaaagtctagcaaattactgattcttaaatttgctacatgtgttaaaaggattttgttgagactgctatttataggtattgagtcgggatcaacagtggaaggcagtcaggctattaaagttgtgaatgacatcatcatcatcatcttcatcttcatcaacatcacttatcatcattcttcttatttgcttaatgtttctgccttatttgatcttttttgaatatgtgatcttattcttgagcagtactgcagttagaggaagagatgataaagagaaaggctatttggactggtttacctactcagttttgctggcatcaaaacagctggtaacttggctgatgaggttctgagggactgcttcacactagccaaaagtattaatctgattataaactcaagtgccaattttaattttaatctaaaatgagaattatagcagtgaactaaatcagaatacttattgtggttgatcattactactgtctctggaggaaaatacactctagaagccaaattattatcagaattttgcttgctagcatggaatgaaaacaaatgaaatagaatagtcttcagaacttgtatttgttatagataaatcttaatactttaattttaagttccaaatcatagagacattatattatttgtagcccccacccccatatcctgacttttattaatgaaaattccaacatgcacttcaaatgatttgcttaaggtcaaccattacagttgttggttctgggaatagaacctgctatttctttttgtttgattagttgattaatgcttatacttctgatttctgattatattaatgtatgtatacttttatgtggttgaatattcacaacattaagccaacacacattttgttaatgatacatgaagaaatgtatatgtttattatgcattgaatcaaattgtaattagctgtagattcgaaagaaatttttgaaggtgtttgggggtttaattggagtaagaaggtagaaggggaatttccaagttggttttctaagagtatgtttttgttctctcctaaaccagtaatgtaaagggcatataaatgtgttaagggagaggaagtggcatcattaaatgtgggtttgggtgcagaatgagagaaaacatttgcaaactacccatctgacaggggaataataaccagaatacgtaaggagctcaaacaactctataggaaaaacaatctaataacttggtttaaaaaaatggacaaaagatctgaatagacatttctcagaagaagtcatacaaatggcaaacagctatatgaaaaagtgctcaacatcattgatcatcagagaactgcaaatcaaaactacaatgagataccatctcaccccagtcaaaatggcttttatccaaaagacaggcaataacaaatgctagaaagaatgtagagaaaagggaacccgcatatactgttagtgggaatgcaaattagtacatccactatggagaatggtttggaggttcctcagaaaactaaaatagagctactataacatctagcaatcccactcccaggtatatacccaaaagaaaggaagtcagtatatcaaagagatagctgcactcccatatttattgcagcactagtcacaatagccaagatttgaaagcaaccaaaatgtccaccaacagatagataatgaaaatatggtacttacacacgatgagtaccattcagtcataagaatgagatccagctatttgcaacatgggtggaactggaggtgtttatgttaagtgaaagaagtcaggcacagaaagacaaactttgcatcttctcacttatttgtgggagctaaaaattaaaataattgaactcatggagatagagagtagaaggatgcttaccagaggctgggaaggattgttgggtgggggccagtgataaggaattggggatgcttaatgggtacaaaaaaaaaaaaaaaaacagttagaagaagaccagaagacctagaatttgctagcacaacagagtgactatagtaaaaaataatttaattgtacatttaaaaataactaaaagagtataatggggttgtttataacacaaaggataagtgcttgaggtgatggataccccatttaccctgatgtgattacctcaatatcatcgcatgcctatatcaaaatatctcatgtaactcataaatatatatacctaccttggatccacataatttttttaaaaaaagttacaaaattgtgggtttgtggggaactcatacgtttcactcagtaatttttaaagcagaattattttaaaattgtcttttaaaaaagccttctgttttgcaatttagtgcagtttactctctatagtttatgttgcagtatctagatgacaggagattgtatgatataaataattttctatatttgaaacacctaatgattctaagatcaagtgcaatttatttatttatcttcagaatatacttttataaaggttaatttaaaataagggtttatccgcccctggagtgtgcatcactgtagtgttggtaggacactgttgtgtaaaataggaagcacattggcctgggttaggatcctggctctgccacttgaatttggtgggttcatccctatatactgctgtaattgcttttgtaagttcatagaaacgacctgtgattttgagccacttttgatgatgacccaagtgtcttggcttctctgtggttccatttttctcatcagcaatttctattattatagagctaacaatcctatttattcaaaattgtcatgaggcttaaatgagattgttcacctttaaagacttcggaaactttgtatatagtagtgttaatcaaattttaatggcttttaaaattgttaccattttgtcttataagtttgcattataaaagcatgagcatattgaaggaagagtaagagcaatggagagtaactatcataatagttttaactcaatatatttctaacctgaatttagaagacaataacatttgatagttaagtactgaaaaaaaatgataatctcatgagttttgaaatattttaagtcaaccattctatgtctgaaattagacagtttttataatagaatttatacattgtatttttattagtctggttatatgggggtttctacacactgcagtgggcagaaactcatttaattcatgatggcagttgtagtgatactttttaatttcaaaagaaaacaatgatgcttacctatttcttttgttattggaagatggacaaattccttctcttttactactaacacacaaattttcttttctttttctttcttttatttttttttgacggagtttcactcttgttgcccagactggagtgcaatggcgcgatctcggctcactgcaacctccgcctcccaggttcaagcaattctcctgcttcagcctccagagtagctgggattacaggcaggcaccaccacgctgggctaattttgtatttttggtaaagacggggtttctccatgttgaggctggtctcgaaatcctgacctcaggtgatccactcgcctcggcctcccaaagtgctgggattacaggcatgagtcaccgggcccggcctaacacacagaaaatatttaaagggtttacttacactaacaatgaactatctcaaaaagaaatgaataggctgggtgcggtggctcatgcctgtaatcccagcactttgggaggccgaggcagtcggatcacctgaggtcaagagatcgagaccatctttgctaacatggtgaaaactcgtctctactaaaaatacaaaaattagctgggcatggtggcacgcacctgtagctccagctattggggaggctgaggcaggagaatctcttgaacctgggaagcagaggttgcagtgagatgagattgcaccactgcactccagcctggtgacagagcaagactctgtctcaaaaaaaaaaaaaaaaaaaaaaaggaaatgaataaaacaatatgatttataatagctataaaaatacgtaggtgtaaattaaatcaaggaggtgaaagacctctacaatgaaaactatgaaacactgatgaaagaaattgaagaagacacaaataaatggaaagatatcctgtgttcatggattggaagaattaatgttattaaatatccatactacccatagttatgtacagattcaatgcaattcctattaaaatttcaatgacatattcccacagaaatagaagaaacaatcctaaaatttgtatcaaattacaaaagaccccaaatagccaaagcagtcttgagcaaaaaataacaaagccggaggcatcacactacctgactttagtatattacactacaggccgggcacggtggctcacgcctgtaatcccagcattttgggaggccgagatgggtggatcacgaggtcaggagattgagaccatcctggctaacatggtgaaaccccgcctctactaaaagtataaaaaatcagccaggcgttgtggcgggtgcctgtagtcccagctacttgggaggctgaggcaggagaatggcgtgaacccgggaggcggagcttgcgattagccgagatcatgccgttgcactcctgcctgggcgacagagtgagactctgtctcaaaaaaaaaaaaaaagtaaataaaataaaaataaataaataaataaataaataaataaataaataaataacactacaaaactgtagaaaacagcatggtactggcataaaaacagacatgtagaccaatgaaacagaatagttatagcccagaaataaatctatacatttctagtcgattgattttcaacaaaagtgccaacagcatacgagggggaaaggacagtctcttcaataaatagtgttgggaaaactggatatccacatgcataagaatgaaattagacccttatctcacaccatatacagacatcaactccaaatggattaaagacttaactgtaagactactagaagaaaacaggggaaaacttcttgacattggtctaggccatacatttttggtatatgaccccaaaaacacaggcaacaaaggcaaagaggcaaatgagattgcaccaaactaaaaagtttctgcactaaaatggaaacaatcaatagagtggagaaacaatgtacagaatggaagaaacatttgtaaacagtacatctgccaaggggtccattgtccaatgtccacctagcacattgtctaatatatccaaaatatataagaaattcgtgcaactcaatagcaagaaaacaaataacctgattaaaaaatgggcaaagaacctaaataacatttctcaaaagaagtcatacagatagtcaaaatgtatgtgaaaaaatgctcaacatcactaatcatcagggaaatgcaaatttaaaaaattgagatatcacctcacacctgttaaaatgactattatcaaaaagacctatgataacaagtattggcaaggacgaggagaaaagggaacccttgtgcactgttggtttgaacgtaaattggtacagccattatgaaaaatagtataaagtttctcatcaaataaaaaatagaactactatgtgatccaggaatttcacttctgggtatatatctaaaggaaatgagatcagtatcttgaagaatatttgtactcccatgttcatagcagcattattgacactacccaagctatggaaataatttaaatgtccaccagtggatgaatgaataaagaaatattggtatatacacacaaaggaatatcattcagccttacaaaaagaaataaatcatatcttttgcagcaacatggataaactggaggacaaactgctcagtgaaataaggcaggcacagacagatgaataccgcatgatctcattgtacgtggaatttaaaaacattgaattcatagaagcagagagtaaaatggtgattgctgagggctaggagatggggaaaatgggagatattagtgaaagagtacaaagtttcatttatgcagatgataagttctggaaatctaatgtacagtgtgtggtgactatagttattaacactgtattgtatacttgaaattcaaatgttctcaccatacattaaaaaaatgccaactatgtgaggtgatggatatgttagaaagcttgatggtagtaatcatttcaccatagatatagatgtcaaaacatcacattgtacacattaaatatatacaattttaatttgtcaattatatcccattaagaagagaaatttggccaccaaaaaaagaagaaaggaattccaacttgactctgtttttcagtaaacacccatgtttgctaccatatacataattgtattaagtacagtctattttagaaataagtaagtcagattctttctctctctctctctctgtctcctcctccccctgcctttctttgttaactatgtatgtatatagggaatacctagcacattgtctaaatccctagaaatttttactgtagccacatatgaactcatcactccattctggtagtcccatgactaaaaatgaatattttgatgtaattgcttctgagctacttcattatttattaataattgctttaaactgctgtgggttgttttcttagtgggatttttaggctgtatgcacaataaaagtggaaaacattgaaatacattttacatttaaactcaagcagttctccaattaaaaagctcccatgcagcataggcatgtcgataagtttctctatagagcttactagtagcatttcaaggcctgtttctcagcctctttctctgagcaccaaatcaaatgatctttgtccctgcttcagaaagaatctcactttacattgatttttgtccataaaagaatgatctttcgtagttttctagggtaggcaggattgtatgttaagaagaatttgatggccaaaacttgtatatcaattttcaaacttggaaactgatattttgtggctgagtttgggatacttagaatgaaagtaagctcagaaaatcacaagggtgttatggccattgttggttttcatggattccacagcctcattgcttgtaagagtaataataataacattataatcctcataataaacccatggtctttactacatgctatgaacagctaataatctgcatggttggaattggaacctcatgcttctggcttcaaagtttgttcctgtaaccactgcactttatttttctatattggattcctagcaggattccttgttgaaagattgcttaatgcatatctaaattaaaatttttgccagatgcggtggctcatgcctgtaatcccagaaatttgggaggccgaggcgggcagatcacttgcagccagaagttcaagaccagcctggccaacatggtgaaaccactgtctctactaaaaaaataccaaaataaataaataaataaataaataaataaataaataaataaataaaaccagccgggcgtggtggtgcacacttgtagttccagctacttgggagattgaggcacgagaatcagttgaacctgggaggcgaaggttgcagtgagccgagattgcatcactgcactccagcctgggcaacagagcaagactctgtctaaaaaaaaaaaattaattctgaaaactttaatgataatagaaataaagtaaaattaattattgggtggtagtttctttgacttgatttaatggtcaatgtcagaattaggtcttatcataataatcattggaactcagagtctctgaacattatgtaatccttgagatgaaaatataaggcaggaatgccaattttacaaatttggaaacagaaatgcaaatgagtaaaatgacctttcttaaaatcactactcacctacttacttaaagaactaaaaatgttatcttatataattacttgtttctgaattattttctgtgttggttgctctcttatttgcatttgtttgtgactggcaattaggcatggataaaggatgccatgttcaggagcagtacaatttagtggaaagaatactggcccagaaattgtcatccccattatacctctatctgctggtgttttggggtgaacatggaaatgttccatggctgtttttgcttattttaaaaaaggaagtagtaattgttgctgctatcaagtctccagggctttgtgagaacaaaatggaacatgagttcaaaagggaaaaatatattattataaaattttgcaggataaaatttgtatagtatcatatgtgcagcattatagaatatatatacgtgtgtgtgtgtgtgtgtgtgtgtatttataaagcttatatatgctgcccctgctgtgctactgacttagtgtttctgtggtccatccctccatcctcctctcattcctgtgactcctgtgatttactcaggcacgcctatgactttaggtaacacagtctggtgacttctaaacctatattgtcaactttaacctctctcatatcaaattctggagtgctagcattctactggacatgtccacatgtatgttatatggcattttaaaatcactatttctaaaactgaaatcccatttgggtaccatcaggcttccactgcatttcctttcattaagtctctgcagctggaaacattggagtcaactggattccttttgcctcctttcttttaccttttgcttgtgatttattagtgaccaagttctttaggttctactttctttttcttttttttttttttgagacggagtcttgctctgtcacccaggctggagtgcagtggcgcgatctcggctcactgcaagctccgcctcctgggttcacgccattctcctgcctcagcctcccgagtagctggggctacaggcgcccatcaccacgcctggctaatttttttgtacttttagtagagacggggtttcaccatgttagccaggatggtctcaatctcctgacctcgtgatctgtccgcttcggactcccaaagtgctgggattacaggcgtgagccactgcgcccggcctagattctactttttacgtatatcctgaatcctacccctcctgtttattctgatgccacttacatagtttaggccctcatcaagtccttcctggacttggacataatgaattcttgaaaacatgtttttaagggggaacaatacgtttaaatattttagggtgaggtaagggttggaagcaaacggtgttctgtggacagagaaccgaaaactgtgatacaatcatgacttaaacttcctctatgtactctctgtgtcacattcaggaaacttaaaaatcttcatctgtgtcctgggcttctgggctggggcaccaggtgaggagaccatcctgaggctatggtaaatcaagctgggttttctctctcccatgggcattccacactgtctctttctccgttataggtgggaggctcatgcaagcccatttttaaacatttgtgcaatgaacttagtcaggatgaaagaaaaaaagaatattattgttcttatccctgtagcataagcagaatggggcttccgctggctttgttcatgctggagggtccctccttcctgcaagccatcccatccccatagaggtagcaaaacaggaagacaatgggctgggaggagaggttgaatagggtaagtggtcctgtcctgaattgtgaccctgcatgagtgaatgagcttcaagtttaagctggatggagtcctcatagcaccccatctaccaccctggtggggtggaggatggttctgctgtgtgggtctccttaagcacttcgttaagcaccccaatacaaattatccgtctactcagagttcccttggaccttccctcatcaacatgcctgacaagtagtgcaaacactaatagcgcagtatcactattactagtctagtcaaagccaaagaaagtcaatttgatttgggaaaggtagtttagggatgtcaaaatatgatggatgtttaaaatatgtgaaatctaacctgtataagttaataattaccaaattgccagacttctcaagcggtctgtttccagtttttttctttcttgaagcaaccattccacatggccactagagaaatttttttcaaaacgctgattgatcaatttttttgatagtttcccttcacctacagtttccttcaccatgttttcaaccatagtgatgtacatttttactaatattcaaatctgatctgttcttttagtttcttcattcttttaccttaaggccaatctttacttgtcatttcatctgaaaacagaacaaaattaaaaaataagtgaactggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagctgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaataaaaaaaaaaaaataagtgaacaaaatatagcctctcagctctgttcacaaatctaactccaaaagcaatagtgaataatatagacatttaataaagttcttctgtgtataccaaacaacaaaacagcctaagaatcttctttgagcatcttatctctaaagtttcatcttgtaaggcagctgccacacatttccaaattccttttctcttgctgtaagagctctatctctttgggccacatccttgaacctctctgcggatctgagcatcatttgtgtattcactgtaatcctttctccatttctctcatttgcacccccatctatcatcctgctctgcaagacaaaggatgctgctgaagttctacctgcctgaaaagaggagaagcataatatttataatttaatttcagtttgcttttatctattaaattaaaatgaagtaatgtagtttgtgaatgattcacttctgtataaattagaatgaattaaaagttaacactagatgaaatcattctcaattagattttgcatgcttccttgaggaaacaaaaaattttggagctaagaggaatgttgtggaatctcctccacagcctgtcttatctgtaatagagcctggagagaaactattgcattgattgtggcaaaagtttcagattactcttatgcttttgagttatgaatgttgaatgggaatgttgaagtttcttttcggcaacaggagagtttcttttttgtaaaactttgaacaactgtcccaagtctgacttcgttaacttgggttaggtgcctgttcctgatctgattactgtgcacagggataggtgatgcccggattggtcaggtctgtgtcacatgaccaattgtagcagagaggaagtcaagggttgagagtggggagggatcatttctcagtggcaaatagggagttttttgtttgtttgtttgttttattttgttttaaaccaagagagtaaattgataatggtgatggaaacagcaggtgtctcattaagttggcctgcagggtcctgcctcatccagttccccagccccatccagcaatgtctgctgttcactcactgcactatgtgatgccctttcgtatctctgctttttcacaagcttttcctatgtctggtatgcttttccctcttttctctacctggtaaactcctgatcaaattgcatctacttattgagccttcccttcagattctgttggctactttcccccctgacccattaacactttgtacctacctctctgagagcatttctttcattgtatcacattaggtgtcccttcttctattatacgagtgtctcaaggtctgtgtgctctccatgtctgtgtattctcagtaatggactcagaccaggtgattacattagcattatgtaaaatcgtgggcctagaaaggtggagaatttggattaattttataatttctgtttcatcaaggttgtgattcccaactaagtttctgctgcattgcttccctgggaatgtttggaagtgtgtgggagtactttgggttgttgcaaagcctgtgcattgggtgccactgacatttgttggccagggacccaggagtgctaaatgttttacagtgcatgagacaatcctgcacaaagaaggattgtcctctctaaatgccagttcttccattgaaaactacttatctagacaagcataggaaagaggagagtaatttgatcacaatacaaactacatgtctatctctcgtcaatcttctttgcgtacactgtgaataggagagcctatgctcagttagcacattgcttgaatgataggtttttaaacctaagtgcatttctatccttatctgtttccccatataatctgggtcctgaggttggagtacaaggctaaaacatgcggaagttcaggataaaagtttgcctctcttaagtaaacttcccttggctaggctttctctaagactggggaggaaatgggaattaagttctacgtattctttttttcaatatctatggtgagataatttgatcttaatgcctcttccactgcacagaaggctgagagtgactaatttaaatgatcttttaaaaatctatttatagcaaaccttctggctgaagaaaccaatgtggagggtggcacatagatttaaatccagttttctgtcatgaggtgtcagaaaagctaaatagttctagtgtggttgtttaggtcctattctaggaagcacatctttttgttcattgttgacactgatgttgctgtgttatctagaatataggaattgtgtagagaaaacttgggagtatacgtccccaagtaaggttttttgattttttgcttcaaaggtgacatttttgaaaaaagattcctgaaacctaagttcagtaattcatgtgtgattttattgtcctgtgttattatatatagcataaagtctttttgaaaaataatttaccaagagtctgaaactcagtatttatcagctgctactgataaacttgataaagttttttgaaagatgttacatgtaaaagatacttcataaaatcaaattctactattcttagtatatgtttgtttcttttttagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtaaatgtggttgctggagtttcctgtgttttcattatatgtggttaaatgaatatattaaagagaagtaaacaaaagctttcttctcttgtatatctctttatgatttgggaagccgaggtgggcaaatcacgaggtcaggagttcaagaccagcctgaccaatatggtgaaaccctgtctcttctaaaaatacaaaaattagctgggcttggtggcgcgcgcctgtagtcccagctactcgagtggctgaggcaagaaaattgattgaacccaggagttggaggttgcagtgagccaagatcatgccattacactccagcctgggtaacagagcgagactccgtctcaacaacaacacaaagattggtttaagatagaatggttttgttacattatacaaaaatcacaaacacaggtaattgaaagtaattgcctaaaagcagaaggagctgctgcttttcaggttagtaagaagttgctattcctaaaacagatttattcattactgaattcctcaagaggtatatttctcaattttaaagccaaacatacttcttaatttgtgaatagttatccacaaaaatattatattctaatgctttgtaaaattgtctgggtttagagtttaatagtcgtataattgtaatcattgacagacaacttccttttttacctcatagttggcagcagtgacagctgtcttcttggacatggattgtataaaaatggtgtctactatcttccagcctttgtcatatgtgagacaggattaggagctctggatggggggaaaggaggaagaagaagaaagtcattcatgatacttgacatatacataaattgctatgaagtaataccaaatagtttaagattattccttctggaaagaataaccacagttctgggaaggtccaccacttactatctgtggacattggggaagtcacctaagatctgtatctcaatttcctcatctgtaaattgaggataatagtactgcttcataagttgttgtgaggattaaagaatttatacatataaaatgctttacctatataaaaactttaatgatcctgtccaagcatgggtataaatctctttatttggtttctcttatcgcagatgaggcagtctgggactttgcacatctttactaaatactaaagagcaaacgtaagaaaatctatgtggagaacaaaatatagcaaggctgacttagtgaggaaggttcctagggacatactatctcgcttgctcttggggcttgaggccccatttaattacatctttagctccaaaggataatttcccaggcccttcacttgggtttctttcctcccagattctggcctgtttttgaggggagggtgccatcctaacactcacctggtaactgggaagagcaagaaagggagcaatcccatcttcaagggttcactgggctattcccttcagtctgtttttggttgcagggagaggccttgtcttcatgtggttgagatccagtgagctccttgtttatagcagtgtgtctctgcccatgtccattgagctttcaggcaacaagagtcacatgtaataaagcaagattgttcatttgcagaacaacctgttgtatttctgattacctctacatgctaggaaaatttcgccttaattttgcacattagattttgcttccctgtgactttctcccacttccctgtttgtagagacatagaactcacccagccttcttccagatgacatcccttacatagatgatggccactgctacctcctttcttactgctcctgtctctgtgctaactggtgctagggccctccatctgctcctcctgaggcttgtcaggcagcatttcaatgggtctgtttccctcaactgtgagtcctagatggtcagtgtttgtattggttcccagggtcgaacaccttaactgtacacactctgaccagcacagacttcttgcaatctgcaaactttttccacctaatacttcttaaaatagtttaatgtttttttaagcaactgaaacattttaaagatatgggcaactgaaatacctgaccttcatcaggtggtttgctgtcaggcaaatcctttcttactcttcctgtgaggtagatttattaaagttataggcagggctttaaatgtatttatttcaattgaaaataatatttattgttttagattatagaagtatgttttcgttgtagaaaaaatttggaaaactgacagaaagaaataggaaaattgatacaatcatgttactaaaagactaatgttgaagttctgtcgtattttaatccagtccttttgtctatgtgtattgatacgccatattttgtttaatcaaccccttacttttgggtattcaactcatttactttgtaaattttaataaataataatatgatgaatatttcttatacataagtatttgtgctcagctgttaggttttctagttatacctttaaaatttatattatttctgaaatttcttgttttacttattcagtctatggttgtatctctgtcaatgtctatgaatttatctaggaaattataaattatgtagatattatctagataggttattattgaacaaatatcatatttgagatatagtatatcattctatgatgtggaaaataatttagatttgtaaggcactttcatttgctgagtaagctaacagttattaaaggcttaccatgtgccaggcactgtgctccatgcattacatgtgattagttcatttatcatcagtattcaagagtgattaagagtgtagacctggagatggacagcatatattccagtcatagctctgccactcattgcttttggggccttgtacaaattacttaattgttctgtacttcaattgtccccctctgtaaatccatatagagtgcttgaaaatactagctataaaaattcacaaacctctcataatcatacaagatcagcactcttattttcatttcaaagataagaaaaacaagccttagagataagttcttaaaggttccatgggaataaatgggagtaggcttttccatcagtgtgattatagagcccacctgctgaacctctgtgctatctggtctctccgtgtctatgggagatcattaaactaggttctttattgcctttttttcagcatcatttagctagttactgacagagccagaacccaaacccactttttattattgagtctttttactaatgccctgtgatattgccttctatcatctcaacagaccttctgttatggcttgtattggattttttcctgttcttcttgctgaagctatctttctttagttatcttgcttttcctcactcatctatttagtttcatcattgcctaaacacttatttcattattttctgctttctttcacaaaaattttaaggtggcttatagaaatatctacaggacaagataaaatgaaacatatacaaatcagagcaaacaaaaggataaaaaccttgttaaataattaggataattcaaccattcttggcactgaaaccatacacatatttctcatatggccttttgtggtcaaggtagtaagtgtccttagagaacaagttcaggggactttatggtagctggtcacttcagaaaaagcagatccacagtgatgttgataacatacatctaggtatgaaggtctttgaagcaacactgccccctttggagacactttcttggtaatatgcaagacagtcatatacaaccaagttttcctgctcaatgtgccagtggagccttctatatgaaggcctggtaagtagactgtgtccttcacaccacattgcatgtaaattgcttttctcaatgtaactcagtcacttccaactgacagtgattaggtgtaggtccagcgcttcaatgggtgcattctagttcaccatagtaagaactcttctgcatgccctgctgaaggatgcttatttttctgggtttttttggggggaagatggggtggcagtggcattgtgacgcttcttctgagcacatgttcttgcctgcctgggagaaagcacaagagcaagatcttgagcaagagcaagagcttgagctatccctctgtgaatttagactctgtgagttagactacaaagtctctgctatagaataaacatgaaatgaacattaatattattattagaggtgatgtgagactggctctctcttccttatgtctgttcctgactccagtgttatctccatatgggctatttgcagtgaacacctagcttattgggaagcctgctctgaagcctaattaaagagggagaaggtaggaactgatggagactgtgggaatggtagcttcagcactcgtggtaatggagtaaagcgataggagtataaatactagccaggcacagtgacctatctgctcggcatctatgtgtcaccctttttctttttctctgcttgttcaaatccggcacgtacttcagaactgcgcttatatctccaggaagctttcactgacctttccagtttacattaatttcttcctacatcagtttccaatgtatttaaaaaatttgtgccagttttttggcattctaacatataatgtctttaattttttttttttttttttttttacttttagttctgggatacatgtgcagaacgtgtaggtttgttacataggtatacatgtgccatggtggtttgctgcacctgttaacctgtcatctaggttttaagccctgcaagcactaggtatttgtcctaatgctctccctccccttccccctgaccccttgcgaggcccagtgtgtgatgtttccctccctgtgttcatgtgttctcattgttcagctttcactcatgagtgagaacatgcggtgtttggttttcttttgctgtgttagtttgctgagaataatggctttcagcttcatccatgtccctgcaaaggacatgaactcattcttttttatggccgcatgtatttcattgttatttaaatattttatgtgtatacatgtttgttaatttcatgagacattaaaatatcatttactgcttctgattacagttgtaacaaatacataatttaacttttaaaaatctaaattgtagctttcttaaaaaattggtaatacatcccaaggttcaaaatgtaaaaggcactccattcctgtcccctgcgacccagtttctatccctgacggcagccactattatcattaaggcattcaaaaacaaaaaaatatgtataaagaagaaaatgaagctcatccagtcagtggtttgctggagctggcttgcctactggctttaggggctgaaattttgtgaactggttgacattagtagcttgaaataggccatggtatgagtaattattccatggaaatcagcagatgctacaaaacagggctttgaaaaatatgctttttcaatgaacctttatttttgcatactttttaaatactctctttccaatacaaatgggcagatgaaccaatagcttagaattgggtctctagagaacagagagccaattattaaacatttaccactgcctataattctgacatttagcgataaccccattaatgctgtggaatgcagctttctcatccttttctcaggtgaatttgtgtgtttgtgtaaaatatttacatagttgacaataatttttgattagatgttaaggttttctgctgtcaaggattgtgcattaaacttgcaaactctattacatctgtcatgatgtcatacacagatgctaaataaatatttggtagatgaagaaatgagtaaaagatgaagagaaaggttattatgagtacatcaggaatcataaatggcatcacaaagttttcatcaagctagagtggtaggatttggagaatgttcaaattgctatattgatgcagggtgcctaatccatcctgaaatgtccttaactctagcatgaggaattcactaactggcagccactgcctcgaaacagctataagtcaagttcttagagaataatgacaactgtaataagctatatggcaacatctcagccacggtgttaatgctggatatctaatcacacaatttttttggtttggacatatggattaatgggcatgctctggattctagggtatctgaagtgaactaaaagcaagaagaaagtaggaagggcagatgatcacactgttgcagaattaagaagagggcttcagtcaaaccttggcactgaaacatagcttcaaaccaagtggcataattatgaaactcccgggaactccatcagcagtgccctggtgtgccatgaacaaagcttcatttggcctcccaacctgagatgctggtttcaaatggtgttccttaaatagaggctgatattaaaaattaagccacaaacttcatgtgagcacagtgtaaaaagagttttggctcttcagtcatttcagtatgttcaccatcagcagcataacctaaaaaaaaccagacagtaatatatggcagttgttggaaagagttaagacactcaggctgattaaaggagttctctcattattatagttttctgactattgtgtttcgaaaggtaaatagagaatagagaaatatttttaacatattgattcatttatccatttatacaggaaacagaagagaaatatgaaaaatataaaggattgttgaaaagcaaaagtatatttatcagtaaaaataaaagaaatttattgaaaattccaaagaaactgtttccttcttccatgttttacaaaactgcagtttcttcaggataaataaaatccttatgttatccttcatgtgatttggtgtagttgcctagattctgttctgtggtttataatatttcttctttatttaaaataatcttggactttagatatacaaatttgttccaaggggtttattaggaattttgctgatatccaggcattatttatgcttctgactttgaatgctttgcagatagcatacatggagataatttgtggcaatagctttgcaaataaatattaaactgtcctgtagtttgtcatcatcttctgtattaataaacttcaggtgaaataaatgagatttttctatcctcttaatattaattatacattctgggtgagtaaaaatgtatttatgtatgaggctgaaaaaatgtgtcttcatgtttgtgagtgcttgtcatgtattaagccatttttctttcttgacattagtaagtaaaaattaaacttgctggcaatatttgcttggcttaatggttctgaactaaaaaatgactttgtttattatggaagaaattaatagactgacataaaagctactaaactcattactttctgcttgcactttatttaataaataactttaaagataataggatttataaattaaaatttcaaactccaatttctacataattaaaaaactttacttagattttattttcttgaagtgtttctatatcattatttatctctcacaaaattacatctctgttgtgtattttaatacctcccttattattaggaaagttacaatatatattctaatgtagccaagcatacatatatcactaccaagtaggcatggtcaggtgctcatcaaagaaagtaaattaaaacaagcaaatggaatttctcatcataatttttatataggtgatgtgatggacagaaatacacattttaacacacagaggttatcccatagagcacacatcccccgtttcacactaaagaagcgaggcattttttttcccttcctgtcagcagtccactctttctgcagggtcaaagaatgaatcagttgactgctgctgccgcagcccatagactaaccagcccatattcactttcattacacattttgggtattttcctcctagatggggatgcagaggaccaagaatatttccaggcaaccatcctattctgaccatatccagttatcaggccctaaatatcttaggccattgcaagacccttctgtgtcatccatcttgtagctccttcacatctactctcttcgctccctatggacagagtactggaattttggtttttgtgtaagcaactgtcattaaggagcaagcaaactgtgttttggaaaccaacttggtgctcctgcttgcaatttctcatacttcccgtttctgtgttgccatatcatttctttataaatggcaggaaaggtgaattgttcattggaaataattggcccatgtaacttttaatgatcagtctgctacttttttaaagttatttttttcttttcagcattaaaaaatatttctaatgattaaaaacttttttaaccttttcttcacttgggaataaaaacttttgagattataattttagttctttcttgttttggctttgctaaaaatttgtgactttattattttcccttttgccattttttaaaacattgacgtctaaattttaggagtctatagctcttcctgattttctttaagacagaagcttatcatatctcgatgatttactatctaataccatgtttcatagagatgtcgttaatgaacggatatttttttttgagtcattggtccagaattctttctgcatgcatgcgtgtgtgtgtgtgtgtgtgtgtgtgtaaagagcaaaatccatcaaatgtataaattcctattaaatataatgttttagacaggaatattttgtattttttcttgtaaatgatgccttataattaaatgcagtgacattagaggctctgactttgctgagcacttaatttttttctttaagaggatttttgcatttcaaacgttgcttctttatatgtgtttattatttggttgttatttcacttaatatcttcctcgtagatttttttctttttttgaaatggtttttcctatcctgagatcaggtagtcttgctttgtaaaaatataatttttttatggtttccctgtcttagtcttgaacccatctataacttattttagtgtacttaagaattgaggctctaaacattttttcaaacagataattaattattccaacaccatttttgtatctctccccctccctcatttgaaatataatcttatattttatattaaaatcatttctgagctgtctcttctgtttcattagtctatttttgtaccagtaataaacttacatacatgattttcatattgtagttttttaatgtatgcatttaaaaatgcaaatgcaaaaaattactactgaaatgtagtatactgttgtattcatgggtgatattcaaaatgtatagtaatcagtatgccatgggcactaaacaaccaaagcaggaaagtgacaaattagaatggaccttgactataatcaaccagtatggctattttctatatgcactgtgtgtatgtacttctaaattttatgatattggctagatatatagatatagattcaagtatagattttaatatgtatacaattacacacaccaaatataggtgaatatttatgaaatatgtatgtgtatgtgtaattttctacatactatgtatatgaaatacatatttcataacagattttaatatgttgcattctcatcagcagagtgcctacttaactactttcttcaacaatgattaaaaagtttgcccattcagaaggtgagaagtaacactttgttgatgaggttgaataccttttcatatgcttattggccatgcatatatcttcttttataaattgcctatgtatatgcattgtcaattttccatattttttataaatgagcttcatttaataaggatattaattcattatcgtctatatttttaatttgcctttaagtttttatggtttttttatgtactaaattttcttaaatgatgtgcagtctagtcaatactttctgtctctaaagggtgggattatgttaatgacatagtgaagaaataatttttttcctatatataaaaaaagagaaggctaattcaaaaattcaagaaaaagaaaatcttgtatgagaaatttgtggtcccttatatataatgaaacaaaatttactacaattttggacaattactgcatttaagaaaaaatatctatcctttttgctattgaacattctcctttgggtgttggagagtttgtgttactctagtgagggaatgattatctcagcacaatatttggtattgcaattaatactacatataggcataaatgcaaatactgttgattagtttcctattgatcttttaattgtgggtctggaaaggtataataatacatctgtgtttaaatttccatcttaatctgccttactatattaaacacatattctatttttatgccctttagtcttgcctaagaaaaaaattgacatgttggacttagatgtaggtatctaaggtatctacttagatgtagatattcagtgcaatatccaacacaatgaagctggtggccccagtgcaattttttcaacagctcactgttttctcactgatttgtaatgtcacctcaaatctccatcaatgctgaggtcggtttctgggccctgttttctgttctactaacctatttgttgatttctgcagagatactacaatatcctgattaatatagttttataagatttgatacttaaagctcaagtctctttgttcttcctgttaagaaatttttgctgcatttgaaacttcattcttgggaataactagaatcagtttaagttttatgaaaaaaatttcattggtatgtattgaaattgcatcacatttatgggttaatgtagtaacatttttatattactcagtcttctaatccagtaatatggtttctttctacattttttaatgtcttctattatcttctttgaaattactacataaagtgtatatacatattttgttattttaattcctaagaaccttatgtattgtactgctactgtgatgggttatttacttttctattatattttctaattgtaaaagatgtttaagttgacgtattactagaaaaatggattttgttttgtatcaaaagtagcatcttccacaggatttaaattgctttctcttttccctagtgacagagttgaattctttggatgcaactcagagtataataacaaaatttttgatgtgccatgaaagttcatttaattctctttttttaatctaccatacattcatatgcactgatattttaatgttcttttccacaatgaatgttgaaggattgttgtaataaattttaattctttggcattacaatacatctctttttgtcttttcatgtcaatgtgaaacttcacaaatactctttaagcccttgatcagttgcttaaaataattttacaaagggctcatttaaaaatataatttttttctacagtttactattcaggaaatagaattcaacttttaacttattttgctatttcctttagttacgattaagtgtctacctttttaaaaagtccatgtgaaatcttgttttggtgtcttaattgacagtggagtttatgttatctccattacctaaaaaatcttatttctcttgctgttgtgtacactccacttccactgattctggagagaagtcttatatttttgtggttgaaagatgtattgatatgtttcataacagctgaataaaagtcattcatgtttgcctctttttttagtacttttattcactgagcattttgaaagaaggtgattgacatgctgtcatctttcctttgtactttaacctttggttatttaaaactctaggtattgtaaaaattacacttgattgtgggatgacacattcttgaggatactgaatgcatcatagaatatatcaattattgaatatttcagcttaaacccatttaattcagccagtagaaatagtctgagcagcaccaaaagtgaagtaagatattacatgttttgagtgaattacaagaaaaatgtttgctttgcaaatgacttaaatatgaaactatatacttacacacttaaacttttaactacacacttaaactatgcacattttcaagaattgagcattatatttaaaataattttttgctgatataacatctgaaaactagctataacttttaaaatttactaatttttgagtattagtgaatttgaatattttggaaatatatttgttagtaagttatttgtgtctgaattgatgaatagtttctaaatattatttttcatttaaatgagactcttgctatttttcttgcttatttgtaagaacgctttatataataaggatatcaacttatgctccatcacatatatgcagcatgtatgcatcagttttcctaatttaatgtttgcttttaattttaaaaaattgaaatagctgcaaacctacagaaaagttacaagtatattacaaagaacttcaccataacagattcccgaactccctaaatatttttatagctcatttgcttcatcaccctccatctcttattcctctgagccatttactgacaagacacttcatcacctttaaatactctagtgtatattttatcaaacattgacaatcttatatagccaacatataaccttccagttaagaatcaacattgacattacaatattatctaatctacagaccccattcaaacatcaccaactatctaaactctttcttcttggcccaggattctagccaagaacacatgttgcatttggttgtcatttaccagcatcttcaatctggagcagttccagttttttcctgtctctgatatcctctatggtcttagaagtataggcctctcattctgtagggcctcaccctgggtctgtccagtgtttacttgttactcatcttgtcaggaacccacagaaatgattatgattcttcttagtataccacatctggaggcacactatgtcaacctgtcctaccactggtgatattaaccttgctcaccgggtcaagttggtgagctgaaaagttcctcattattttttcctttggattttgattagtgttttatcagggagaaattcgaattttattccaatatcctgatcctcatcagaccttcacccacctgcctttacatcccttgaccatgcccacctgtattagatattattgcttcttagtgacatggataaaatgataaaattgaaaattgacacttgtttttactcttactcttattcatattctggtagtatcaacaacttgagaatatatatttatgtaaaagtgtattcctaaaaaatggtaacacaaactttttttacgtattatttccaatgcatatcagcattcaccatgtaagtcctatttaaattaaatgctatattttttcttactgaaatgtaattaggtatactgaatgaaattcagggaaaataacatcttattcccataaagatgatttgcctggcttttctacctttctcttgatagctttatatacagtattgcacgtattgaactgatatatcacatacgtttatgaaaacacgatcagcgtatatatatgatatattagaggtatattttgctaaaaggcatttacattcatcctgatatgactcttctgtttatggcttttcaaattttttatttcattaagttattgataagcaataagtgaaatggagccttgttttttcaatatttatagttggttaaaatgtatgttttattcatttaaaaataaacctcatgttttccactagccagtaactgaaataaatacacgacagaatcttttcaacctccagtttatcaggattcaagatctgttgcaggagttttgctcaatcacattaagaaaaattgtgcttacttttaaactctccatttctaagtggattcaataatgtagagtaatacgaactgataaatatgaaaacggtacaaacatgccttgtgatgtaaaataaagattgggcagaagtacaggagttctagatatgaaaagggaaggctttatactatcgtggagcatgttgattcaagaaaatgacaaagtgatgagaagttccttgagtacctggactttgtctctttttttttctgtatcctctgtgcctggtgcagcacatctcgtatagatggctaataaatatttgccaactaaatgactgaatgagaagtacagagcatctgctgatatcaggtcttgtggtagctggctgacttcttaggtgcatggaagtgttttcccttcattgcaagggttaacactttcagcgcctaccctgtgtcaggcagttccctaaattccttatatggattaatctcattaaatgctcactgcaatcttggaggtaggtaccattattattcctatcttacagacaaggaaatgggaccctgagagatgtaggctcatgtccgatgttacaataagtgacagaatcaacatttgaaccaggctacttggcgtcacagcccatcgtcctaactattatcctgacaaattctcaactgcttgttttagagcagcaccatgagctttctacttccttcagagctcaaaaactctaatgaccagatagcactattgttctatagtggtttgaagataataataataatcatgtatttttctctgttgggcatttttatttatactaacagtaaaaactggctaaaaagccagaaatctttcacacaatttacttctttatttcagcagcatcacatgacctactgaaaagttgaggcaatgtaaataaatcatggtctacattattgggtaactattttgtcttttaatttttcaaactgcctctccataaaaagttaatggcaaaacttgaaagtaagatttctagcattttggcgtttctataatagctacaatttagggcaaggttggttctgtttcctctagttagggatgttctgtaaccatttcagttgggaactcctgaggtaatatgctcactacaatcaaaatgtcgcctcagtgggtggcctatgaatcctgttgccttcttccttggctcttatttatactgaacaacaggggaggcatgatgacccatgaagcatgtcagaaaacagatgatgcagtgttgacagcttactctgtcccgtgtgactttgttctctctttcaaatacagtctgcctagaacttctagctgtcttccatgcatcaatgcttttcctttattgctgcccatagtttcagaatatgttacctataaagctgttgaaaattcctacacaggccaggctttattggcctaaagaatttctattgatttttagcatcttaggacagcaaattgttaacgtaagagaaaggttggaagccaaatgaaatactgcatagaatcataggacattcaggggctttgagagtcacttactcactccagatggacatatccgtaaaagtatcatggatcatttttaggtgaagatgaagatgaaaagctaccattttgggaatattactttcttcctaaaaattctttgttctttgaaagcgtgcaattgcagtcatcccttcataggcttgtaaaaccacttaggcatctggaaattgaagagaagattagtgtattctcttggggactctctctctctctcgtctcaattcacaatagtatttaatttatgtataggttggattttaagatatcgccaaattcctccctttaacttcaggcagagctgacttaaacctctctaacagataaaactatatccagaaaagatgaattttatttttttcacaaaattaagagattgacttgagtatccaaattcagaactaaaatgtgcttatttaccatattttaaagtaaaattaagtacatagtagtgtcttatatgccaaatgactaagtaattaatgattcctcaataagcgtgttattcctttgtggaattaatgtgtctgtatatttctatatcttttcatatcagagtgaatgcattctgaggatttggtgattaaatacgattaaattcaatttctatatttttgaactctacttgaccactaatatctaagacagatggtttcacaggtccagggatcactttattccacttcctctctgtagataagtagaataatgtttaaacataatgtagaaagaaattgatattttatttgagcctctacaaataactcttgggtaggagtttcatctttcaattaaagtagggtgacaccccagttaataaatgccttggaataaaatgtgtttcataacttagctatattaaatacatcaccccccctacacacctgaaaacccttcagaataggaccactagtacttatatttaaatgaacaaactcttaatttttctctctaatatactgatctgtattctgtggaaaaattatgaccatttcggacattagaagaatataatatattataaagtggtagtaagatggaagagttttggaaagaaggaaagagtgcagttgacccttctcaacctaccatacttcagtgaacaccaacttggagaattagtgaagggttatacttctttatttttttcaaatatcattaacatcctttgagttgcagcagggactagaggcagaaccggtttgcagctgccatcaagattggagtataatgaatctgatctccaaactgatgccttgagttttcaggaagtgggatcttactgtattgcacaaaggtcatacgcataggtgataaataagaagtggaaatcgggccgggcacggtgtctcacacctgtagtcccagcactttgggaggccaagatgggtggaacacgaggtcaggagatcaagaccgtcctggctaacatggcgaaaccccatctctactaaaaatataaaaaattagccaggcatggtggcacgcatctgtagtcctagctactcgggaggctgaggcaagagaatcacttgaacccgggaggcagaggttgcagtgagccaagatcctgccactgaactccagcctgggtgacagagcaagactctgtctcaaaaaaaaaaaaaaaaaaaaaaaaaaaaaagtggaaatcatttgcaaagttcttttttcccctatatgaatagccaactgatccctcacagttttttaaacagctgtttttttctctatgcattaaaatgcctttgctataatcaggcgaccctatttgtgtgaacctgtttctaaactatctatacagctccattagtctacttttttattcatgtgccattgttacacaatttaattactatacctttttaaaaattttagatgtggtagcataagttctccaaattttgcttttttcaagattatgttagatatatgtacttgtatttttcacatttctttataattctagaatcagcttaaattttgtttggaatttcattaaatctatacataaatttgaaggatgacttacatatttacaatagagaacattaatttctttcagtattgtttcatagcattctgtagagttgttgcatattttctgttaaattaattcctggatatttgatattttgatgtcattttaattgccattatttgaaattttattttctatttgttagtaatacagttgaatcttgcacattgatattttatccagtgagcctgttaaattcatttgttaattctatagtttatttgtagaatattttgctttttctatgcacatagtcatgttgtccaccaataaaaatagtgatatttatttcaaattcttataccttatagatttgaaaatttagatgtagtgaatgattttctatgaaatcacatattagaatcccaactcaaaaacagtacagaaaatctgagggaatgcttttattccatcattccatctaggatggaatgattttattccatcattccatctaggatggaatgcttttattccatcattccatctaggatggaatgcttttattccatcattccatctaggatggaatgcttttattccatcattccatctaggatggaatgattttattccatctaggatggaatgattttattccatcattccatctaggatggaatggttttattccatcattccatctaggatggaatggttttattccatcattccatctaggatggaatggttttattccatcattccatctaggatggaattcctagatggaatgatggaataaaaatttgtcaaagaattggattttttcatcctttcatcctgaagtcattagaccttaactttatttttttaatgttgagtttttcagaccttcaaggagcgatacttaatgataccttcaaggagcgataccattaatgattttaattttcttcctcatccttttatgtattttctgtaattttgtctaattgcaacctattattttatatcagaaaaattatatatttatgtatatacacaactggccaagttgtcaggtcttttgcaactagccataagccttcactctttctgcttttatttcctattattcagaaatacttaacgaagcccatgaatggactttgtagaatctatgaaacccttgtaaaatttgtgagccagccaaattttttgcacatctgctatgtgcattttcagatcattaaagcagactatattccccagtgggtccccaaccttacaacagtatgcttttatgatatgaccatccttgatgcaatagggaaggctcatgttccttgagcctgccacttctctgaaccctttctctccatgtctttctctaatttctacctgtttggtttcagtcacaactgagttgagataatgagaaagctaagcattaagcagatactaccctttatccaatggcttgttttaactccctaactcttttggctacccctaccgcacttattatcagtgctttattataccctttccttctttttttaatacctgttcttaatattcacataggaccttttgaaaatcgatgttttaaaaatatatgcaatgccacttaattcttatctccagaatcatagctccaagtgctctttcttaggatttgtttgtgttttgctggcctcatcattaagaataataaattacctgtaatttacaagtggtcattttttccttgtattttatattaagctcagttatgtagggtaataagataggttgttattcaagccatcatgttggatgctagggcttcaattatgaattaattcaatttgctactgatcttatctcttggtgatacaattttggctcctagctatattattcatgaaaaagttttgttatcctcaatgatttggctgcattccttttcttgtaacaaaacttttgtagtagtgttattattagttttgaaacagctaaacctaattttcacttaataatgtgtttattactgagggtctttaagctacagagttgtttggccttgtttattgacagattctcagtaccatagtaaatatttgttggaataattaaactaaaaagttattattaagaaacctcttttctttagggcttaatgtaagaaaaattatttaaaattaaaaacaaaatggtctgtgtcaggaagttctgattgttggtcactggatatattcaaactagataatcatgttgacaggaatatcatagatgagatttaagcaccattagttcagtagattcttgttaaaacactttctgtccatgaaattcatacttagttaagttaaaacccatcctgaaattttgctgatattttaatagaatgtataattgtatcataggaaatgcaagtcataataatgacatatggagtgcttactctttactaagaattgtgcaaagtaagcacttacaacttttagttcatttaattgttaaaataatcagaaatttacaactcttattatcctctttggatggggaggggggaaactgaggcttagagagaatttttaacttgcctgttatcacagttagtaaactgtggggacaggattaagagactctgagtcctcttaaattgctgcattatactgtcttccgaatgaacaaataccattagaataaatgaattaacaaaaatatcagaaaagatatttctaataagggatgctagaaaatgcacccttttctacttgctctcccatctcccttaacatgtgagggaatcactggaagtggcaagatgaaacagccaattttctataataaatgaggaaagccacctaactcacaataattttggctctaccactgtagttcactctttatatttcattatactagagtccccgcataccagtgatatccactagttggattaatccactagagtggattaatctgtttttgccttgtttatttcctggcttctgcattcttgcacttaaaaaacatattcaaattgctcgttattcacagaatcagccttaagaatctggaccttataaatgatgccaaattgggattattgaccaataataaaaatagttaccatttactgagtgcttgctatgtttcaggcatcttgcttagtgtggattatcacattgaatccttcttgaacaggtgaggaaactgaagcattgagaggttagatgatctacctaggtcacaggtagtagtgagaggctgagctgtattttcaattccaaagcctgtgcatgtaactactttgcaattgtaccatccataagctacactgataatatatatttggcactagaagtacatatggcttttctttaggtgactaatttgtatctgggctgtagcttaatgtactgagatggtctgatcattttcctatttaggcttaatttaaggcagcagaaaaaattctcatttcatgttgtgtgcaacctttttgtcatatgagacatgaccctatttttatcctttgatcttgagtgatgaaggaggttgttaaaatgaatgatgccctgccaccgttgcctatttctcggaaacctaatcttaagttagtttatgtttctgccaatgcaaaggatatttgactaacaagggcataaattactataaaaggttaactttatttctgattccagctaactctcaaaattctaacaaatcagggagacaagatatgttcaagtgtgacaaattatgttcctgggatttataatgtgattttcaatttagggtagtaaatgctcattaatgacagaagggaaaataaaggataataaaaataaggttaaaaattactcatagttctatcactcaaacaattgtgtttaaaatgttggtacattttattccaattatgtattttcccggtagtcataattttaatgtgttggttagaactcttggttgaaaggtgatctggggaggttgcagatgggagggcagtttacagaactaatgggaggctgtgatgccagaattagagctaggaaataacgagaagtaccctgatgggtcagcaaacaggaagcaaaatgcacagtgaccttagcataactgaccggggtgctgttgctgccagcacaaggaggtactacctgctcctcccttccttgctgcgctgcatcagattctgtctcaggaaagcgtgtttgttggaagagtgtgtcatggtcttgcctccaattgtaccaagagaagacagagggaagacatgagccctttcctttttgaaatggaaatgatagctgacatctactacttttcctgagtattttgtatgtactgagtattgttctgagtgctttcttaagtcagctcattcaaatcctcacaaaaatccaatgaggcaagtactatcatacagtggattaaccagatgaaacacataggggtgaagtagcttactattactaggaggggtgcctgaatgtgaacccagtgatctggctttagggttagatgttcaaccatcctgctgtgccgagccttggtagggaggcaggaaggggacaacggggggagccagggctgtgtcctactgagactccatccagtggggaacagtggatttcctgaagtgaatatgactgtttttagaaaaatgattgatcaaagtatgcccagtgttcattataaaaacttacaactatacaattatcatattttcaggtagtttcctgtattcatacgattttgtgcattttaatggtgactgattttgaagacattctgtttcaaaaatatcagaattgaattatggattgattccttttgacatatcttcctttctattaatgatagctaatgttattgagtactaaccatgtgtcaggtacacgtcttttatatcattacttatttttctcttcacaagtttttgatggattacttatctattttaaaaaacctgagtgaattatgctaatgaaaatttaacttttgctgaagtaatttaactccttaatggctgttattgtttgtagggtgttgtatcaccatcactgttactaaaggctacttttagtggcttaggtttaggaattcaatacaggtgttatttctaataatttctaaaagtggggacatgatagcaacaattgggttcttgcctcattatgttgagaactgacaggtatttagcaatgggatgatgcgtttgctgatgttattgtttaaaaatgcaaatacactttattattatagaactcattagttgaattgattaaataatgaatacttgttgttaaacaagaagataaaagggactctctggctggtgtcttttggataaaaaaagcaaacaagttggtattttattcattctttgtagtttctaaataatttatattctcgacaggtggtttacctttttcttttttatcttaaaatatcaatttacttcatacatatgttatatatgtacggacacacacatacacatacagagttttgttaaacaaaatgtgattatacacagcctttttgtttacttaatagtacactatggtattgtttcatgtcagagcctcattcttttgcagagtggcatagtgttctagaatatggatgtattacattttctatatgaatgaataattggaattttatcagtttttcactattttaaataaatctgtgagcaccttctacatatgtcattgccaatttgtgctattatttgagtaggacagatttttagattcggaatcgctcatttaaagagtatgcacatttaaggtgttggtagtttcaccaagctgccttttaaaaaagctcttgtcaatttatgttgctgcaaatcatgtatcagagtgcatatttccccacattatgattgacactgcatattattaatctgcttaatttttgctaatctgattggcagatctatacgtcaataagaaaaatccatctagttgatttttcttattgacttataggtgcacttcatatattgtggatattaacctctgatgtattatgcattttattttgtcttatagaatgtcattggttgtttatttatggtgtcttttccattgaaaaagatttaatttttatatagttaaaatgtaaagttaatctgtgttttgctttatggcttcttttttattccagtttcttttctctttcaattttggctaatttcccttttttacaagattatccgcagcagcatacaagcacgtatagtatttctcaccagtaaaaatgaagaaaaaatctcttgacatgtctctcagcatttaccttcccatttctttcaaagtgtctccatttattgtctgtttcttctctttgccattctctcttgaaccttcttcaagccagctttctcccctaaaaagttttctgaaatagctttagggtcccctaaaaagttttctgaaatagcataatctctgaattttgctaaatccagagattaattcttcatcttacttaacctgtcaatggcgtttgatacagttgatcactccctcttttttgaggcaccatcctcgtcacgaggcttttgagacaccactctcacttttttcttctctagtctccctggccacactggtttcctttgctgtgcctcaaaatgtcaaagtgcctttttttttttgtctgtaataattccctagggaatccctatgctttcctggctttcagtgtggtctatatgcctgttacccccatattcccatgcccatatggacctctgttcacctcagacttataaatctagctgtcctttctatatgtcctcttgaatgttcattaggtaccttaaatataacatatctacatttaaatacttgatttaccttatctaaacttactcttcttatagtctccatctcaatcagtggcacctcttgtcttctatttgctcaagtacaaaacattagagtcaaaagctccagctccactatttttttttagttttgtttttcaaaactccatatcagcaaattctatcagctctattttccaaatatatgccaaattaaaccacttcccaccaatctaccactactactgtggtccaagacaccatcacgtctcctatgaattattgcaggagctctataccgagcagtatacactgtactctatttatagtcttttatgcctcagccccctcctaggcttccccccaagttcccaaagtccattgtattattcttatgcctttgtgtccttatggcttatctcccacatatcagtgagaacataggatgtctggttttccattcctgagttacttcacttagaataatagtctccaatctcatccaggtcactgcaaatgccattaattcattcctttttatggctgagtagtattccatcatatatatatatatatatatatatatatatatatatatatatatgatggaatactatatatgtgtgtgtgtgtgtgtatgtgtgtgcgtgtgtatatatatatatacatatatatatacatatatatatacatatatatatatatgtatatatatatatatacttgaactttcttcttggtgtctatctcctttcttaggtcattagtaattgttttataaatttgggagctccagtgttaggtgcatatatgttcaggattgtgatattttccttttggacaaggccttttaccattatataatgtccctttttgtctcttaactgctgttgctttaaagtttgttttttctgatagaagaatagctacccttgctggctttttgtgtccatttgcatgaaatgcctttttccatgcctttacttgaagtttatgtgagtccttatgtcttagatgagtctcctgaaggcagcagagagttggttggtgagttcttatccattctacggttctgtatctcttatgtggagcatttaggccatttacattcaatgttagtattgaaatgtgaggtgccgttgcattcatcatgttctttgttgcgtgtgtactttggctttttttgttgttgttgttgttattttgtttttgctttttacgttgtatttttgttttataggtcctctgtgatttatgctttaaagaggttctgttttgatgtgtttccagtatttgtttcaaaatttagagctccttttagcagtacttgtaatgttggcttggtagtgatgaattctctcagcatttcttggtctcaaaaacactgtatctttccttcatgtatgatgcttagtttcaccagatacaaaattcttggctgataattgttttgtttgaggaggctgaagatagggtcccaatcccttctaccttgtagagtttctgctgagaaatttgctgttaatctgataggttttcctttataggttacctggtgcttttgtttcacagctcttaagattctttccttcatcttaactttagataacctgatgataatgtgcctaggcgatgatctttttatgatgaatttcccaggtgttctttgagctttttgtatttggatgtctaggtctccagcaaggccagggaagttttcctcaattattcccccaaatatgttttccaagcttttagaattatcttcttcctcaagaacaccaactattcttaggtttggtcatttaacataatcccagacttcttggaggctttgttcatattttctcattcttctttctttgtctttgttggattgggttaattcgaagaccttgtctttgagctctgaatttctttcttctacttgttcagttctattgctgagactttccaaagcactttgcatttctataaatgcatccagtgtttcctgaagttttgattgttttttctttatgctatctatttccttgactatttctcccttcacttcttatatctttttttggatttccttgcattgggctttgtctttctctggtgtctccctgattagcttaataactaaccacctgaattctttttcaggtaaatcagggatttcttcttggtttggatccattgctggtgaactagtatgatttttggggggtgttaaagagccctattttctcatgttaccagagctggttttctggtgccttctcatttgggtaggttctgtcagagggaaggtctagggctgaatcctgctgttcagattctttttcccacagggtattcctttgatgtaatactctaccccttttcctatagatgtgtcttcctgtgaagctgcagtgattgttatctcttctgggtctagccacccagcaagtctacccagctctgagctggtactggtactggggattgtctgcacagagtcctgtgatgtgaatcgtctatgggtctctcagctgtggataccagcacttattctggtggaggtggcagtgaggattcttagctttggtggtttaatgctctatttttgtgctggttggactcctgctgggaggtggcactttccagagagcatcagctgtggtagtacccagcagtgggcaggaccctagaactcccaagagtatatgtcctttgtcttcagctaccagggtgagtagggaaggaccatcaggtgggggcagggctaggcatgtctgagctcagactctccttgggcaggttgctgtgggggttgggggtgaggttcccacgtcaatggagttgtgaacctaggaggattatggctgcctctgctgagtcatgaaggttgttagggaagtgggggaaagctggcagtcacaggcctcaccgaactgccatgcaattcaaaggggcggtcttactccccctgtgccctgccccaacagccccgagtctgtttccaggtggtgggtgagctagacttaagaacttgctccaggctacccacctcccagctgcaaaagaacagagctttggttctttccccacctatggagtctgcacaccagatttgtgccttcccccaagttctggccaggaggcttctcgcccagcttaaattgttacaaagttcagctggagatttccttctgcctttgacatcttcccccatgcctctgggcaccctcccaaaggatccctgtggtgctaggcaggaatggcctgcttggagactcagtgagctcccagggcctttccctctgcttcctctacgcttgtatttgactaggctctctagattgactcagctctaggtaagtttggaaacttctccctcaaacagacgttcagtttccccagtgtgggtgtgtgtttgggagaagaggatctcccttttccatttccacagttggagcactcagtgtttggagtgtctccggtgtcctgcaggagcaatctgcttccttcagagggtccgtggggtgggtcctttcagaattcctggtttattcttgcagtcgatctggagctaaaattcatcatgcaagcctccacacactgctctgtctatccgagttggagctgcaatctagtcctgcctcccatcgccataatgataccattctccccacgttcttttttttaattgctgagttttgagagttcttttatattctagatagtagtcctttgtcagatatttgatttgtaaatattttcttccaaactgtagcatgtcttttcatcttttcacagggtcttaaaatgcacaaaagtttccctttctgatggtgtccagttttcaatttttaccttttatggatagtgcttttggtgtcaactctaagaactcattgtgtagacttaaatccctaacattttatcctttttttatcctaacagtcttacattttagattttatatttaagtttgtgatccatgttgagataatttttgcatgaagtgtgagactgaagttaaaatttttttttttcccttaacatttggatgttcagttgcttcagcaccatttgttgaaaaagctatatttttctccattggattacctttgctcttttgtaaaaaaatcagttggtcatatttgtgtgggtatattcttgattctctgtccatatgagatatgtgactatccctctgcccatactacacagtattgattactgtactgtataaagtctttgaattgggtagattgattctttctactttattccttcttcaaaactatttcagctattctgatttgaatagcctaaatgtccttccatataaattttaatgtaaatttttttgcctttccgtataaattttaggataatgttgtctacagctaaattttttgccattatttttataggaattatattaaacatttatatcacactggggagaattgacttctttactgtattgagtcttccaatttatgcatatggtatatttattcataatttagatctttgatttctttcatcagtgttatgttgttttcagtatataatacctgtttgtgttttgttagatttacacctaagtagttttaaattttctgtgtaattgtaaattatattgtatttttaattttggtatccatgtatttttgctagcttgtagaaatataattatttttatatgtcatattgtatcctatgaccctgccaaattaacttattagttctgatagtttttttttatactttaaattctgggatacatatgcagaacatgcaggtttgttacataggtatacatgtgccatggttgtttactgcacccatcaacccatcatctaggttttaagccccgcatgcattaggtatttgtcctaatgctctccctcatcttgcccccaccccatgacaggccccggtacgtgatgttctcctctctgtgtccatgtgttctcattgttcaactcccacttatgagtgagacaatgcagtgtttggttttctcttcctgtgttagtttgctgggaatgatggtttccagcttcatccatgtccctgcaaaggacaagaactcatccttttttatggctgcatagtaatccgtggtgtatatatgccacattttctttatccagtctatcattgatgggcatttgggttggttccaagtctttgctattgtaaatagtgctgcagaaaacatacatgtacatgtgtctttatagtagaatgctttataatcctttgggtatataaccagtaatgggattgctgtgtcaaaaggtatttctggttctagatccttgaggaattgccacactgtcttccacaaaggttgcactaatttatattcccatcaacaatgtaaaatcattcctatttctccacatcccctccagaatctgttgtttcctgactttttaatgatcgccattctaactggcatgagatggtttctcattgtggttttcattttcatttttctaatgaccagtaatatgaactttttttcatgtgtttgttggctgcataaatgtcttcttttgaaaagtgtctgttagtctttgcccactttttgatggggctgtttgttttttttcttgtaaatttatttaatgtccttccagattctggatattagccctttgtcagatggatagaatgccaaaattttctcccattctgtaggttgcctattcactctgatgatagtttctttggctgtgcagaaggtctttagtttaattagattccatttgtcaactgtgcttttgttgccattgcttttggtgttttagtcatgaagtctttgcccgtgcctatgtcctgaatggttttgcctaggttttcttctagggtttttatggttttgggttttacatttatgtctttaatccattgtgagttaatttttgcataaggtgtaaggaagggatccagtttcagttttctgcctatggctagccagtttttccagcaccatttattaaatagggaatcctttccctattgcttgtttttgtcaggtttgtcaaagattagatggttgtagatgtgtggtgttatttctgaggcctctgttctgtttcactggactatatatctgttttggtaccagtaccatgctgttttggttactgtagcctgtagtatagtttgaagtcaggtggcatgatgcctccagctttgttctttttgcttaagattgtcttgtccatatgggctcttttttgtttccatatgaaatttaaagtagtttttttctaattctgtgaaggaaagtcaatggtagcttgatggggatagcactgaatctatacattactttgggcagtatggccattttcatgatattgattcttcctatccatgagcatgaatgtttttccgtttgtttgtgtcctctcttatttccagcattggtttgtagttcttcttgaagaggtccttcgcatcccttgtaagttgtattcctaggtattttattctctttgtagcaattgtgaatggaagttcactcatgatttggctctgtgtttctctgttattggtgtataggaatgcttgtgatctttgcacattgattttgtattctgagactttactgaagatgcttatcagcttaaggagttttggggccaagatgatggggttttctaaatatacaatcatgtcatctgcaaacaaaacaatttgccttcctttcttcctatttgaatacactttatttcttcctcttgcctgattgccttggccagaacttccaatacggtgttgaataagagttgtgagagagggcatccttgtcttgtgccggttttcaaagggaatgcttccagcttttgcccattcaatatgatgttggctatgggtttgtcataaatagttcttattattttgagatacgttccatccatacctagtttattgagtgtttttagcatgaaggggtgttgaattttatcgaagcccttttctgcatctattgagataatcatatgtttttttgtcactggttctgtttatgtgatggattccatttattgatatgcatatgttgaaccagccttgcatcgcagggatgaagccgacttgatcgtggtggataagcttttggatgtgctgctggatttggtttgtcagtattttattgaggattttcacatggatgttgatcagggatattggcctgaaattttctttttttattgtgtctctgccaggttttggcattaggatgatgctggcctcataaaatgagttagggaggagtccttcttttccttttgtttggaacagtttcagaaggaatggtaccaactcctctagatttattgagattttctatgtaggctatcatataatctgccaagattgactttctaacttcttcctttctattctgtattctttttcttttctttcctttcttttccttttcctttttcttttcttttctcttcttattgcactgaccagagctttcagcactatgttgaataagaatggtgggaacgagaggtttgccttgttctgatgttagagagaaagcatctggtctttcaccattgagtatgatgttaactgtagtttatttatagttgctttttattaggttgagacagttctcctctgttcttacttttctgagagtttcatctttaattggtgctgaattttgtcaaatgctttttctgcataagtcaatatgataaaataattttcattcctttgttagtcagtataatggattgattttcaaatattgaaccagactggcatccctggaataaaccccacttgattatggtatatcattgtttttatatattgctgaattatatttgttaacattttgttaacagtttttatgtatatactcagggagcatattgtctttggttttacttttttgtactatctttatctgttttttggtgtcagggcaatataaatacataaaatgaatttagtagtttttctctctgttactttctggaagcgattgtgtagaattcatatgacttcttttattacgtgagaaaattctgcaatgaaacttctgggcctggagatttaattttttggagttttaaatttatgaattcacttttcttaaaaattatagaagtatacaagtaatctgtttcatattctgtaagttgtgtttttgaattagttcattttgtgtcatttgtcaaactttttgtctagagtttagtattcccatattaacctttcaatatctgcagggtctgtaatgaaatctcctgtttatctcttaatattgatatcttttctcttttttcttcgttagttcattaattttattgaactgttcaaagaaccagcttgtggttcattgatttttttcaatttttttaaattgtattgatttctgctctttattaattccttacttctacttgatttgtgtttattttgcccttccttttctttgctcttgaggtgggagcttattgatttgggacttatcttcttttctaatatatgcatttagtgctataaatttctctctcaagtattgctttacctgtttttttggcaatttttgatatttaattttaattttaatttattttatgtatttttaaaaatttccctgagccttcctctttgacctgtggattatttagaaatatatttagcttgaaaacatttggagattgtctggttattgattttcagtgtgattctgttgtggttggaaagcatactctaagtgatttaaattttttaaaatgttgttttgttgaggtttattttatggctcaagatatggtctgccttggtatatatcccttgggaacttgaagggaatgtgtattctgttgttgttgagtggtatgttctataagtgttgagtggatcctgttggttgatggtatttttgagttatatattcttgacattttggctagttgttcaaataattgttgaaacaggggtgttgacgtctgcaactgtaattgtggattttaccatgtattctttcaattctatcagtttttgcttcacatattttgcagctctgtgttttcggtaatacacattgagaattgctatgtcttcttaatggattgatttttttcatcatttttatagcatttctgtttgtctttggtattttttggctctgaaatatatttttctgaaattaatatagccatttctgctttcctttgattaatagtttcaatatatattattttctatttgtttactttcaaactgcctagactgttatatttgaagtgagtttcttaccaacagaatatggtcatggtttttaatcccttctgctaatctctttcttttaattgatgcatgtaaactatttacttttaataaaattatatgcttgagtttaagtctgccactttattttttattttatgtttgttctctctgttttatttttctgttttttttcttaccatgggttacttgttttacaatttcattttatctgtatgtttatgagtgtgtctctttgtatagctttgtaagtggttgctgtaggtattccattatatatacataacttataactgattgttcgtatagtcattttaccagtttgagtgatgtatagaaattttagctgtctttatgtttctttaccctcactcatttataacataaattctttaaatattgtttaacatacatttaggacacagactcttttgcttcaattttgagctgttgcttcagttgtcaaacatactttagaaaagaggagaaggaaagcttattgtatttacccatttttcttttttacatactatgttctttctaccttcctgatgttccaaagctttttattttatatttttctttctgtttagaggtcattattttgctgttcttttaaaataggtcttctcatgataaattctcttagttttcctttatctgagaatgtcttgatttctcttcattcctgaaggatgtttttgctgggtatacaattctacgtgtacagctctttttgcttttgtcacatgaaaaatattttaccacttctttatggctcccatggtttctactgagaaacacactgtcactctaatttttccttgtacttaatgtgcaagattttctctgtctactttcaaattttttctttgtttttagttttcagaagattaattatgatatggcttgatatgaagttgaaaattgttttgagtttatcttgtttagggtttccttagattcttgaatctgtgagtttatatctcttgccaaatttgggaggtgttcagccattatttcttcaatattgttttttaagctcgcctcctttctcctctctttctcggatgctagtgatacaaatgttagatcttttgttataatctcacagctctttaagactgttcaacttttttttcagtctatcttctatttgtcacattggatgcttttttttctgtcttccagataactgattcttttcacagtcacttccattctgctgtttagctttatccactgagctttcatttccattattgtatttttttggttctgaagtttctatttggttttaaattttttttcccatttttctttttctttattgaaactttctatttttttcatttaagtcttttcataattgtttttgtcagtgctgctgtaaaatatttgttgggtaattctaacatccttatcattttagtcttgatatctgttctttttctttttacaatctgttggagatttctttgcttcttggtataatgaatgattttttactgaaacctggacatgtttgtatcatgttctgagacttgaatcttatttaacccgcctgttttagccagctttctctgacactgctttgtcaggggaagggagggtgccatcttgttactgccaggtggaggtagaagtctagattccccacttgcctttgttgacagttgagggggaagcttcttttatttctgagttgggggaagtttcagcttcctatatggtttctgctggcactgtggcggggtggtttcattactgctggatgactataaaactcctgactccttagtaggcttcctttgatactatcccagcggggaaagggaagtgtgcttcattacttccaagatgagatggaagtccaggctcctcattgtatggtcttcactagtgctgtggggggcctcattactgcctgggagggttaaaattcttggctctaaacttggccttctctgacactattctggtgttacatgcctcatttctgcttgaacagggtagaaatataagcttcttacttagcttttgtttggcatggtttgggatggggccagttttttctgtgatgtttgactggaacagagagattattatctagcagtttctgtcttgctagactgatcctttctttgttcttcagctagagaaagcaggctcatcttgaggattttttaggtctacattcattgatatttccagattgaagccttctttagctccaagtccaggatatatgacacaaaatggaaacccattgaactcactaccatattgttccttggatcctgaatatctttttttctctatcttctagattcttctgtgtttgttttgtatatgatgtctagttgtacttagtgggagaactaggaaaagtacatctattccatcccgtagacagagatcacttcaatcgtttttgaactttatttttaatgtgtcccatgtggctcttctctctgcaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataagtaagtgtagtgtcctcattttaggaaatggaagattctaagaaatgactgtctactcacgttccttctttgatgtttcttttttgcagaatttatgaaagggtagtagaaaagccctccacagacttgcctctaggcacaacattttggctaggacagagaaataatgcgcatggatattttaaggtatcttttggcaaaagtctgagaatgaaatgtaaatgctttctaatgagtttcaaaaagtagattttactttttatggtgtgaaacaaaataatttgatttgtaaattagaaaatttgtgtctgtttcatttttttaaacagtaatattttagccagcaaacattattttctcttcttttttcaatgagtttaattgttagatattacagaaatgatcacaaggctgcaatcagggcagttaacaggtcattctttgaattaacctttcaaagcaataaaaatctaaaatgttaacatacaaataaactctccaccactgaaatataacctttgatgatacttttacaaagatgttaatagcggattgaaagctttttagtatatattattcatggtctccttgtactgcagaaagtgagaaaggaatacacatatgtgcacaaatctgtcaaaagagaaagcagttataatttatatcttttcctttaatatgtacttggagacaacacttcatagaatttcttcattggagaggctctaagggacatgtcatttaactttccatattttaaagatgaagaaataaagtccagagaattgcttgactacaagcccatagtgcaatcattttcccccagtggctatgacagtccctacaacatggaagtggctcgatgaatgattaccaaatcaaacaatgataagtgatagttcaactcatagatttcaaggtagatcacataccagtgaatttaattgttttctaagcaaagtttataattctataaaggtgttttgggaacttatttaagcattgcctgttaccaggaaaccagatacttgaaatatatgattccatctaatagtagccttgctagtcttgatgcagggtcattttttatttctgttttattatgcataaacctgcacagaggggtaaagtaacttgcttaaagataggcaaatagtaagtgacacaaataggaaattggttccatgcttgcaaatcctaaaaccatgcgcttttcccaggtaagggatagcagatgtgtgctgtgagtcccaaatctcatctctatttaatcgtgacagtccttcccatggagcctaagtgtggcctcaaaatctccacatgtcaattatgtgtacaactctgggggtcattctctttattgtagtccataaatagtatccattagagttgtacagtgcataaactatataaccgtacacgatagccttgtttttatgttgctgcttctaagtgataggagttggtacacaatttatttcatcaatctaggcccaagcacacactggatccagtaatacccacacagtaaaaatacttaaatatttatcgttcacattgatacatgctattaatcagattaaacatgtacaagacatagagaccagtatttgactggtaaatctttataggtacgtttaaaattatattgatgtcatgttggtacagttattcctatcattagatattttgtttgcatttttcaaatggataaagtaaaatattaatttaataaaatatataaaggccatgaagaaatggggggagtgtggcagataaaagagacagctggatgtgtctgatagatcatttctgagccaccattggtctttgctttaggagcccagcaagctggaagctaattataccttaatgactaagtatgcatgtaaattttgcctataaacatgtgataaaattttctatgtaaaacaggtcatttccagctgacatttaaaaaattttcattttaaactttctgtactcataagaactcatcactatattttgctgtagctgtttaatgaatctattgtcctttttaaattgagaaattagttttaaaagatcccactttcatgagatgctcaaatgagcatgctttcatgactcagtttttctatccttttctttaataattaaagttaatttaaaattggtatcaatttcagagttgctgaagctagaaattattatcaggttgatttttttaaaggtcattttcaagcccgtcagtggctaactaaaaataacttctcaaaacaacataactattgcctcttagttatatcttgacatttaatcttaaggctttaaaaacattatcaataagagaatacatgggtaatcatctattgtgcctgatgaatttctttccctttggtatgaagtggaaataatgtattaacaaagactttttactcagggattttagtgagtgtgttctgtaatattttccttcatgaacttgaccattgaacataatttgggtaaatgaaagtaatatgtcttttttttctatttttcacacacagggtataatgcaagatgtccaattacttgtcatgccccagggatttattgctcagtgcccagatcttaatcgcagtaagtctattagttcttgcactgtggagtccccatatattacttgtcagcatagacttaaccagattgaaccccttataaatgcatcttgaccaaatgtagtgtttgtaattccagcctgtccaacttgcaatgacttccatggacttgtgcagaaaatcatggagctacaggatattttagccaaaacatcagccaaggtaaaagctactcaagaatacagtgtggaagcttaaaaatccttgatgttcccaatacttccatttataaccatagattttcaccttcgaggctcttcttatactatactgtttgctaggactgaatctaaatctctgcttaaggaaaggcttataaatattaaaaccctagccatctgtataacaaataattcagtaaatcaggaatgaggcagattacctaatttatacactgcttactacaggaggatttattgtttagcttttattattatttatttttattcagtttttcattacaagcaaggaggcagtaggacagtgtaaagaatatagacaccagaattgtatcaaagaaatggtcccataaatgctttctaccactatgttacagttctaggattatttactaatatcttaagcatatgtcaggtttacctacaatttcactagacttgtaattttgtatagtagttacagaatacctgatggttgtgttgtatggtgtatgatttgtttcttatacaacataaattctgaattttatttttttacttgaagaagcatataaatgaaattaaacatttttcttttaaatggaaagtgcttctctgcatttgagtgatgttttgaattaacctttgatttatgtcttataaattatgttgtttgtttctaaggcagggagcaaatttatcacaaaaagaagaggagagaaaaaaacattcttttaaattaaattaaagtcttaaatatgtttatggcaagtggttgataagcacagccatcatcattgctacatactttaaaaaaaagatacctgcggagtgtttcacatttctgtgttgctggaaggatgaacaatgtaaaacccgttcttttgtgccacagctgtctcgagctgaacagcgaatgaatagattggatcagtgctattgtgaaaggacttgcaccatgaagggaaccacctaccgagaatttgagtcctggatagacggctgtaagaactgcacatgcctggtatggcttctatttgagttgagactaagggaactcagatgctcccactctttaaaaatttattaaaacaatgtaatcatgaaaatttcaagacccatttcctcaagacacaacactaaagtgtcaacaaacctggtcatatctaaagaactgtgttgcattattaaaaacactttctagcttctaaagatgattatggtttaggaatgctataaagtttaagtttattggtacacacatgaagttagcaatttaaattaggtaaagtgattcctaaagaagactatcctcttatccttaacatttccagagatttttctcccttgtgttttcatgaatgcattttcatgaaactaagtcatatgcagcattaaatattgtgtccagattgagcaatataagcaaattagatagagtttaaatgattgggacaatctaatagtttattaatacagtggaatacaaattataaagtttaaataaatgtgattttgctaattgctcgctaatgaagtagaatattttattgcattatgatttcagaaatatatgttcattttcaaagaaaagttcaaagagtttggttttaaacttttaaattacacatgaactcatctgttaaagctggttttctggaaagaagtcagacatctatgtgaattaggcttttaaaaaaatttctcaaagttcatccagtttattcaaaaacagaatatcatgcatataaaaagatcaaaagtagttcagaactgtgtgtgtgtgtgtgcgtgcgcacgcacatgcatgtgtgtgtgcgtgcgtgcatgttcgtgtgcatgatacagtttttattcaggaacatgatatgttcctaaattttttaaatggggagcaaaggttaaattgagtagaagacggaatgtggtatagtgaagtcaataaaatgggaagcccgagcagccagctacctgggagctctggccacctttaggaatcaaattccttgcggtggtcctgtctccagtttggcgcctccttgtggtgattgtcagcaccgcctcccctcctggcaatgaatggcctgttctgttctcttcacatgaagagtttaaaatttaaggaatgaattcaaaaattcttgaaaactactaaactctaacatggaaattctttaaatattgtttccttttcagaatggaaccatccagtgtgaaactctaatctgcccaaatcctgactgcccacttaagtcggctcttgcgtatgtggatggcaaatgctgtaaggaatgcaaatgtgagcataacttttatgatgaatactttctttggaaaaataaagcactgtattaataagtattcacccatcattggtttaatctgggcaagctaaatagctttcagaagtgatggaataaaggaagaatactttctctgttttggttgattagttcttttccattttaaaatgctatgcccctattccagtaggacaattttttcttggagtaatctattccatatagtgatagtagtaggaaacatgtgtaagaaacttactggaagttatttcactaattgtactatttattgtaagtgtctcccaaataggttaagaatggttcacacggctgcaataaccaaagaaatccatgatacaagtggccttcagcagcagaagatatgctgttccattagcccaaacaacagaagtccacattattataggattgtccagtgtagataagggccatggccttcattcagggaaaaaaaggctcacaccaccatgtgtggaagcttttctgccttttagcagtcattatatagcagttcacttcggttgtcagaaaatactttttgactcatctgtaactacccttaactgggttctagatcgttcaataaataatggaaataatttatttatgtttcttatactttaaaagacttcacttaaacctttgttaaaaagagtgtttaaaaattttgctgttttttccacaaaggagtagtaacatacatgaaaactgagttgttttaaagtttgtggaatatatagagctctgtaaatgcaagtgtatttatatgtatactctcaaaaagacaaagtagggagaagtggcggcggggtggagagaaagacagtagcaatgtgctactgctggtgagggtgacaagctatcagagaaaaatcaagaagttgcttcatagtccgttgatttaattccctcaggaaggcatttatatttaattctattaggctttacattgaagccagtccgtctcataagactgtattagcctagtcaagtcgattcagtggaactaggaaggattgaatacaatttttcttacatgtcactagctaatttccttggtgagaaataatctgcatttttctaggacttctcttaataaaaggaggcttgtggcaatatatagttttgtttgtaggtggttagaaagaggaaggaagaaggaccatatatacatatatggcttcatattcataatacaatagcaaggaatcatactttttgccttaacttcttttttttttttcttgagacggagcctcgctctgtcgcccaggctggagtgcagtggcgtgatttccgctcactgcaagctccgccttccaggttcacgccattctcctgccgcagcctcctgagtagtcgggactacaggtgcctgccactacgccgggctaatttttttgtatttttagtagagacgggatttcaccctgttagccaggatggtctcgatctcctgacctcgtgatccgcccgcctcagcctcccaaagtgctgggattacaggcgtgagccaccgtgccctgccctgctttaacttcttttatctttctttacatccataattttatgttgttattcatggatatgacagatttgcattaagtgatgtcagtgttattagatacaggttgattgaaataacgggccattgtgagagattcgtcagaagtgaatttcaattctcatcttaccatttgcctgtgttaccaagagtaaactgcagactaaatcggactaatgcttgaattcttcccaataaacatgcggttagacataatgaaatgataaaatgttttgagattcattaatgaagagtgtttcaggcagtctttggtgttaatgattgaaaaccaactgtttgcttcatatagaaaatagttaaagctggaagtgagtgatcagtgagcagaccacaacataatgaaaaaaaaaagccataggccctcattagatatggctaaaaaataataagtattaagcgactttatctttctgttcacatttaatgatatataagtaccatggaatagagaggaatagagagggttcatgcttatgtttgcttgttatttcaaagatttgaaattttagttttaatgaatttaacattttactagagctagcaagacatttcagtaaacagccatagatatttccccttagggaaataagcatttagttcatatggtgaatattcttagcggttctttttgggaatgagtctctgcaaagcacaatttaaaaataagtcactgacaatatccagaaaatgtgcttctgaaaagtcttgtagaagacaaataacacttaaaataaatgtaatagtaatcctttgactgactgacttaaatagtacagattttcatatgtatttaaaaaaagtgggagaaaccaatagttacacatgtctatgatgtcttgtatgtgtgtttgtgcgtgtgtgtgtgtatcaccattgcatgtgaggagaaacagtcttattttcctatgttaattccacagtagtgtcactgttataatttatgaaaatctaattttagtggagtagaagtaaattcctatgttttttactcttttaaatataaatataagccctcttcttagaccctacattgatcctatctttgaaacgcttctgctcaactgcctttttaatgacaaaacctgataaaatagattattattgaaaacagcttaaagagattaatagcttactgtttctaaagcccttggaaggtaaagcgtataacctaactgctgaatgtgactctgccaagattgaaatgaacgaaacacgtgcatgtggccagtcactttttggtgctcttcctttaatgctttcaggcttgcttcatcggagttgtttgcgcatttctgggcagtcctattttgcagcttcctttatactttccctcggtaacttcaactccagctcgttatctgaatataaatactgatgaatagcaagatggttgttgttctgggaaagaagtcagaagaaaccaagccttttctttagttgaatctacataaacaaagcattgggaggaggggcttaatttcctgcctggaccattaaaatagtgtgctggagttaaacagagaggataaaatccaaaggcaggaatgccaaggccaaatcgttaaagccatagtaattacagccataatgaagccatatttctcctataggttacaagacacatactttgtgcctcatttgatctttacagctctataagtacgtattatctccatcttcctaataaggagaattccaagtcattcaggaacgtgcagttagttagaggtctcagagaagttccatctgaaagtgctgtgtttgacagcctgctttccttttttttttttaaaaaaaccatctgttataattaatctaagtgatctacttttatcgaccagttgctaagctcaccagaggtgttttggaatcctggttgagtcttaggcagcagagtttgccttcaccactcatcctctttcctttcagtcaccatctcctccacatcctttatcccggtctcaggctctcaactagcaaacagggacatttagtgacacatattcaagatagctgtagaaaatggaaagtataaatattttaggtgaccttaactctgaaatagaatgaggtcaagatatgattaaagtacataaaatctcaacccaggtttaaaaaaaaaattatcagaaaataattgactgaaattctaggaaatcaaatgttactgaaagtcactgaatttaggaaacaatttaatttttctgaatattaatgctattacatggatgcatgcctttatttatttatttatattgattgtagattcaggcttgtgtacagagctctgcttcacaggaaaggcggttcatgagaatagggaatctgaggcaaatctgaactgatgctgtaatgtctttcctccattgttagagagttctcaaatacagggaatgtgaatgtgaccatcagaactggttggtatttgcctagtagcaacagttagtttaagtggtatttcctcagagtccagaattatatgaataaatacaaatcatcattcttttggttgagcaaggtcagagtttcagtatataatatagattacactttaatattctatgtgctgattagacatcagattattttaaacttaattttaaaagccatcttggtttagttaaagtggacttactgtaatatctttgcatattgaatagttaattctgtgagttacaagtcggattttctgggtctgaattctgactccacaacttattagctgtgagactttggtcaaattgcttaacctctcatggactcagttgcctcatatgtataatggaaataacaattgtatctactttataggggctgtgtaagcactgaataggtaataaatgtaaagtgcttagaacaatgttaactgttattactgtttttattaaaagagtcactcatgtttttattgataaaaatacaaagtagtgaaatgatctcattagttcattagctttagattttaaagctacgtaggacctcaagagttctttgaaatagccatttgcttttgggaggtatggtttcattattcccattttatagaagaataatgaagccaggtagattgtgacattactaagatcaaatagtatgtaatgcacggtaatttttttctctcaaattgtgtcctgatttccccaagaccactctcttcctcaatattgtgggcgtatcttaatcaaggttgaaacccagaactaatatctcattattatgtactgttttgtgtgtctggcttcttgtactcagaatcacctttgtgaggctcatccatatttctgatgcgggtcaaaaatgtagctgcatctcattcatacttattgtatcattttgacgtccactgcagatcagttatacttattgctgcatatattttatttgtgtttatgtaccacaattcagtctattgttggatggcagttaggtagtttgccgatttgggctatgtgaatagtactcatagaataattctttacatgtttcttggtcttagttatgtatgtatttgatgggtatatatttaaaacagtggaattgtttggtcagagggtaaaactgtttgactctatggcaaaaccagttttccaaacagttttccaaagtgcttatactagtttattttctcaccaacaaggtaggaaaattccagttgccccacaccctcacccacacttggcatttttagtctttttaattttaacattctgataaatgatgttggtaaatgatattgtaccgcggcctaattttgttatttcccaggtgactaatgaagatgagtgcctttttgtatatttatgggctgctttcattaatattaaataataaaaagtaagagtaagtattttctatttatacttttccaaagaactattttcttgcttttagtagaagtggtaatttgggaggcttattttatttgcacatcaatatagatgattctagtcctgtcaccttaaaatgtgtagcaaagtaagggtagtggagattaaatgattgctgctcaagtacttagtgattttaaaaattggatgataatctgataaaatggaatcagagatttctgaacatgtgttcttgacttttcaacaaaaatcagcagaatataattcaccaataatttttttttgtttttaacagagggggaaaacataatttatgtaggctatggtgaaaaagaaaataattttgaaacaaagtaaccagtaaacatagctatttttacaataatgctggaagcatgggaaatatttaggatgtactggaggttctcatgcatgaacacaattataaattagttggtgtgatagagacacgaggggccacatgaatagaatgccaatataaaatgagaggaattatgtaataatgaaaaaggtagaagtagcaatcaaaagaaaggtgtgttgttttacgtatcagatgcgctgttttaagaatatttcttgaaagtctgtagtgaataaggaattttatgacacagcaaaaaattgagctgaaagctaatggtgtcactggaaatcacatatccagccttggtctggacggtcttttctcactaaaattactttaatttagtatttgaaataacattgaataaatcatagaattagaacacttttataattctataggtatatgtgacaaataggcaagaaaatagttcacttgtatattactttaagataatgagcttctgatagggaatgttttctctaaagacaaatagctaaatttttaaagagagatttcatcaagataatcctgtaggcttcctaaatactgtactgtcattaattttatcttaattaaaaaaaaaaccctttaaaaaggcacttggcatgctgctaccttttaaacattataaaaaatgatgtccaatcagtggaaaaataccgaattggcaatatattaataaactagaataattaacaatgcagccttcagattaaggctgtgagacagcatgtgatatattttaatgatctttagaaaaatataaatctactgttaattagtcagctcatagcagagctgcaatgccagggaaatgtagggcagaatcacagagtgattacaatgtcacagtgacttagctgctgtgtcctgtatgctagtcctgggtagtgtaagtagtttaactctaccattctttcttcccaatcctagtacagtatttttaatgctttaattaaaaataatgcatgcatataataaatctgcaaaccatgcaaacagatataaaatgaaacataaacacctccctattctttctcctccaaacttctggtttttgtgtttccctccagatgacttttaatgtgtctactcacattgcctgtctaggctttttatatattgtaaatgatattaagcattttcctgaactttgtttttttgttaataacatatattggagatattttcatattaaataaaaatagttgcatattatcccactatatagtttattattttatttcttccctctctaaagatattttgattgtttctaactaatttatacatttgttatgagaaataatattgcaggaagccattaatgcataatcttggtgcagtcttatggcttttttctatagagtaagttgctaagggtggagttgctgggtcaaagactatgacacttttaatattgccagcttttgccaaattattctacaagaagatggtcccagatgttttcttcctttggcaagggagcaccaggtggaagtgctgagggaagcctgaaaacagcacgtctctccgggtttcagtaggtgtttagaaaaggcattggggggcttttgttctctttcccaggcaaccttgacaagaaaatggcaatttatgggagatcttttaatgagaaatagtcaatggaagcccaaacattcttattttaccacaaacaatgttgtctggtgcactcatataaaattgttgttaaattaattgctgctctgcatcttcaataaattccacagatggcataagaatgtattgacctccccttttgtctgatatgaaagtgggttttccggtagacgtaacacggatactgtcctctggctctaaggcattatactgtgcctatttaattatgttttattaaaaaataatagacagtactcagcttctagttcttcactctgaattgcaatttctcttcattattaaaatccttgaataaatgtgttttgtggattttattatttttcatgtcccattacactttctcaaaagaatgtctctgcacatataatggcattgcttaagtgaccaaagacttttcagaagaaagcgttatgcaaatctatctgcaataataattaaatcaaactgtctagcacagttctaggggaccaaaatgggattctttaggtgatcagaaggctagtcctccttcttagtatcataaggctttgaaataagtaagaggatttcagatttataccaaagcaaaagagtgataatctaggtatcattcataggagacccaatttaagagagaagaaaaacactcaacctaggcagaaaatgcaactttttatctccagtgctgttaagtaattgtttaaaaatgagcttattttgttctcaattgagataatacaaaattgcattttgaagtaagaataggcaagaatgagacatatgcaatttaaagcatcttagaagttgattttggcaattacgtggaaagtagcaattccgacaacccaactgcacaataaaggtaaagggacaacatagtgcccactggagaataaagccacagcacccatgtcctcaaccaaacgtacaaaacaacaacccagctgcactggcctctccaatggctaccttgaaaatggtatgtggccttcagttttctgtacatatttataaatggtataaagttattatagattaagaattaaagaaaacaatgatataggagcttagtatgaggaagggacagaaaggaattcactttttcaatttagagatgattgtgataaagcagaattcagatgcatttctttcttttttttttttttctgatacggagtcttgctctgtcacccaggctggagtgtggtggcacaatcttgactcactgcagcctccacctcctgtagctgggattacaggtgccagccaccatgctcagctaatttatgtacttttagtagagatggggtttggccattttggccagtctggtctcaaacacctaaagtgatctgcccacctcggcctcccaaagtgctcagattacaggcgtgagccactgcatcctgccaattcagactcatttcagtttaaagatggttgagatggagtacagtttaagcacattttcttttatgcaaaacctggcccccaatttaaaaatatttaactataaaaaaataccacatgaaattgccttaaaaattgttcttggagttggtggtggtaagaacggagcttcttccaatttaggaatgttaagctggtaacatatctatttgtcagaatatctgctgcaatcccactctgagccacagtatatatttcacctatattatgtactagagcctcacttagattttgtttctaaatagctgcagctcctgttcacacccgtttcacctcagttgctagaatgttgtctatattagggaactggctacatggtctctggaatttgggttaagccatagggccatatcagggttttaggatttaaggctcagatctggagttattgactgtatactttagttacattgtgaacttaaaaaaaaaattctcggctgctttcataatgaccctcacttatcaatattattgcaaattataaagagatgtctcacaaatacttgtgcaacaaactcagtaacccaggaaagataatttgaagtccatatagcacaatagataatatgcagatataattatttatgattttaaccattggaagatgacctcaatgattcataacattggtaattttgctgagacctgaatttttttcagacaagctgtaaggtctgtatacaggagcacgtcacttagctcagtgccgcttaaattttaatggggataggaatcatctggagattgtgttaaaataagaatcctgaatcagtgtttcagggtgggacctgtaagtttgcatttctaaccagttcccaggtgaggcaaacactgctggttcatggaacatgcttcaattagcaaggacttagctaacaggtgtgcatccctgactgtccaggagctcagtattgcttttttttttctctctctctctctttttgatcttaagtatgcagtaagatgtcaggatatgttttagggatgttttaagctgacattttaaaagtattttctaagtgtgaaagctcttgtttctcataatggctcccaatttacagatgaaagtgaagcttagggaggttactgctgttgcctgagataagccagctagtaaagtggcagcaccacaatttaaacatatgcagtgtttcttatacattgtctcatatgatttgtaacatatttcatcaatggaaatagaaaattagtttgaatggagaatttagtttgtgatgttctggagacatcaaggattttaattacccatatgtttagtgattatgtaagtacttaggaaatatgattttataatagttatttctctatgattagtaagagaagagggaaaaatcaaaagtaaatcttctagtatttcgtattaaaatgaaatgtgtatgcctattattgaaagcataacttttcattactttgtaagacttcatacatggaacagaaactatcaattctgatagttcaggaagagaaatttcaaaagcaaatgccttctggttggattttacttgtttttgataaataaagaatagagaaaacacactgagttaaaattaaaagtatctatgtaaaaggtttagacctaccttgattattaactggaattcttagaagtcagtgataatgtcgaattcttctttggtcccaaaagctttttgaaaaacttttctttacatttgtattagatgaggtctttttctgaatacttgtggaataaatcacatctgtctaatttcccaggcctttagtagcttggggtagtcccataaaatagttttagtttatgctgggtggttctgctgagaaagattgtgctgtctcaatgcaaaattaaactgttctcttccaacttgttaactattagtactccaaatacgatgaagtctttgttttttttattgtaaatcttgtaaggataagaagattaataaaagcaatacagcattagaaaaatttaggataatgcattttccataagcttaacttctctttcctcctttgtaaaaattctcccattaatccttcctcgtagaattgtgctctgtaccacttgattcttgaagttattttaaagatggtgatttacaaggagttagtgagcccgcacaaatatatctcatgatgctaaaagcaagtgtttgcagatggccctggatattctcttggtctttgtttaacctattcaagcctttttaaccagttttaggatattgtaatttactgtagcattatttgtaagaaaacacaaaccaagagccttttgtttgtttgtttgtttgtttgcctaaatcattattattagatttaggaggctaatcctttattatgctttgagaaagaggaaaaaatgcagtagataacgtattcttttcatactattttgtgggtaagcatcatgcttttaaaccaataaaaaaatgagctttcctgaccacaaattaggaccttttacggcaaagcaatgttaataattcgcccatctatgttcatgcttgtagtctacctccagcatttctcaggccctgaatctcagaaaggtcacttttatttcttagttggaaagaagggagggagtgggctggtatagaacaagatgcacattgtacttgttcactgatttatttaatgtattaatgtctcttcagaccacagttcctaaatgctgaaggacttagagctgggggagacaatcagtagaatatgaaatgggatgtaagaattggattaactgtcctggctgagttttccatgtgcctaggaatgaatttatgagctggagaatatttcttgaaatgatctagaaatagtaatatggaatgattgttctaggcatatagaaattaagtgaaataaaggtgaaataagtgttttaccaccaaatatcttttctgtaatcatgtaatggtcaagtatgcaatgcaatggtgcagtattaaggtgttgataaagcacctgaaataagtaaaattctaccatcagggagatcaggcaaggtattcctgagaaaaagatgttggagttgagttctaataaaaaatagcatttaactagtgaagaggagaaagaggaatgtgtaagctgagagattgaatattcagaggctctgtgtagtgaggtgtcatgttgtgaaaggtggcagaggtgactgctgtgcagagagtcatactatgagtttcagctgaagaggtaggatggcgttaaattaaggagttttattattacgccaagggcagtggattgctggttacacattttaggcaagacaggtctgtttttgaagttatacagggaagaaatgatggtagcttcattaggtggaagttatgggaaatgattaggttttggatgtactatattttgaaggtagagccaacaggaattttaatggtgagaaatgggtatgagtgaaagagaggagttgaggatgattacaaggtttttgtatcaaggaagtaagaggacagagttgctaatacctgagattggaaaggctggtaattgagctggatttgggagagtggctaagatcaagttcaatttagacatgttatgtttaagaggtgtgttagccatttaagtggcaatgtagtgcaactagttggatatttgagcctggagtctggaataaaggactaaagtggaggtaaaaatctggatggttgaatttttttttcattatgtttgttgacaatttctatttttttgttgtgttttaaaacatatttaatgtattttatttttatagattcagggggcacatgtacaggtttgttacatggatatattgtataatgctgaagtttcagcttttagtgtgcccatcacctgaatactgaacatgatacccagtaggtaatttttcaaccctcacgccccttctactcttcccttttgaactccccactatctgttatttccttttgtacgtccatgtgtacccattgtttagctcctacttataagtgagaacatgcagtatttgattttctgtttctgagttattttagttaggttaatggcctccagctccatctatggctgcttcaaaagatgtgatttcattcttttttacagttgtgtagtattccatgatgtatatatgccacactttctttatccagtcattacattgatgggctggattgatggacagttatgttaattccatgactttgctgttgtgaatagtcctgctatatattttaatatactataataatttcttttcatttaggtagataccatatagtgagattgctgggttgaatggtagttctatttttagttctttgagaaatctccatattgttttctgaagaggttctaataatttacgttcccactaacaatgtataaacatttcttgttttttaattttgtttgtttgtttgtttgtttttgagacggagtttcgctcttgttgcccaggctggagtgcagtggcgcaatcttggctcaccgcaacctccgcctcccgggttcaagcaattcttctgcctcaggctcccaagtaatcccaagctgggattaccggcatgcagcaccacacccggctcattttgtacttttagtagagatggggtttctccatgttagtcaggccagtcttgaactcccgacctcaggtgatctgcccaccttggccttccaaagtgctgggattacaggcatgagccaccgcaccaggctgtgtatttgttttatgaaataatttttcatgtatgttgtccactttaaaaattaattatttgcatttttcttactcatttgtaagaggtctttttatgataaaacttatctaatatatatgttgcaaatatgttttcataatgtttcttttgtttttcaatgaaaaatatgtaaaatttcacgtaattgattcttttagtcttttcctaatagttctgccttcagtgttgtcatgctttaaaaggccctgtcctctttttattcatcaaatatttactatccagcctctgaatgtccccttctttttttattttaaatttaaacaacctgggatttattttttgtgtacatgagataataatctagttaacttttttttggtcaaacaaattaaccaataattctagtaccatttgttaaatgattattttgttcacttatgaacattacacctttctgttacattagatgtttacatatttacatgtatttgagtaggttttaggatttatctcattctctattaatttatttgtgtcttaggatactaattctacagtattttatcatagctttctagtatgagttattatccaggagagcaaatctaccatcactcgtctttttaaaaatttctttggataattttctcttgtttctagatggcttttgtatatcatgataattatatgtctctaaattgatttaatagcttggaatatgtcttattctggtatcttttaaagataattctctgatggacaccataaaattttttctgtggttatttggggtttttaaaaaatctatattattttgtttgttattttaatatattaatgaaagaagtctcatgggctaagagttgaaatatttcggaggtggactaattttggtggagtaacatgttcaagggtatagctatggaaacggaatgcttaagtgataaggaaatgaaatccactgtatatgaggaggcaaggagtcaagcaaatttagattctaagtgctgaacaaattttccaaaggccatctaaaatttcccaaaacaaatcccaacctaaggtagagagaaagattgttttcaggttccaaagtccccagtaactctgccataggtatatgatacgaattttaaaaggtagtgaaagagacggatgccatacacattaaaggaggttgagttctttcctgagggtgagagagtggtaatttggaagtggcactccttcctacagcaagcatacatatggtgtgggaaataaacactctaaatgggaggacttcagagtaagcagcattgtcttcactgaaaatccaggtttcaatgagagtgaggtgttaggttatggaggatctacatggtcaatggttgagatggaggattggaagcccattttatcagttggcatttactgtgtagcaaaacatcccagaatttaatagcttaagaaatagtttggcaggttagaaatttagactgaattcagctgggatttttttcttcaatcatgctgggcttgcttgtatatctgttagttagctggtgtgtcagttcagatggttggtttatgacactctcacttttcgatgctgagatgactagagcatctttccatgtcatctttcaactagcatgttagctcagccttctttatatgatagttgcaaatttctaaaaagtcaaaacttgcaaagcctctttactcctaggcaggaattcagacattgttacttctaccacattctattggcctcctcaagtcacaaggccagtacaggtgatggagaacctgtaaagtcacattgaaagggacaaagaaacagggatagaaaaacttgtagccttttctacagttttttaataccctgtgaggatgattcaggagggaggaaagtgagcaaggtatgaagatgaaagcaggaataatgtgtttggaagctactttcaaatggggtagtcatacccaagagtaacaagataggaagtatggtggccttcattgacctcagcaacatgattcttactctggctttgtttcagcattggggcaggatgcattttcaggtaatatcaagaacttggtgaaaccagtggtcagtcaccatgtctgaggccatctatgttcaagcaatacatggtatgtcagaggcatgaagttttacttttggggcagtgtttcaaatagaacagaatagaaatatgatatagtacctttaaagaatactagttcagaaacacaaaggtcagaagtggttaaccctttgaatttcagtcatgaggtggaaataacagtggtcctgagtgagtggcagttaaggaatgaggcttctgaagaaattctaacccagctttatattgaaagctgaactgagtttatattgaatgaattgagttaatctgtttcatacagggcaaggttcatctgtcatttatctctgtatcttcatcacttgacagtatctaatgcatagtagatgcccaatacatgttgcaacattcattgagtaaggtgtttcatattttgacccctctttcatggatttttattgtactcaattgcatctgtaaatattaacagtaagttgagattattgtgcttgcgcatcttctgcaaaaataataattgtacttttattcattgtgtcaagtttattctttttatattttgaagtggggatttaataaagcagagtaactaggagttatgtgtggcacaaccaacacagcgaatagcatttagaaaacgcaaccatcctgaacagaatagaaaggactgtcctttctaaattctttattttgtcaagaatgttgcaaactttcactcagggtgacttaagacaatttccagattttgaatagtttgaggataaaaaattccccaaatgatctagttatcacacaaaacatatgagaaactaccaaaaattctcagctgggacagtctctttagattacgctgaaaacagtgatgagttttcatataccttgtgtgtgtatgtgtgtggcgggggagtgtgtgtgtgtgtgtgtaatctcctgtatcaaaagacaatttttcaccagatgaaacaaaatatgttctaccagataaagtattaatgtccctaactaatatccccatatcccttctgctttttcaacccagttcccacagtgctactggatcatctatcaaaattataatacttaattacatcatactccagttcaaaacccttcaaacacttcctaatgctttgaggatacacatcaaagtctttcacatttactgttcatttgtttccaggtttcactattataaaaatactgccacagtatttttcaggtcagtattaaaaaggagaatttataggttgaacattgtacaaaatatgcagaattttggcacctattaccatattattctcaatggttttaccaatttacacttcagcaacatctggaagtgcctgtttttttcagcacccacactagcacaaggtgttatcatcattaaaaagaaaatcttttctagttagatgtatggtatattgtatctttctagtgtgacttgagcacagtgaatggtgtgagaatctaagtagagtattttgggataaggatggggagagaagcagtgaccagataatgtgggctgttgtggtgttaaaagacttcgatatttatccccaaagcattaggaagcatttgaagggttttaaacgggagtatgacatgattaagtattataattcagtaggcgagccactgtgggaactgggttgaaaaagcaggatgggatatgggaacattagttaggggcattcatactagtccatttcagagaggctacagtttgaggtaggaaatgactgtggaattggaaagaagcaaatggattcgtatatatgagaggtagaatatgttgcctatagtaattggatttcaaggaccaagggagagaggcatatcatggatgaatttcatatttcagacttgtgcaaagtggatggatggctatgatgattatactatttattgaagtagagaatactggagggcaattagattttgagttcacttttggccataaggagtttgagatgcccatagacatctaagaggaaatattgaagtttgttgcataagtctgatgtttagaagaaaggtctgagctggagctataaatatgggtgtcattggtgtagatgctaactggagccataggaatgatcagagtcacttaaggagagaatatattgagaggaaaagggagcaaggagcagtccttgaggtactcctacatttaaaatctataagaagtggaagagcctgtaaaataacatgagaaagagttgccagaaaattacacagaaaatcagaagtattattgtaccaaggaagctaaaggaagagtattttaggaggtaggaagtgatacatggtagcagaaggtgctaagaggacatcaatgatgcttttaacattttttatgagattcagaatgtggagatggttgtcttttttaaagcatttttggtggcctggaaaaggacgccagattagagtggctgtggggagtgggtgggagaaggggtgatgctttttgcaatacatttggctgtgaatgggaggatgcatggggtagttactggatgcacatgtagggctcaggaatttttttaattttttaagatgggaagaaataggaagagacaatatttaaatgctgatggcacgtattcactagcatttgagagagaaaaagagagagaaaatgagagataaggagagagagaaaggttgaacatgtataagagaggaattaactgatggtgcaaatagggcagaaagcataggattcagagcataattgaagaattcgaactttgctaggaaaggagacaccttctatgtacaaacagaagggagggagaaatggatggatattgatgcagctaaatgtgtatttgatagaaaggaagttaaaggagttgagtccatgtctgacagcttttgttttttctgtgaagtgagatctaaggtgaattactggagagaagaggcagagtcacaggtgaagttaacagtgtaccgaaaacagcccatgaaagttttgaggtcccagataaagttgataaccagaagttgtgctattcatccatctggttatacaatttgtccctaaccttttacaacccagatgtaggcatgagaaaagtagattgattcatccatcgttaggattttgatctccagacaaagaagttaatgatagtatcaaaaactaactaaactttgagacttaaagatatttatattggatagagaagaaagtaaggatagttgagggctcatcagtagggagaaagttagttcatatggaacaggaagcactaacaaggttgaagaataaatgcagtgggaatagttgaggccacctggaagaataagaagctggaatgggaaagtaaaaggtctgattgagagcttttagaggtggagtagttttgagtgatgacaaaactgtggctatacaggtaaagtggaggtgaggggagagccaaggagtaaaaaggccagggtgcaggataggtcaatcacatggatgtcagaatccttcagaatgttgcagacattgtgacagagagagagactgtgaccagatttcaaagtcagcagtgaatgaaggggagtgtctatgaatgtgtgtatgtgcatgtgcgtgtgtgtatgtaggtagggaatttaatgacgggaacctgaaagagcagatattttttgtgggggtagaaaagtgacaacaactgtaccttctgactctgaagtacagatgtgtatttcatggtatatatgaagtatccatggtggtaaaagaatttgcagctaccctttgggaagtccatggggcatgtggtgttcttgctggaataacaggattcagggagagccaaaaggccataaggttgaagctatgcaaagggtagaattagaattccagagaactgagtgagtttggcagtgaggaggaggttggtgggatgtgtgtagttatgtgaaaagagaatcacaatgcattggaaatgttagtgttcaaaacaaatgaatggatctagttcattgggttggttcacaaagtgggggaaaagaagcaagagatatttgagtttttgttgaattagctgcctcacagagttgtcgatagtaaatcttaatggaaaaaaatgtgggtttgcagtgcttttcacagtattttatatttttcattgctgagagaatagatttgtttactttatacttttcaataggttattatttgcacaaaggaaagctattgattttggtcaacttgttttataactcaattattggttcaaatagttactcagggtttctcttatttctaggtagtcaatcatcttccataaatagcagtcattttatcttttttccaatatacctctaatcatattaattctaacagtagtgatgcttctaggaatccctggcatataaagtgtttgaaatatcataaggactgtggtctaggttaaaactaatgaaacttaaactaggatgatggcagttgaaataaaagaaaaggaatgactttagtaatgtaaatacttggcatttatctgaatgtagactctagaggagggagctgatgatgattctaacatttccatttaggtaacagagaaacaaaagggtgatatctcatgctttacctttaagtataggattattaatatttccatagagtaaatgtttgaaaaagcagtaactggtccagagactatacatcattgtaattcttttgccacaaactaccaaattatatccagttatattagatttgttagcatatttcttcacaacactgaatatcatactttaaaattgtgttgttagattgatagaagtaaaatgatgtctcgttcttcctttattaattcttcaaatagctttaaaatagctttccctatatttccaaatatctcccaatattctcttaattcttcacttgataccattttaatgtttaaatacatttgggatgtatctttgcttatagtatggaatacagaaacgaattttccacctcaaaatgtgagctagtttttgcaactctagatggctaacattttgaaagagggaaatgtggcctaggaagggtgtgaaacaaaaatttagtcattcaaaatatttattcattaggggaaattttaacaaaacattccttacaaatacattaggtgaaaattcctcaccatgatatttaaagctctaaaccagcaatagaaaactggctgcaagccagccattgtaatactagttcatatttacagaatgctttctatgtaccagccctgtagcaatcattttatatatacagattatatatatatatcttacctcattaaatccctagaatagtcctatgaggtgaggattattattccctgaaacaaagtattaaaaatagggcatgtgaggtcaacacagccaagtcctaggccattatttatatggcatttcactgacctactcactgttccccaaaaatactttgcagcttacccattccatattttgctttgctgcgttttgagccacattgacaatactgtggatgataaagacagagagggaaaaatagtaaaagaaaaaccagttagaatttatccagatgttctttcatccattaattgaacaaatacctcagtgttcccatgtactaggcagtagtcaagggggaagggacaaggtagggaatgaaagtgatagaaatatctggcctgcgtagagcttaccctctgagggtggatggagagtagtaaatgctaatgatgtgaaattgaaagtaccatgaaggaaaacaatcaggataaggtaggggcatgatagggacagggtgctgtggtctcttgaggaggcgacatttgaactgagacctgaattaagtgaaggagccggccatgtaactatttggaggacagtaagttcaagactctagggcaggcatgtgcttgattctgtgttcaatgaactgcataaagttcaggccagcagggttgcagcgtccaagggtcgtggtgggagacgccatgcaaaaggagctgtggcttacaagaccgtgcaagaccttctggggacctgaaatcttattttctgcctgtttgcaatggtttaggagatagcaagaggacttaggcctaggcagtggcagtgagcggggcatcaccgtggcagtacatgacttggcaatcgactgaaatagtttggaggaggagtaatgatgccaacaatttcagttgtaactgtgagaatgatggtgctgggtagagaggaaaagatgattttcaggagacaaggatgcagtctaaaggtaggaagttggggaacatatttagggaatatattatgtatttagggaatgtagcaaggaaactaaatgcagagtgctggggaacttttcaggactttctgaattgaattttatttatctcctaagaatgtcattccaggtatttggaagcaaaagctgtagtgaggtggtaattaactgcagtcagatctggattggagttcagtctgtcacttttcagctttgtgaacctgggtgaatcatttaagatcaccttgatttcattgtttctctatttgtttatttgttgtgagcttaaatgagatactgtatgtcagtcatactgctggaaaaaaataagcctttttaaatggtgttatgataattatgaaatactgcacagttattttagataatgtatgtgaaagagctttttgaatatgaaaataactaggtgtgaggtattagctatgttcataaaaccacactccttgtcttctctgtattgctttctaattatagtaactcctctgctaactttataatttgaatcaattcaagagtagccagtgttttatagaaatgtgtgtaaagtagaatggcagcataacatttttgcaagaagttcaaattgaaggctcagctcaagcttgtccaacctgtggcccacgggctgcatgcagcccaggatggctttgaatgtagcccaacacaaatttgtaaactttgttaaaacattatgacacttttttgtgacttttttttttttagctcataagctattgttagtgtgagtgtatattttgtgtggctcaagataattcttcttcttccaatgtggcccagggaatccagaatattggacacccctggcttagataaatgccccaaataactaaagcttagaatagcttatttttgtaattttatagcaaaattatcagtttacatattttaagttttgatgaactcattatttttatttcaaatttcagtgaattaaggagacttccttaaaagttaaagtacaaatgttttaacaacatatataagtttcagaattatagactccaaagtaaacacaggagggagggacagaaaaaagggaagacaggaaaatatgaaatgttatcttggtcatccatacatgtggatttttaagcttattatcagttcttgcttttatgttttacagacatgctttttgaaaatgaaatgaagttgaaatgtaatacatacacaaatttgtatagctaaatactagattttgatgaatattttaagaaggaagataaactatgattcaaatttccaattaaatatatgtgaaatatgtatcaaaggctcagatacttccagcacctgagccactcccttaaggccatcatttctaaaatagaatataaagaacaaaatatcatttaacggaaaaaccaacttaattagtctataaatgtctttaaaggaaaactgattcatccaaaaccaaaacaacatttattatttctgctatttcttccttcccccttccacttagtctgtaattatatttcagctcctattaccctgtctctcatcccttaatgaccccaattttctgattggttctctttgacctccacagaagcctgcttaagcattcaatgaattctttatgaaattctgtggtaatttaatcttctgtgtgaggtccttttagaagctttattctgctcttttggactgaaaggctgttgctaaatcctgatttttattttttcttctgacagtagtgctttagggagaacccaaacaccttcttgaatattgcttactcttttataatgactcttgctataattttcttttgatattggatcacttttagaaatgcagaatttcagttaagtcatttaacttaattgcattcacaacctgttatcttcatttttccatttaaaatatgtttctgcttgctatcaagacttatatttctggatatgtgcggtatatctattatatagaaacataatagaaggttttcctgaacgctttgacccgcactgttgttcttggctgctattaccctgggagagtggcagctgagaaaagaatgaaaaagattccttttccatgagcaatggtcacctgaatctagtgaatttcttggtagttcaagttcccaattacttcatgttctaatagtgaaattttagccttggtaatccttacctgttcatagaataaactgatttttagagttgcttcattttgcttgctttacataatatggctgcatgaaagccttataaagcccataaaacttcttgtttcctgtcagtgaatcctctagcattaatgtattaggaaacatctaccatcttttgaaagtctccaaataatttgtcctaacatgtaattttaaaagaatgtaccttcctatctgtctacctgctaggtaattatgggcttctctgaacagcatctgctgcagagtccataaagaaacatacttccccttttcatttgatctttaacagtacacatttgttaactttatttttgaagaatgtaaaaggaaaacataatctctgctgggtggttttctttctctttgaagaatgacacttttctagttccaacctttgcagaggaggggacttttcttattgcaatgagcttggtgtatatactctctctttttatatgttccctctctttctctatatatcttgatatatataccttttctaatttctcctttttttttctccctgctagtttcctggtttacgtatttcttctcctgctcgtaataattaccttgttgtttgagaatattttccaacatttctgttccttgtatactcactaagtgacaggttttacgtagtgcacaagatagtgcttcttacattgtgtctgtttctttttatggtgttatttgcccttctacataattacattttgaatgatggcatcacctcttctcttctcatgtcacagtttgccattgctgtaagaacgccctcagtagacccctctcctttcctcctccgagggggacttcacttcattattcgtgttagctacacataatggcatcttggaaatacatgtaataatcctcaaatgacatcagttttttctcagtctctcttctaaggaggtgacaaaatagtttcttctataaaagatggaaatgttaaaagaaataacatgtgtgagcaagaagaggtgtcatctgacacctgcttcagtgctgcagtaatttttgatgtgtgctacatatgtccaggttgggaaatgccagaaggaaaggaaaatggccaaaagtatattaaaatagaattaggaaaaataataaggtagtgacaaaaatttgcattctttcttacacatagaagtatacttcagaaaaagggtaagaatattgaatatgtataataagtaattttttaaaaagctgataatgcattatttatcttctcacctttacagtagttcctgctgtactgacttcccgagggaaatttctttggcagtttgcctttagctaaacctttagggatagactgaactgaagggatagacagcttcaagtgggtcattacgtgccaatctttgattcaaacccttgtcaatgttaatgaagtgtcagacttagtccttttggagtcatctttttgttgagaaaactgatttcatcgtgcaaggctaatgtggcatgagtgatattaatttaatactgagatctctgtatcagagtcattttgccttttatagtctgtaaattatttatgagtatgtgcaaattcactataatgcaattcccacaaagtggagaaataataactttgctttttcttggtctcttcctctctctttgctagtcattaacagtccctctttggtatttgattttattgtttgaatacttagtttggaaagttgatcttaagttctgactcttttaatttggtaaatggatacatcttttcattgcttccacactgttcaggtttgaagaatttggtttgtgtaagccaaagctgcctgactgtttctaatcctatttaataagcaaagtatttaatttaattatggtgccatggaaactaagcatttctcaacactcagtcatttatatgattcccttttatgccacattataggtatagtgatcatgatagtgccaactctgatttatttagttttgattcatttgcatgaataataattagtgttgtaagtgttaacatataacaaagtctgttgaatacattagataggatctttatttttattatttctgtaaaacataggatcatgacgaaatgcaaaagaagtagcgattccttgtctataaagattaaagggtagagaaaaataatactcttaccaatgacttagaaaagcaaacctactatcaaaggtctgaaattttgttgttgttgttgagtacatttcagacacaaagaaatataaagggacacttttctttgtatgttagcctgtatgaatactaatgttatttatattcttaaattagagtgttgacaaatgagcacatcaatttgaagtttctgaaacaggctaatgtcacttctgatcttttgcaggcactaagtgcagctaatttactctgtccacactttgtaggggatgtttctcctctgatgaacaatcctcaatttacagatgatacaagtgagagtcagataagggacagtatgatgtattgattaaaagcctggactctgatgcaagaccacttgccttcgaatctttccattacgagtttggttagtcaaatgaatttatcgggagaaggattttgtttcttctctaccagttagcatgcaggtttcctctgctataccaaaggaaagtctaaaattcatacaagtcccatttttctgtatgtgcctctgaattttagggagaggcagggtaggctacaaaatggaacaccagaagcgcagcatatgtcatggcaacagcacatgggtaatagataaaactgatccattactgatagggataatctgtttattcacaggggagacctttatgataatctacttctacagttgaccgttaaacagtgtggaggtcagggatgctgaaccctgtgcagtcaaaaatccacgtataaatttggattcctgccagattttttttgaaagtctaatgttaaccagaagtcttaagataatgtaaatagttgagtaacacatattttgtatgctatatgtattatatactgtattctttttaatattattattattattattatacttgaagttttagggtacatgtgcacaacgtgcaggtttgttacatatgtatacatgtgccatgttggtgtgctgcacccattaactcgtcatttaacattaggtatatctcctaatgctatccctccccccttcccccaccttacaacagtccccggtgtgtgatgttccccttcctgtgtccatgtgttctcattgttcaattcccacatatgagtgagaacatgtggtgtttggttttttgtccttgcgatagttcgctgagaatgatggtttccagtttcatccatgtccccacaaaggacatgaactcatcacgttttatggctgcatagtattccatggtgtatatgtgccacattttcttaatccagtctatcgttgttggacatttgggttggttccaagtctttgctattgtgaatagtgctgctataaacatacgtgtgcatgagtctttatagcagcatgatttataatcctttgggtatatacccagtaatgggatggttgggtcaaatggtatttttagttctagatccctgaagaatcgccacactgacttccacaatggttgaactagtttacagtcccaccaacagtgtaaaagtgttcctatttctccacatcctctccagcacctgttgtttcttgactttttaatgatcgccattctaactggtatgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgacttcattgtagattctgggtattagccctttgtcagatgagtaggttgcaaaaattttctcccattctgtaggttgcctgttcactctgatggtagtttcttttgctgtgcagaagctcttgagttgaattagatcccatttgtcaattttgtcttttgttgccattgcttttggtgttttagacatgaagtacttgcccatgcctatgtcctgaatggtattgcctaggttttcttctagggtttttatggttttaggtctaacatgtaagtctttaatccatcttgagttaatttttgtataaggtataaggaagggattcagtttcagctttctacatatggctagccaattttcccagcaccatttattaaatagggaatccttttcccatttcttgtttttgtcaggtttgtcaaagatcagatagttgtagatacgcggcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagcagttttttccaattctgtgaagaaagtcattggtagcttgatggggatggcattgaatctataaattacctttggcagtgtggccattttcatgatattgattcttcctacccgtgaggatggaatgttcttccatttgtttgtatcctcttttatttcattgagcagtggtttgtagttgtccttgaagaggtccttcacatcccttctaagttggattcccaggtattttattctctttgaagcaattgtgaatgggagttcactggagatttggctctctgtctgttattggtgtataagaatgcttgtgatttttgtacattgattttgtatcctgagactttgctgaagttgcttatcagcttgaggagattttgggctgagacgattgggttttctagatatacaatcatgtaatctgcaaacagggacaatttgacttcctcttttcctaattgaataccctttatttccttctcctgcctgactgccctggccagaacctccaacactatgttgaataggagtggtgagagagggcatccctgtcttgtgccagttttcaaagggaatgcttccagtttttgcccattcagtatgatattggctgtgggtttgtcatagattgcgcttattattttgagatacgtcccatcaatatctaatttattgggagtttttagcatgaaggttgttgaattttgtcaaaggccttttctgcatctgttgagataatcatggtttttgtctttggttccgtttatatgctggattacatttattgatttgcatatgttgaaccagccttgcatcccagggatgaagcccactcgattatggtggataagcttttcgatgtgctgctggattcggtttgccagtattttatgtaggattttcgcattgatgttcatcaaggatattggtgtaaaattctcttttttggttgtgtctctgccaggctttggtatcaggatgatgctggcctcataaaatgagttagggaggattccctctttttctattggttggaatagtttcagaaggaatggtaccagctcctctttgtatctctggtagaattcagctgtgaatccatctggtcctggacttgttttggttggtaagctattgattattgccttaatttcagagcctgttattggtctattcagagattcaacttcttcctggtttagtcttaggaggatgtatgtgtcgaggaatttatccatttcttctagattttctagtttatttgcgtagagttgtctttatagtattctctgatggtagtttgtatttctgtgggatcagtggtgatatcccctttatcattttttattgcgtctctttgattcttctctcttttcttctttattagtcttgctagcagtctatcaattttgttgatcttttcaaaaaaccagctcctggattcattaattttttgaagggttttttgtgtctctatttccttcagttctgctctgatattagttatttcttgccttctgctagcttttgaatgtgtttgctcttgcttttctagttcttttaattgtgatgttagggtgtcaattttagatctttcctgctttctcttgtgggcatttagtgttataaatttccctctacacactgctttgaatgtgtcccagagattctggtatgttgtgtctttgttctcgttggtttcaaagaacatctttatttctgccttcatttcattatttaacctgtagtcattccagagcaggttgttcagtttccatgtagttgagcggttttgagtgagtttcttaatcctgagttctagtttgattgcactgtggtctgagagacagtttgttataatttctattcctttacatttgctgaggagtgctttacttccaactatgtggtcaattttggagtaggtgtggtgtggtgctgaaaaaaatgtatattctgttgatttggggtggagagttctgtagatgtctattaggtccgcttggtgcagagctgagttcaattcctgggtatccttgttaactttctgtctcattgatctgtctaatgttgacagtgaggtgttaaagtctcccattattattgtgtgggagtctaagtctctttgtaggtcattaaggatttgctttatgaatctgggtgctcctgtattgggtgcatatatatttaggctggttagctcttcttgttgaattgatccctttaccattatgtgatggccttctttgtctcttttgatctttgttggtttaaagtctgttttatcagagactaggattgcaacctctgcctttttttattttccatttgcttggtagatcttcctccatccctttattttgagcctttgtgtgtctctgcacgtgagatgggtttcctgaatacagcacactgatgggtcttgactctatccaatttgctagtctgtgtcttttaattggggcatttagcccattaacatttaaagttaatattgttatgtgtgaatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggaggtcttttagggcaggcctggtggtgacaaaatctctcagcatttgcttgtctttgaagtattttatttctccttcatttatgaagcttagtttgggtggatatgaaattctgggttgaaaattcttttctttaagaatgttgaatattggtccccatgctcttctggcttgtagagtttctgccgagagatctgctgttagtctgatgtgcttccctttgagggtaacccaacctttctctctggctgcccttaacattttttccttcatttcaactttggtgaatctgacaattacgtgtcttggtgttgctcttctcaagaagtatctttgtggcgttctctatatttcctgaatctgaatgttggtctgccttgctagattggggaagttctcctggataatatcctgcatcgtgttttccaacttggttccattctccccgtcactttcaggtacgccaatcagacgtagatttggtcttttcacgtagtcccattttcttggaggctttgttcatttctttttattcttttttctctaaacttctcttctcgcttcatttcattcattttgtcttccatcactgataccctttcttccagttgatcgcatcggctactgaggcttctgcatttgtcacgtagtgtcttggttttcagctccatcaggtcctttaaggacttctctgcattggttgttctagttatccattcgtctaatttttgttcaaagcttttaacttctttaccattggttcgaatttcctcctgtagctcagagtagtttgatcgtctgaagccttcttctctcaactcgtcaaagtcattctccgtccagctttgtttcattgctggtgaggagctgcgttcctttggaggaggagaggtgctctgatttttagtttccagtttttctgctttgtttttttcccatctttgtggttttatctacctttggtctttgatgatggtgatgtacagatgggtttttggtgtggatgtcctttctgtttgttagttttccttccaacagagaggaccctcagctgcaggtctgttggagtttgctagaggtctactccagaccctgtttgcctgggtatcagcagcagtggctgcagaacagcggatattggtgaaccgcaaatgctgctgcctgatcgttcctctggaagttttgtctcggaggagtacccggctgtgtgaggtgtcagtccacccctactggggggtgcctcccagttaggctacttggaggtcagggacccacttgaggaggcagtctgccagttctaagatctcaaactgtgtgctgggagaaccactactctcttcaaagctgtccgacagggacatttaagtctgcagaggttactgctgtctttttgtttgtctgtgccctgcccacagaggtggagcctacagaggcagactggcctccttgagctgtggtgggctccacccagttccagcttccaggctgctttgtttacctaatcaaacaactaactcggcaatggtgggcgcccctcccccagcctcgctgccaccttgcagtttgatctcagactgctgtgctagtaatgagcgagactctgtgggcgtaggaccctccgagccagatgcgggatataatctcctggtgtgccattttttaagcctgttggaaaagcgcagtattagggtgggagtgacccaattttccaggtgccgtctgtcacccctttctttgactaggaaagggaattccctgaccccttgcacttcccgggtgaggcgatgcctcgccctgctttggctcacgcccggtgcactgcacccactgtcctgcacccactgtctggcactccccagtgggatgaacccggtacttcagttggaaatgcagaaatcacctgtcttctgcgtggctcacactgggagctgtagaccagagctgttcctatttggccatcttggctcctcccccttatatactgtattgttatgatacagcttaaagttagctaaagaaaagttttaagttttagcttaaaataatctaaagaaaagaaaatgttattaagaaaatcataaaaattagaaaatgtatttactatttattaagtggaagtagattatcataaaggtctcctttctcattgtcatcacattgagtacgttgaggaggaggaataggaggaagagttcgtccagctgtcccaggggttgcagaatggaacgaaaatccatgaataaggggacctgtatagttcaatctcatgttgttcaaggatcaactgtactttgaaacagtgcctggtacatagtaagctccatataagtgttagctgttataattgctatattttttattatgatgtgatcccctgtgaataaacagattatccctatcagtaatggatcagttttatctattacccatgtgctgtttccatgacatatgctgtgcttctggtgttccattttgtagcctaccctgcctctttctaaaattcagaggcacatacagaaaaatgggacttgtatgaattttagactttcctttggtatagcagaggagacctgcatgctaactggtagagaagaaacaaagtcccaaactaacatccccattctagactctttttttttccctcttgaatttatactttttaaccttatagatacctttttctataataaatgctatagtaagttttcttttttcacaagctcctggacccaaaagcatgccgtacagttttggatttaggtatgtgtggttaggatacctttggctccaagttacagcaaactttgatgcaaactgactgaaaaataaagagaaaatttgtcatttcatgctagaagtagttcacagataggacaacacagagaaaggtatgccagggttctacctctgcttctctttgcttcccttttttctgccctcctctgtgtgctggtataacaattataggaattatatccagatacaagtacacccagagtaataaaggaaacatcagtatatcatctgatatactgtacgtatctgtacgtcgttcttaaaagcaagaaagcatctctgagaagttgcctcacaggtttctcttcatttctcattggccagaattgggtcacacgcccataactcagacagtcattaccaaagggaactggattactatgttttgcctgtaataataatttgggtggaatagtggtatgtacgtttgttctgtaaagggcgagacaataagtatttttggtcttgcatgccacatggtttgtattgtagccactaaactctgtctttatagcatgaaagcagccacaaatgatatgaaaatgaaaatgaatgatcatgcggtcttctaataaaaccatgttttttttgttgttgttgtgttttaagatggagtcttgctgtgtcacccatgctggagtgcagtcgcgcaatcttggctcactgcagcctccacttcccagttcaagggattctcctgcctcagtctcctgagtagctgtgattacaggtgcctgccaccacacccagctaatttttgtatttttattagagatgaggtttcaccatgttggccaggctggtcccgaactgctgacctcaagtgatccactcaccttggcctcccaacttgctgagattacaggcatgagcctctgtgcctggctaaaactatgtttattgttactgaaatttgaattttctataatataattttacatcataaaatactcttcttttaattttttccaaccattttaagatatggagctattcttagccacaagcctgtacaaaactggtggtggatagatttggcttctgggtcatagtttgtcaaccactgagtcaattcccggggccactacaagctattttgactaaagaaattctaatctagctatttgtacatgtgctagaaacttcacatttcataccatttagatgtatagatagtaattttttttctctgaaactacttttggaaaaatcccacaggcccttgtttgtatttttcattttctaccttggtttggtggtaaaggatacatacatacacacacacgaattattgcaaattatggtaagggcaatataggaaaagtctaagatgctatgagaggcaacccttgggacttaatttacactggaattcaagaagactttgtctaaaaaagtaacatttaagatcagaaggatgaatatggaaaatatgtatgtgtgtgtatggatgtgtgtgaatggtggtggaggaaatcattctagaaagagggataaagcctcaaagccataaagagtttggactttaaattccaatatgtctgaatctttatagtccatgagtgggaggtagcacttttttaaaattaaaaatatagatacatgtatacattgcaaaatgattcactaattcagcttattaacttgtcacctcacatatttacctttttatgatcagaaaacttaggatctactttcttagcacgtttcaagtatacaatacgttattattaactatagtcaccatgctgtacattagatctccagaacttattcatcatataactgaaagtttgtatcctttgaccaacatcctttcattcctctccttccccctgaccacggcccatggcatctatggttctagtctttgcttctatgagtttgacttttttagtttccacatataagtgagactatgcaggatttgtctttcagtgtctggcatatttcacttagcataatgtcctccaggttcatccatcttgtctcaaacaggattttctttttttttttttaagataaataatattccattgtgtgtatgtaatcacatttttaaaatccaattatctgtcaacagacacttaggttgtttccatgtttctgtatcttggctattatgaatactgctgcagtgaacataggagtgcatattctttgagagattgatttcatatcttttgtatatatatctagaagtggtattgctagatctatgttctgatgacacttttattcactgagaaaacacttgtgattgaggcacttggttacttgtttgagatatgaacacaataatatagttcttctcagtaagtttttagttactgaggggcaatagactacaatataatggctgagtgccgtgttagagatatgttcaagtgctgtgggttcatagagcagagaaaacttcctttattttgggaaatcagggagggcttctcaaaggaatcagagtaaattagaacttcatttgttctttatgaagtcttccttgacaagtaccaactagtttctgtgacttccttatttagtctctcagcagctggtctgtatttttaccttgttaatctgtagtctgtcatacattttttttttttgcagccaaccgtttgccctttagttctcattttatctgggttttaattagatcatgagggccttaagaacaagaattctctcttggttggataccaggggaaggtatgcagaatggagaggaagacttagtttaataattaaatgacaatatggaattaatgaagagcaaaacccacgtataatgaccaatagaaagtggaagaatgattctctgtgggccaatactcatttaatgatgcaggttgatcacaattgttgtgtggccatgtaacaatactctgagagctggacttatgtatttaccatggggggattattacagagcaataagaagtatgtggcaaaaaccaattacagaaaaagaaatgatttcgaattaaaataacactaataatattcttagagatttgttgcatgaaaaatgagaaaggaatttgggaggagcaggcaaacaaatgagaaatctgcctattaaagaggcataattttatcaactaagaacaaacaagttttttgtttattataaaaaagttattgattgtgaactaaatgtgtgcatgttgagactgtttgtcccaatgaatacaatggcaatactgctttattctgatcaattatgcatgaccaagaaaatggttatttagcagctagacatgagggacttatagcaaaataaaatactcaaaaattaaacatactttatcttaatctgagcaacttcactctgaatattagaaaagtaccaattttaatatagtatgtggtatttattttgaatttttacataatttttacaaaatagaaaaatattacctatcaatattttgataaaatttcaatatctaaaaataatatttttatgtaactacagcactgaaaataaatcaggacagtaaatcagatcaatgagtaaacaaatacgagaatatttacattgtgatagtcacataaatgcatacatttataaaataaattaggaaattttctattatttttaataaaaattaaatttatgcttgcatatataggtttgaaggcagtattacacgatgtataatttgtcttttaacttcatgagggagactaaatgtaggtcagacctttactgattctataattcttatataaaattattttcaaatattctttgtaaaatattaacagtataattattgaatttaaagtttaatttacatagttacaactagttgaattgatttccaatagtaaacatttggggataacttcttttctggtttcgttcagtatattgttgaatttttcagagccacatgttagcaaagcctggcttcattaagaaagcacatatgtacaattctgatgtttactcatgacttctgtctttttttttttgattaagcaaggtcaattatacatatattttatattgacgactatttagtctactgttagtgtctactttgccctttagaatgctagaatcttagtctttgccttgcagtttctgtgtagcagggccttggcagggctctagaatatttttgttttagcaactctttaacagagttacccaatgctttttttaaaaaaataaagaaggccgggcgcggtggctcacgcctgtaatcccagcactttgggaggccgagacgggcggatcacgaggtcaggagattgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcaagatcgcgccactgcgctccagcctgggcaacagagcgaaactccgtcagaaaaaaaaaaaaaaaaaaaaaaaagaattaactgcttgtttttaattttaattgacttacatttttattacttattaacctgaactttgagtctcttagttttcaccaataaagtgttatagtcttctattttcaattaattaaaaagatgaaaattaagaatggaatttcttattttgcataaaagctaagttatttgaaccacattcttctgaaagcaactaacaaaggaggataaaaatattttttaaaattcttaaaatagtttaaatgataaaaataatagcaagggattctcagaccaaaaccaaagagaaacctagaaaatagaatacagtgaaaaaaatcagtggaactgcttttgctatgagggtcttttcttcttccttgaaaatttcagcttttcttttgataaatttctggggcaaaggggacagaaacaaaagcgaagaacctatagtaggaggaagcattcaacagaccctcatcacaataagctggaattccaaaaccagataccttcatgataagggcaagttaggagtaaacaagatgttgcatggatataaagcctaggcagcagttatcttggtttttcagggagactcaagccttggatttcatttacatttatgtattatgcctttggtgaaggataataaacattcttcctggagaaatctatctttatcctagacctcaagttacttttagaaatatggtttctttttactactactaggcatccaaggaaacaaaactgtaggatgaaaactggcagaaacaacagacaacagaaacagactacaaaaatgtcaaattagaattaaccaacagttaatataatacaagtgtgctcattaagtaagataaatcagtatatcttcaaggaacaggaagacatgagatctagacacggtaaagtgaacattcagaaaaattgaagacaaaaaagtctaaataggagccaaaggcaatattaacttcaaaggaataatgaatagactaatcatactaacttttcaacagttgaaaccagaagggagtagttccatcccttcctcaatatatggaaggaaaatggcttctgagcttgaaatctatgcttaataagaatatccttcaagaatgaaataaagaaaaataatttctaaaaagtaaaaagctgaaaaaattagttataaatagtgagtaaacctaaatgagtattgatagaataagatataattaccattatcctcataatcttacagaatttagaaaatgtatagaaatttaaaaatacaacaataacattatagtagggagaataaatatgttaaaatattttaagacgcttctattatcccaaaggaccctaaagttattgactaaacttaattttttattatttaagaaaagagtgttaaatttctaaactactgagtgtaggggaaaattgaatgagcaaaaaatgattaattcaaaataagtaaaagcaggggggacaaaaatcaacagcataggcagaaaaagagaaagcacaaaataagacagtttatttaaaaattgaatatatttgttgttaaatatacatagactaaatatacatagactaaacattcaaaatatttattttgaaactgaattaatgaaactcagctctaaactgtttaaaagatacccatttaaaatataataatacagaaaggttgaaagtgaaagagcagtaaaatatagaccatgcaaaagaaaggtatttttccctgaaaaatcaaagtagattttaagacaaaaaaggcattactagaattacttaataattataaaatttaaaattactaggaggacctagcaatttgaacttgcatttacctaataatatagcctcaaaatagatttaagaaaattgacagaattacaaggaacaatagacaaatacatagagtaaagttgtagtaattgatagactatgagcacacaaaataattattaggcaaacggagcacttgaatgtgattaaatgtccaaacctaataaacatatttagaccattataccctactgtgcagcttacataagcctttaagcacccatggaatatttataaatactgattttatgctgtgccataaagctcatttcaacaaatttcaaagaactgaaattatacagagtatgctgtatgaccacaatacaattaaactagaaatcagtggcagtagatgctagaacattccatactataattcattcatttcattccttctttccttccttcctcccttccttccctacttccttgcttgcctttctttcttttttatttttggataaaaaacacataatatgaaatctgccctcttaatataagtgtacaatacagtattgttaactatatgcacattgatgtacagcagacatctaggactttctcatctttcatgactgaaactctataaccattgaatagaaactccttattttcttctcctcctagcgcctggaaaccatcactctgttttctgcttggatgattttgacccctttgcatacctcatgttaattgggttcatgcagtatttctcctgttgttactgacttatttcacttagcttaatgttctcaagattcatccatgttgtagcatatgacatgatttccttcattttaaaggctaaataatattccattgtatgtatatactacattttctttatttattcatccatcagtggacacttaggttgtttccacctcttggctattgcaaatgatgctgcagtgaacatgggagcacaaaaatctctttgagattcttatttcaattgtgatggaaaaatacacacaagtgggataactggagcatatggtagttttattttcaattttttgaggaacctctatgctgttttctgtggagtctgcacatttacattcccagcaacagtttccagtttctctacatccttgccaacacttgttattttctgtttttgtttatatttgtttgtttttggtaatgacaatcctagcagatgtgaggtgatgttgcattgcagttttgatttgcatttttctgataattagtgatgttaaggatctattcatatacctattggccatttatatatcttttttggagaaatgcctattcaaatcctttgcccagtttttaattgggttatttgtttttctgccattgagctgtggaaattcattatgtatcttgaatagtgactccttatctgatacaatttgcatattttctcgcattccataggctgcctttcattctgttgagtgtttcctctactgtacagaagtttgttagtttgttgtagtcccgtttctctatttttgcttttgttgcctgagctttggcatcatatccagaaaattattgccaagaccaatattatgaaatttttttctattagttcatgtaggagtttcttagcttcaggacttatgtttaagtctttaatgcattttgagttgatttttgtgcatggtgtaagatagaggtctaatttcattcttctgcatttgatattgttttcccaacacagcttgttgaagagactatcttttccccattgtgtattcttagtattcttgttggagatttgcctgtatgtaagtgagtttatttctgggctctctattctgtttcattatctgtgtttaatgccaaaaaccatacggttttatgtactgtagctttgtaatgtgtttgaaagtcaggaagtgtgaggcctccagctttgttatttctcaagattttttcagctatttagggtcctttatggctccatatgaattttagcattgttttgactgtttctctaaaatgtaacattgggattttgatagggattgcattaaatctgtagattgttttggatagtacaaatattttaacaatgtcttccaacctgtaagcacaagctgtattttcattttttaatgtctttttaaatttctttcagcagtttcatagtttttagtgtacaagtcttttgcctcattggttatgtttatttctaagtattttattattattgatgctattgtaaatgagattatttactttatttccttttcctatttttccttgttagagtttaggcgcacaaccaattttcgtatgttgatttcatgtcctacaaatttgctatatttgttcaagagctttaacagatcttttgtggaatcagggttttttcatctgccaacaaagataattttactttttcctttctaatttggatgccttttatttatttttcttacccaatttctcttgctagaagttctagtactttgttgaagaaaagtgctaaaagtgaacaaacttgctttgtagttaattgtaaaagagaaacttagtttatcactgttgagtataatgttagctatgggcttttcatgtatgacttttattatgttgaagtatatttcttctatttattgtttgttgagtgttttattaatcataaaagggtgttgaattctgtcaaatgctttttcttcttatattaaaatgattatgtgatgttatactttgttcttttaacatggtgtatcatattggttggttttcatatgctgagctatcctcacaccccagggataaataccactttatcatggtgtataatccttctactgcgctgttgaattgagtttgctagtattgttgaggatttttgcatgtgtatttctctgggatactggcttgtagtactcttttcctgcagtgctttgtctggctttcatatcagggtaatattggcctcataaataagtttggaagtgttcaattttcttcaatgttttgggaggagtttgaaaaagattaccattaattctttaaatgtttggtagaattctctgctgaagtcatcttgtcctgggcttttctttgctgagagatttttgattgatgaagcaatctccttaccagttatctaatgattctgctgtcatagtaggttgtagtgtttctaaaatttatccatttcttctacattatccaatttactggtgttataattattaggagtagtctcttatgatctttttattctgtgtattggttgtaacatttcctgtgtatttctgattttacttgagtcttcccttttttgctttccttcttagtctacccaaaggtttgtcaatgttgttgatctttttaaaaaacaacccttatgttagtaggttttatttctattgtttttatcctctatttcattttctttctgctctaatctttattattttcttccttctgttaactttgaaattagtttgttctttttctagttccttgaggtgtttagttaggttctttgagatctttctatttttaaatgtgggcatttacccctataaacttcccttttttactgcttttgctgtgtttcatcaattgtattatgtgatgtttttattttctttgtctcaaggtattttaaaatttcttttttgattttttagttgatcaattaactattcaagtgtgttatttaatttccatatatctgtgaattttctagttttcctagtgctactgactcctagtttcatttcattgtgtttggaaaagatactggtatgatttcatcttcttaaatttgttaagacttgttttatagtataacgtggtctatcctggagaatgttctgtatgtccttgagaagaatttacattctgctcctgttgtatggaatgttctatatatgtctgttagattcatttagtctatagtgtttttcaagtcttctgtttccttattgactttttgtttggatcttctattcatgattaaaagtagggaattgaaatattccactactcttttgttactgtctgtttctcccttcaagtctatcagtgtttgctttgtatgcataggtgctctgatgttgggtatatttataattgtcatatattcatggtatataaaccctcttgtctttatataatttccttatttatctcttatttgacagttatgaatttaaagtacattttgtgtcatagcctggccaacatggtgaaaccctgcctctactaaaaatacaaaaattagtgtgggggcaggcacctgtaatcctagctactcaggaggctgaggcagaatagattgaacccaaggggcagaggttgcagtgaggcgagatcacgccactgcactccagcccaggagacagagcaagactccatctcaaaacagaataaataaacaaccaaacaaaaaggcctggtgtggtggttcacgcctgtaatcctagtacaggcgcatgcctgtaatccatctcaaaaaaaaaaaaatcctggaagcttcttgcttttggttatcatttgcatgaaatatatgtttcaaacatttcacattcagcccatttatgtcattaaatcttaggtaagtcttttgtagacagcatataattggctcttggttttttttttttttaattcattcagctgttctctgtcttttgacagtttaatccatttacttttaaagttattattgatcgagtaggacttactattgtcattttattgttttctgtttgtcttgtagcttcttatcctgctttttctcctttgttgtcttcctttgtgtttccttgatttttgtgtgtgtgtgacacgcttttgattcttttcttattttcttttgtgtatcatcaataggaatttttgttgttgttaccatggggctgacataaaatatagcaatctattttaagttgataacaacttaactttatttccatatacctatttactcccctccccctacactatttatcattgatgtcacaaattaccatttttaggtggcatgtccattaacatatttttatagttgttatctttatgtttttatctttaagttatataccagaattaaaggtgatatatacaccactgttggagtattatagtattctgtatttgtctgtatatttacctttaccagttaaaaagtacttttatatactttcgtgttgctgtctggtatttttttcatttcaactttaaggtcttctgttatcattttctgtaaggcaggttgagtgatgataaacttcatcagcttttgttatctggaaaagtctttattttttcctaatttttgaaggacagtttggctatgtatagtattcttggttggtggatttttcttccaacactttaaatacgtcattgtactctattctgcctgcaatggttccattgataattctgctgatagtctgatggcagttcccttgtacatgattagtcacttttcttttgcttcttttgaaatgctctttgtctttgacttttgaaaatttgattataatgtgtctttgtgtagctttgtttgcatttaatcttgctgaagttattttggcttcttgaatttagatgtacatttcctttccagatttgggaagttttcagctgttatttcttcaaacaagcattctgcctttttctatcttcttctttctggacccccaaatgcataagttggttcacttgatgttatcccataagtcctttaggctttctttattcttttttatttgttttcctttttgctcctctgactgcatttcagatgcactgtctttgagtttgctgattcttctgcttaatcaaatctactgttgaactcctctagtggatttttcaattcagttattgtattcttacattctaaatatctgtttggtcattttaaaaaattactgtctattgatattctaaatatctgtttggtcatttaaaaaaattactgtctattgatattccaactttgttcatgtatcagtttcctgagctcattgagcagcattgtgatggtcactttgacttattttcaggtaatcacatgcctctgtttctttaggtcagtgtctgtgggtttattttttattttttttattaggctgagcacactgactggcatataatagccattaaagtaataattttgtgtgtgtgtgtgtgagtgagagtatgaacaagaacatttccacagtattcttctcaataaatgtggctgaggggaaattcatccatatatataatagcatcactgaagacatgaaggattatgggaagcccttttgcttcttagttaattccagaggcatttgggggtaatgtaaccaaattttcttttgattatttgttattgtgagaaggttaattttggcaataatttaattcttaatttacagagttaatataatgtgtttaacattttaacctcgatgtttcatttagcatagctgtcaaaaacttttacttaattgacccctaaagagaaaagttatctgaaaagaataaaatacgatatacctcaacaaatattttgtcccaaggtacaagtacaggtatatttaataaggctcaatctctagtcttacagtaaatgtgaatttcatttttctctttttctctcttcctctctctttctgcttttctctctcattctgcctctccatctccctcttcttctccatttttccacttctgttacttttattactctttttgcagtcatattcataagcaaattatttaaaatttaagaagcatctggaataattttggtctgattcttatagcaacctgtgcattactgagtgggattatctaggattgagatttatagtaaaaactccctaaattgactagttggatgagtctacaccagtaatccttaacactgctcagacattagaatcatctggattctcttgaaagatactgatttcctaggtccctctcctagagattttgatttagtttgtttggattccacacagatattttcaacaatttccctatgtgcaatttttatgtgcaagtccagttgataattactgatctataatcttgctactctaagtgtgatcattgaaccagcagcattagtatcccttgaggcctggttacatatgcagaatttcatgtctcactctagatctactgctcagcatacacatttaaataagatctccaggtgatttgacaaacattcattgacagtttacattggctctgttaaaaattaaaagaaatcaactgagtttgaggctaagcctgtacacttaatgttttcaaccctgttcatgtaagttgtatttatataataattgtaatattacttaactgctataaatacatactaatatataaatcaactaaatacaaatatgaaatgaaataaaatttgttttatacaaattaagttgaatgattttgaaaaagttgataaactaaaattactaaaaaagtactgtttttctcattttaaagttaaatttattttaaacacggtaagtctttaacataaaatgcaagcatttgaaagcaattgcaatcaaaattttcttgattatattcaagtttaagtataacacatctaaactctacctttatgtttagttagaaaagcattggcaaatcattgtattttaaggtttagaatgaaataaagttgaatgagtccaaattctaacccatggttctgagggttaattaactagagatatggagatttgactggactagaaagcgaagcccattgcgatttgactggactagaaagcgaagcccattgcatcacccactttaggcaacacaaacttttttgggtttcagttaaaatatgaaacacaaagatagacagataatatttctcacctcatgaagtcgtttgaaggaataacaaaacttaaagaaatacatctagcggagttcctgatgatttgtttcattcagtaaaatatgtttccaactctttcttcagtaaatgtatttttctcctttggaaattttattttaactttcttagtttataactgtgttttatgtgtgtatatctactgttatttttttaaattatttattgaaggactctcttgtcaattactttttacagtaataattttcagtaagtaaaagttttaataatatttctcagtgtatttattgttatgcataatgggatgttaaaaaactttttcttacgtttgggggtacatgtgaagatttgttacataggtaaacatatgtcactggggtttgttgtacatagtatttcatcacccaggtattaaacccagtacccaatagttatcttttctgctcctcttcctactcccaccctccctcatcaaatagaccacagtgtctgctgtttccttctttgtgttcataagttcttatcgtttagttcccacttataagtgaaaacatgtggtatttggttttctgttcctgcgttagtttgctaaggataagagcctccagctccatccatgttcccacaacagacatgatattgtttttatggctgcatagtgtttcatggtgcttaggtaccacatttttttaatccagtctgtcattaatgggcatttatgttgattccatgtctttgctattgtgaatagtgctgcagtgaacaatcacgtgcatgtgtctttatggtagaaagatttatatttgtctgagtatgtacccagtaatgggattgctgggctgaatgggagttctgcttttagtttttttgaggaatcaccatactgctttccacaatggctgaactaatttacactcccaccaacagcgtataatcattcccttttctctgcaaccttgccagcaaatattttctttcattttgtaggttgtctgtttactctgtttgtagtttctttggctgtgcagaaactcttaagtttagttagatcccacttgtcaatttttgcttttgttgcaaaaatttgttggtgtctttttcatgaaatcttcacccattcctatgtccagaatggtattgcccaggttgtcttccagagtttttatagttttgggttttgcatttaagtctttaattcatcctgagttgatttttgtacatggtgtaaggaaggggtccagcttcaattttctgcatatggctagccagttatcctagcaccatttattgaatagggagtcttccttattgcttgttttttttgtcagctttgttgaagatcagatagttgcagatgtgcagccttatttctgggctctgtattctgttccattggtctatgtcctgtttttataccagtaccatgctgttttggttttggtagacttgtagtatagtttgaagttgggtattgtgatgcctctagccttttttttttttttttccccttaggattgccttgtctatttaggctcttttttggttccatatgaattttaaagtaggttttttttttctagttctgtgaagaatgtcattggtagttttataggaataccactgaatatgtaaactgctttgggctgtgtagccattttaatgatattgattcttcctgtctgtgagcatgggatgtttttccatttttttgtgtcttctctgatttatttgaggagtgttttgtaattctcttggtagaggtctttcactttcctgggtagctgtattcttagatgttttattctttttgtggcaattgtgaatgggattgccattctgatttggctctcactttggttcttgttggtgtataagaatgcttatgatttttgtacactgattttgtatcctgcaaatttcaacttttattatagattaaagcatacatatgcaggtgtgttatatggataaactgcatgatgctgaggcttgaggtcccaatgattccatcacccaggcagaaaacatagtacccaacaggtggttctttagcccacaccctgctccctttctcccccatctagtgatgcccagtgactattgttcttaatttaacatccatatgtattcagtgtttagctcccacttatcagtaagaacatgtggtttttgcttttctgatctcgtgttaggttgtctaggatgatggcctctagctgtgtccaagttttgcaaagggcatgatctcattcttttttatggctgcatagtattccatggtgtatatatatactacattttctttatccagttccttgttgattggcagttaggttgattccatgtccttgctatcgtgaatagtgctgcagtgaacattcaggtgcatatgtctttctgacagaatgaattattttccttgggtatatatccagtagtgggattgctgggttgaatggtagttgtactttaaattctttgaaaactctacaaacggctttccatagtggctaaactagtttgcattctcaccaacagtgtataagagttcccttaaaaaaggtaccctgaaattatgtgtcagtaaaacaactgtaaatgtggatgaaaacagggtattaaaattatttctcttcagactgctgagcaagtatctatcttattacattaaaaaaaccccaaacaaaatgaaacttatactggaaattctaggtaacacattgaaaggcttacttatataatcaagactacaataaagcacaatcaaggaatccatactaaaatgttcaacatcaaaacatgattgagtgtgaatttgtgtgtttaaaatgtttaaagtacatatttattgtcgtatatgatttctcagtttaactgattattttcaaacaataggccaaattccatcagataacataggataaaaaggcttctactgaatatctctggactgcctctattcaaatgttaattttatttttctcttcgatttcccctttctctgcatagtaaaatagttgtcaacttagctctacctgggcagctctaaaatattaaaagacccaagtcctaccctcagaattttttaactcgtctagcatgcaaatagggcattgagtttttttttttttgagacggagtcttgctctgtcgcccaggctggagtgcagtgtggtgcgatctcggctcactgcaagctccgcctcccgggttcatgtcattctcctgcctcagtctcccaagtagctgggactacaggcgcccaccaccatgaccggctaatttttttgtatttttagtagagacggggtttcaccgtgttagccaggatggtctcaatctcctgaacttgtgatctgcccacctcggcctcccaaagtgctgggattacaagtgtgagccactgtgcctggccaggcattgaattttaaatgttcttcaggtgattttaatatgcatctattgttgagatccatcagcctactggtttgggagtataggtaaaaccaagttataataaatcacttccaggtaatataggtttctagactggatgttcattggaatcctgggacaaagtatattattgtgattattactctatttttgaatgtattatgagtactcttttcctgatttaaatcatgctaaatcatttcaccctcagtgcttattttcaaacactcctctgtgtgaagcatttccatttccacccttgtaagactgtgttcttctctgagttatatttagttacctgtgcatgtgcccatcatttcccacattaggctgaatgctccttgaaggcagggaagatgactttctactacagtgtttcagtgtcaataaatgtttcttaggtggggtgtggtggctcacacctataatcccagcactttgggaggtcaaggttgaaggatgacttgaggtcaggacttcaaaacaagcctgggcaacagagtgagaccctgtctctacaaaaaattaaaaaattagtggggcattttggcgcatgcctgtagtcccaactactcaggaggctgaggtggatcacttgagcccgggaggttgaggttgcagttcatcgtgccacagcactccaacctgggcaacaaagtgagaccctgttgcaaaaaaaaaaaagtttcttattttcaccaggtgttaccattcttgccccatgtctttatgaaattgttttggttctcctgtttatcattttattgcttactccttttccttctcctgttccatctccagtatgctatcaaatttttctgtcctcagttgcttcctctgctctctcttccctcctctttgtgccattccttccgcttgtcttactctacacagagcttgctccctttaactgtgtgctttttctcttatcttggcccacattctttgcataatggagttattaatatagctgtcatgaaactgcattgaaaaatttcctcctaatagagctgcacctcaatagttacctcttttgttttacctgcacaccagaaactgttataaaagagcaaaatcactttttcaatgtttttttacttgtaatctcttagttgagcactaatatttggtttataatgaaaagaatcatgctttgcagttcacacagcattttgtgttcaatatcttcgtcactataacatcaaaacaacatgtgtctaaatggtgctgggcattttgaaaaaaaaaagttacacaaagttaaaccaaagacgatgttcctgtattgaccaaattcactgggttggtggtaagaaaagatgcacataaggactgtcatatggattctagttctaactttgaaagtgacaatatgtaaacttttccttactatattatacattatatttctttgtgtagtggtaatgaaacctttcttcatgtgtgtccatgtttgtcgctttaatagtatttaagtattgacacaaatactgtattttcctctaaatctttacctccagtcattcaatttatttttcatattgtcagaggactaaatgaattgattatattgttgttttaatagactgttatatggtatatgagccaggatcaagaacaagactagtgacagaaaagcagctaaattaaaagaatttcagaatatttttagattgccatttaaattggtaaagttagagtcaaaaatgctgaatctctgcttacagcaatagcgtgtgcttttttgctattaacttctaaacattcaatttttgtttcctcagcatatacattctctaacctagaggctgatctggacagggtgcttgaatttttgctcttgttctattctgggaggtacttttatcctcctttgcctcctaacccctcactactgctaaatttacagtatttcagggcctgttctctttttggaagaataagctactgacctaaattaaggccacctatgggaagcacactttggtcctttagaagcccaaggacatggtgtatataaaacagaaaagggaggttgcataactactatcaagatctcacttcttaaactctaatattagtttggcaaacaactaaattcccaaacaattaatgagatttagctaaggggcaggatcatgtctaattcatgaatttgtgaattatttaagcactctgaacttctgatcattttaaatagcattgactcacaaaaactggttttatatagggaaagaagaaagttttgtcattacattgtccgagcagactttctttgagcatgctaatttgcattattcatgttagtaagttactgctatgagagtaaccagctactttcttactgctcccatttcagatgtttcaaatgtgctcgagttgaaagtaagctgtcattttacagaaagggcagactccttctgtaagacacaggctatagaatcttttttataagatgcaaactccacaggtgagaccaaatgtaaagggaaaaatgaggtttcagttcacttatttttagatttctttatcaaacaggaagctgaaagagaatttaccaaaaaatttaacaaaccttgagagtatattatgcagggcccatgctgggtgctgaataaaatccaaagacaagtaagacactctgtcctgagataagaaagatgaaaaagtgtacaactcactagagaaaaggaaaatgtgttcagtgctataatagagatttaagcattgtagagaagagagagagattaatttgtatcagttagtgctcaatacttttattatgaccatattgttaagaattgactccaagtgagtccagttaacaaaaaaaggttgtaggcaggataaatgcagcatagctgattggagctttttaagaatattaaaacacttttaaaattttttgtttgactttgcagaatcttagcctgcctcatgaatgcatttattgtacattcttttcaaaaatgtataataagaatacaaatatacataattatagttaatgagtttttttctcatccaacagctttgatttgtatatcactaacaaaatattggctcagaatgaagtaactgctattatacatttttaagaagtctcccaaagggaatcaaaatttcaaacaataccattggaaagctactactatataaaactctgtccttaacagactgtcaatccaaagatcactgatatttggtgttttgaaaaagaattttaaagaaactgtaagtcccatgactcacttaagtgaattacactggctttctttttggtgtttataacttttaattttgtaaggaatcatttttaaaggtattggtaccaactgggaagtttaaagtagatgcatgaattttaaatcaggtaataagaggaaaaagctagatatgtagtgaggaaatgtttaaaagtgaaatatgatgcccttttgcttgtatattctgaaatgtttttagataggtttagatgattctttctacaagggtttgctaaagttcattaaaatctcattagaggaaactgcagttgccatctctgcattaatgaccagtaaatcaagatgttaatgtgcaacttagaattttcagagttttactggcttctttcacttatccatttctcaatctgtgttataaattacctttcactttttaacaactgatgacttctaaatttgtctgtagcatctcttggctcctatttgctgttaatcgtttttatgttcttaaaatgggggaaaatgaagtgaaaataatttttattaattgatttttttggattccatcataattatgatgctagtgactatccagtttgtaatgtttaagatagccttggtagaacgtatacatcaagtgttatattgtcctattgaatttctccaagttgttgttaatgtctccacttataactgaatagactgtgcataggaaagctctgggtgacctaaatcacacagaccatgatgtgaatgcactgcctggagttatgccaacagcagcacctactagagtcgagtaaatatgcatttcacattgtttaatattaataactaacaagtagctgtggttctgtgggttaatatgatttcaaaatggtatagcattcttagtctacaaactgataagcctgtatgaataaattaagtacatctccctagaagttttatatcttaaagtatatacacataatatattcaatcaatcactcagcatagacttttgaaaatatggcctaattgaaacagttctgctttaagctagtaagtgattggaggtgtagaaatccaaagttacatcataaagaacttaatgtggtatacacactcactcacatatacacaagccacacaacaaaactagggaagaaatgaagcctctggctgtaaacatgtgcatgcaattaacatggttaaaaggagcaacaaatatagtaaaaatgattattcctttattgttttattgaggaagtgaattttcttactttatactctactggggagaggttagaaggcagatacttttcagttagagaattccagggacggtcctgtagccattgtggtagccagcgattattgttatctctcagaatttgcacctgatacctgcatgggttcgccttggttaaaattagggcataggcccgatctgctttccctcctctgtttacacacttgattttcccagagctcagttccctcattttaccctctggctgcctataaacctcattttgataatctcaaggagggacaacattttaaaaatatcagttttctctttcaaatcttttgtttctgtgttccgctctctcatgcccttctgagcaagctatcctggtaaactagacctcttaatggcttatagtgaattaacgtaatagacatttgttcttgttattgttcctgggcacccaacactcccatttccattctttgtcctctgtcccccaggagcctgacttctgcagcctgcatcactctggtctccttgccagctagtttcaagtagcgttcaccaatgggagacactggcaggaaactggaaggcaggaggaggagagaaggttggctatgtttctttcctgcaccaagctatgtctctggcagtagctgtgctctcatgattacagcttttacaaggcagcctctcctccataattctggcttacactggactctagtaaaaccattttcttcccttgttccttagccttagggtaatgatgatcccttgcttttaccacagtctggatccttaaccagcccttgtttattttcttaatcttaatccagctgtcccttcttagaagttcgttcggtctcctgagtttccatataacttatggattatttaatcatagaatttcagtttgacttctcttagagttagttgtgtatgagtctgtctgccctactaaatattgaggcatgaagcacattaaattcgtctttgaattccagtacctaggagaatatctaacatgtaataggagctcagtacatatttgttaaatgtatgaataggttaacatgactgttactctctcagtcttctcttagaaaactcctagagccattctaatggcatttttatgattccttgcagtgtttttaggaatcattatatcttttttgaatttcttcacatttctcctctaaagagtctagggaagaaatatcctactagtattactgaatattccatgtcaacattagacttatggagaattacagcaactgatcaaaaaagaaatgagataaaaatcactcactttggtttctctctaagccaacttcatcctgcttgtgctcattgcttgaaagagaattaagcaattgtgacctcattcatttttgtgctttttccctccctgccaagctccatttggtgccctattgtcccacaagttgcctatttgagtcttctgaattaagagtctcaaacagaaggcccatctgctctacatgaatattaaattatcaaaagacttttaataaggagaatttacccttgtgttttttttacaatgtttcctttcccctctgtgtaagatttagagcaccattgtttttcttccacatacgcttggacttgaataggctgcagttatcaagtcgtataatataataggcttagaaacttttgaatggcaggtactgaatagatgtaagaaaggttttgtttattctcattatcttataaaatatagtacttattaagtataattaaacatgcaatatgctaggtcttggtatgttgaggttactgagtttcataaaaacaaaaaaatcctaaaaattagatgtcagagaggtaaattttgcaatcaatcatgtttattaagtaaatgcacataccattttaattcataatatgatagatagtatgcaactgacaaatacatagtttcattttgaatattcacgagtgagcatattttagccagactttaagtcatatgattagtgcaagtaaattttattctttgctagcaagctctaaaaagttcaaaatcagttggctaggagatatgcattatgtagtcaaatttgttaataaatgctgtgtaaggagatcagttggaggatgacattttaaaaaacgtgcatggtttccattatttaattaatttatttatttgacattatttaaatgtgcaactttaaaatagtttttcaaggaaagcgagagtcaggttatactttgggaatgaatatttgtacaacaatatattgatattattaagagaatagaccaggcatggtggctcatgcctataaccccagcactttgggaggcttaggcagaaggaccacttaaggacaggagtttgagaccatcgtgggcaacacagcaagaccctgtctctaaaagaaaaaaataaataataaaatttaaaagtaaaaatatgtctactttcttccttctttattattggcaagttgatagttttaaaggtaatagggatatataaattccaaagagtgagacaatttctcataattcacacagtggaatcaaaagaaaatatacccattcactttatataatttgtatagttaaaataaaaaattggatttagtaaatttggggaacaaattgccagagtctgtatcagttgatcacttccactggtctttgaaataattatcttggggtagatctagatgttatggggacctgaagcatctacaatattgggtggcctttcaaagataaacaatacaaaattatgaaaggagaacttagttcagcatcttacaaggagcctaagccagagaaggacgctgaaaattaggcatcattagctttagggtaaatctgtttcaccttaggtgatgagtcagtgtaggtcgtgtgaaatacttcaaaacaaggaaatgatttctgttggctaaatgtttgtgtgaactgtaaatatgttgcaggttttagaaaaagattatttgatactctatgcatttttatggattaaaaacatatttttcccatggaatctaaggttacattttaaaatttcacttaattgtgatggaagcaaggcaggttcagattcagacctctcagcatcctagatggggtgccctaacccatacatacttataaataaaatgacactaaaccataaaacttaaaacttacatggatgtgctgaaatgaatataccttctttctattataatgttctattttaaaattctgtaatggtatataaaacaaaaacttttctcatattgttccctgagtctcatattacccctgatttattgccgccctaagtgactacttaatatgccctaagtgggacatcatctattaggcaagtaattggctgtaagtctgctttttggcactactttttcagagtctaattcagacatgtcattgccctttatcttttttatatcttattttactctctcaacttaatttgcatgacactaatttaagtttacatgtgccttgcagtagattgaattgaggtttctggttagtcatacatgttgaaaaaaggtgtataacatgtggaatgctgttacaagatgatctgatcccttctaagctatttttcccaataaaataaatatatatgtattttttactccaaagcgatatgccaatttcaaggacgaacctactttgaaggagaaagaaatacagtctattcctcttctggagtatgtgttctctatgagtgcaaggtaagaagactattcgtgggtctttcaaaattgtttctatttataaacaagataaaagtttctttactagctcaaccttgaaatacatttttgaaattctaatgcaaagagaaaattcacaatattaattatcatttgaatgtaaagaaattctcatttttaagcatgtaaattagtggttgaaaaataatttttccaagaaatgaaaatgctattttgtcaaattaaagctttatgaagttgtcgtatgttttccaaattcaaataagctccttatttgctcttgggaggaaaatgtaggtgaagttagacttagctttttgtcactcatgattttgtaccatgtgagaagtattgctcagttcaattaaaaacaaaacgaaaaattacctaactaaaattaattgttggatggagttgagactgatatttatctaattccctttggaaggagtgttttaaattagttaaagggaaattccttacaaatttacttgccaaggtttctgaagcaaatgtgattcatttgaatttttgcccctcgacctactaattgaaaaactaaatatgtttcacaacacttttcatgtttgtcttttgtaaattataatgttatatttcttgaccctaatgttacattaaaatccttattctatatgaaggaaactgtctatatataaaatttctgctttagggtttcatttttatttgatagttaattttcctctttaaatacctcctatacatggtttgggaaatgatttagtatgtataaattatgtagaaaattaagatagtgatttatgctgctggcaccaccaataaactatgattgctaagagtgagggaaaggaaaatcctaagaattttgctaagacaaattgaatctgaaagaagctatccagtttatgcatcttaatttggaaatcctttgagataagcaaggaggagatgcaaagaggcaagactgtgacagatttgatttctagaacatgaaagctctgatttcttcatgcccattataaagtatcctctcttcttcttttagttttaaatcagctttccaatgatgtaggttctcatcttagagaatagaggcacaggaacattaaaatgaattcctcaacctgtatttcaagatgatggattttcctttatcagcctccctacaccaatgccgttttaagtggagtaagtctcacaatagataaaagaattggaagacagagtgagatctagtaactccaaaatgagaaaagagactcagagaagttacttcaaggagggaagaaaacttctgccagctggcttctaatagtaatctctaacattaaaattttggttctaaatttaaaaatcttgagagcatttaaagtttctctacttctctttctctctctctctgtctctctctctctctctctgtctctctctgtgtgtgtgtgtgtgtgtgtgtgtgtgtgtgtgtgtgtatcctattcattttaccagaatgtgtctcataatactgataattgtggtttagaaatgtactggtataattgcctattggattttaaatttgctattatataagattatttgattttaaataggttcagttagaagtctttatagaggcaacacagcaggtgctcataaattttagataaatgagtgaatgttaccttttatttgctcaaacaaaaggcaccattttctaccttctaatgctgcaccatccaatagaaatatgatgcaagccacaaacgtaatttttattggactagtttttttctgttttccccgatatatccaaaatatcatcatttcaacatgtaatcaatattaaatttattaataaaatattgtacattcttttgttacaccaagtcttcaaactctcttgcatactttgcaattacagtgtaaaagagccacatgtacctagtgactactgattggacagcacagctctatcagatcatcataagcttttgtactaaattcttcactttaaggtgttccacagtttcttttcccttcaaggcccttagctcctgtatttactgtgttgcagaattgacagctctctcacacatccattttctgggctgtcaattcgagtccctgtttgttcttttattgtcagttttgtccttttgaaaatattagcagtcctaggggtctgtgactttcatagtaacacagaaaaacactgtggtttagaaaatcagattaccagaactgatattactactaaaccaaaagaagactagcgtttgactccactgtatacatgcctcctgccaagcttcttgacaagagcttatgatttggagaaggtcctttacataaatgagccaggaaaaggcagatattgaaatgtgcacttcttctatgaaagcattccttgcagaaattcaatctacaaatctaagctattgagcagtagttaacatggaagcttgcaagttccaagagttatttaattacttatgtattggttagcataatataacatagttaatgatccttgtttttaggacattggagactgacagtatagaaaacaaatgtttgctcctaaggcaagaatacttcaattatcagaagtgtattttgtattttggtttctccttgggaagtgtttaatctttttggctgcaagaactacagtgattttacattgatttattcatttattcaagaaattttttaagtgccaattatgtgcctgaaaatgtgctagacattaatttacaagagacaagaatcctgccctcattttccctgtagttttgtggaagacatccaatatttcttaccagaatcatctgtgagaatctccttataataaaactttataagaaaactgaaatgtttcgaaagctcaattttaatttactgttttttttcaaaagctgttgatataattcaaactgtatctttgccacaattgtcatctgggcttgcaaaatgtgttgtaaaactagcaaaattttccaggattacccagatgtttggcaaattatagacatggctgcagtgtggtggaatcagtgtggctgattcttattctaaagacttgcttattctaaagactttccaattgggatttaatgtcattttgggagtgagcccatgacctgtgcagaggtcctcaggacaaaaatttcttgatcttaaaagagtcttctcagatgctggatctggaaacttcttaacaagtcctaatgataaaatttgaagcacttcttttctgttgtctaacaggaccagaccatgaaacttgttgagagttcaggctgtccagctttggattgtccagagtctcatcagataaccttgtctcacagctgttgcaaagtttgtaaaggtaagacttttttgaaaagtaaggtttacgtgcaagagttattatagtaggctagtacaactgacatgaagtagaaattctcataagcaaattatttccatagactaatagtatttccctatatgctctcctaatttggcacagagtagcacagtaggtagtcatgaaatatttactgaactgaattaaaactgaactgctcctgtgcatttctgcaagttgtcttgaacctgtctcaagctctggatctctaaatttctctctgtgtgctggtttggagtcagtacagctttgctaaagaaagttacacaacaatattgagttagttattttattggcagttactgtttcttggcaagtgagttttgtttgtttttcatttctcctcagcttctttttataacttacctagaatatttttcattatgactacttcaaatccctttcttcttgattctactctcaattctcacccataggtttctggactactgagaatggagaggccatcagacatacattgtttgttctgtgttgcctctgatatgatacaactagaactagtaattagaagggacttcaattattagttgaagataagaaaacactaaaatttgtgctattcaaaaatgcaacaggccaccccagaaggcagtgaatttccatcactaaagatttttaaactaggtatcttattatagattcatgtattaaattaaagcattgattatatggaactctttaagatccttgccaatcatgaaattatatgtgccttcctgtattatacgggaattatatgcttatgaatccatcttctacattagacagtgcaccttgtgggcagggctgagtctttatgttcatctctatatccttaatacttagtatgatacctggaatgtagctggtacttataactgatgtaattggtgctgtataacaaactgccccaaataagctactagtacttgtttgaataatgacctttatattgatgcaaaacaaagcttaaatagaaaaagtaagacaaagaaacattatgaaacatacactgttttgttttcttttaacttactctattaaaagtggacataggatctgatagatcctagatcacccactcccatttttagcagggtggtgcagtttggttttgtttttagtttttaagttacttttccatccactcaatagtttttaaatctcattttatgtgaggctctttaggaattacaaaatggtttaagacatggtctgcctttcgaggagctttcagggtaacctgcagtaataaagaacacttctaaaaagaactatgatcacatagacatataataaggaccataagagttttcactctcacagtgcctaagtcagtgccttacacaaagcatgtgtgcaatttgatatgaatcaagaatgctctttggattcagtcctccagtttgcagcttgactagagtgtctttggcatccaaacataggcaggccatatcagtgtttcttaaacttaaatatacatatgactaacttaggcatcttattaaaatgcagattctgattcagtaggtctggggtcaggcctaagaatctgaatttctacaaaaaagctcctaggtgatgctaatgctgatggcaagcaggaccacacttttagtagttctctatttctgcaaaaaaactatctattgctgctccaaatctcagtggattaaagcaatagtattgtgggtcaggaattcagacagggcttggctaggtgattcttgtgctccacatggtgttaactggggtcattcaatgctgtagggctggaagccgggcttggctgagaggttcaagatggcctcactacatgttggttaccttgggtagggatggttagaaggctgagccagctggcactccctccctctctacgtaatctaaggacttcttcctatggtctctccagcagggtaatcatcagacttcttaagtggtgactcaggccttcaaatactaggtctggaactggcaccacatcacttctatcatatgcaattggtcaaagcactcacaggcagcccacattcaagagaaggggaaatagacctcaccatagataagagtgctgcaaaattgtgaccacttttaatggctatctttaatggacactgcaggtgtccaagggctatacagaaattacagagatgaatagcgtagaagttagtcaaggttgggtaggataagatttgggtaaaaagctgaaatagggcctttaagatatcaagagaaaccttaactacatctatttctttttaaaagagtcctaatatattatgaaaagcaagttaataaatggaaaatgctagtaaaattgtgttatatttaaattatttacagttaaaaaatgtgtttacatagcatacttaaaaatacaatgatagactataccatgactaatacttcctccatctgagattctgatataactgataggagtggggccttggcattactatttttaaaaaatccctgataaattatttttcacagctaggattgtgaaccactggcttagataatcctcaaactgaaattggacagattggcccttcttgaaatatttagcgctatttttaataaagattgcattaatttccgattcaaatatgtgaaataaacgtgttctcctggcattttctaactttcaaactaaaagaagtcaagttttcaaggcttaaatttttagtcaactcctaaagatatgttgtgacaaattcatttgtgataaaattggcctcctgtttccaggcctatttgtatagtgctaaagatggtgtgttcacatctgaaagagtagttgttggacaacagttagtaaatattccctgagagcagagcatgagatgaagtgttgactttttcactagaggctcagccagtggttggaaactaagctacacaccgaagtcaggctccaaattggtaggcgctaaatcaaattcacccaagactgtgttctaggtaccctgtagctagccatcttctgtagtagcagatcagaagaaatgtagcagaaaagttttccgcttttttcaaattagagagccctttcaaggaagcttataacagattaccacatgacagagactgagtgattcagtgaggattctgatttagaaagataaagaaataatgtggataacctttatatccacagtccttctggttcttctcctcctccttggcaaccactttgtctgcctgcaagatcattaaggcttattgactagatggccctccttaatttattatttacttcatctcaactcataattataagcaataggggcatccacatacagaaggctgagttagtgtcagttctcctttccctgggaaacttctggataacccatagtttcccatattattcaattatcaccttcatgattctggctatgtgctatgtatatgttactaataccattatatagttaatttttaaatacctactatagtcgactcacttttaaaagatttagttttattcctaagcggtggtagccatgaaataataggattatttgctggatttgtgtatttcttatacacattaaaagaaatccgttggtattagtatttttttatgttcatccacgtacatgagttacactttaggaaacactaggataatccattatcttgcaaacaacacctaaattaatattctttcatgtacaagtgatagaacacccaattcaagtttcatggcaaaaaaatggaatatgtaggcccaataagcagaggataaattggcttcaggtgtagcttgattctgctctcaaatctcgtccctttgtcttgatgcatctctcagtttatctcctgtgagatagctttattttgaggctcgatgtgttctcagctatacccctacattcttacgctcatatcattatgccattcaagtaggtggaagaaaaagctcagcattctcatacactgaataaaacccccagaattgagtttcagtggtcttcattagcttgaagtagataatatgccctgacctgaagaaattgttgtgtccaggccagtggactgcattggctggtgtgactctatcctgtggaggagtagagtccattttcttataagcatctgggctgaaagtaggggtgagtgataacgaggttattctttttttccacaaaaacaagaaatagatgcctttaggcaaaacctataaatattcaccacaaaattattgtattctctttctcttgataattatgtattatatatatactgttcctacttacacataatcttttgtatccatcctcccctcttttccagttatataagaatgcatgtttatattttaccaaaagttctacacttgatagaaaaacatagaactttatgtaattttgtaaagcttgcaaagggattagagaacataatatccttgaagttaaaacctaaagaaggaaatcaaagaaaggctaggttgtattagataattggttcatccatctgtctataacaaatatttgaattttcttttatggatctcaacatatttaatttcagcttagtagtgctctaataactttagttattaacgaataatatattattatgcttttacatagataatttcattggaacctcacatttttacaaggtagttattatactaatttttattggtgagaaaaactgaaggcttagaaaggttaattaatgtacagttagtaatttacacagcaagttagtggcagagatcagatgtaaactcaggcctgccaactccaatagccaagcacatatgaatggaaatgcaactatgaagataataggattatgttgccaacccatactctgatttgtttaaagctattccctatagatcagaagcaacccactcgaaatcaagtctgaattttccatccattaattgttagctttttgaccctagcattttgcaaaataaccagtaggttcaatcaacttatctgttggaagaatgaatcaaaatagctgacattgtttatagagaattggaattcgaatgactgaaattttaatttttcaagtatttgtgtttaaaaaaacccatctgataaaaagcaaggcacttcctaatttttacctaaaacagtgaaagttggatcacactgttatcttacagtgagaaaattcttgcagcaattaaactctacatagtgtatgtgtgcaagatgtttaatgctgagatgagaggtctcaccattactgaaacagaactgaaaatggatgataatagaggtggcatatcacatatggcatagataatattgggcagagtccaagatgggagaggagaaaattcaaccaagtgaaaagttgaaggaaggttttgaaaaaaaggtgtatcagaaatggtatccgttcttagtcacagtcctctgaaagttgtttgaaacagtacaggcaaaattatgcagaaatttagcactgtgttagagctttgtttcttaattctctgtgtatcttaaggagtaggctattttttagtaactttgttttaatatagaataaatataaagtggtttttgaagcctttttagttagtttgatgttgtgctgagctattgggatagatagtgaagatgactttttagccgaaattgttctccctcaggcattataaaaagacagcggaatacatttgaagaaatatcatctgaatttagctatttaaagaagaaggaaataaaaagatcctaggagaaagcatttttaacttttgctcttcttaagaattttacttttaaatgtacagccttaatcatgacagtttagattgtgaagactcttgtcaaaagaagctacgttgccaagtattttaaatgctgttattgactatatttttctggacttaataaacctatgttcgattttattttatttttgtagaaatcactgagtcatttgattatttttctattcttttttaatggtattattacatttttggaacattactcttcttaagggttattaagttgtaccaataatattttactatacatcatagttgcattaatagggagtatgttttaactctggaattctaatcgaatgaacaccaatttgattacagataagatgaaccaatatagtacttccatctatatgattttcgcaagtaaaagtcttttcttgcttataggttgatcagattattctaagatacatgaaatatacttttttagtccttttttttttttttttttgatggagtcctactcttttgcccaggctggagtgcagcggcgcgatcttggctcactgcaacctctgcctcccgggttgaagcaattttcctgcctcagcctccagagtaactgggattacaggcacctgccaccatgcccagataatttttatatttttagtacagacggggtttcaccatgttggccaggctggcctccaactcctgatcttaaatgatccatctgcttcagcctcccaaagtgctgggattacaggtgtgagccaccatgcccagccaccttctttctttacatgggctaaaatagtaatccattagaaagtgcaaacctagatagatagcatacatcaagtaatttaaaactggttgaattatatataattatgtaatttccattaaatatagattccagttttgaagatttcatttcagcatcttagatgatctttgaacaaggggttcaggccacaaaaagagatcttgagaaattgcacatgattgctgtcactatttataaaatgttccatttttcttttctcttataaagactctgagatctgtgaaatctctataattcctaaaaattttcttcctctttagagtgagcatactttgccttgcagatttctagagaaaattagattaaagtgatttaatattcatctttaacacatttagaaaggttttgttttttttggatgctaagctgtctaatttcttaaatacacaataggtacatttcatctggcttggtttgttttacccacaggtattgaaaatgttgaacctccagttaccagattaccttctcattgtgttatcttctatattataaatcttcattttgtaccctaataatatttctttttttcagatatatggagggttataattagaatattagggactagatagcatttataaagtcaaaaaccacaaaagaaatggagttaacttgaaatcgaaattaattgagttaaacataaagaagaagtttttggtactcatagcatgtgattcttctgtaaatgttgatgaagatactaattaaaaaattatttagggagtcatagcttcaaaattaaagaaaatattaagtaggaaaaatttgcattgtcatagtttcatttaccttaataaatttctttttttttctgtaggttatgacttttgttctgaaaggcataactgcatggagaattccatctgcagaaatctgaatgacagggctgtttgtagctgtcgagatggttttagggctcttcgagaggataatgcctactgtgaaggtaatccttgtaatgatgtgtagctcagctgtataaattttctaggattactgcatgcaaaatttattaagttcccaggttgtcaagttgatgggcccattaaaagcagtgaatttaatttgaagcatattaatcagctaaaaataattatctttcaaattaaagtttttcagctatctgctatatgtcacactaataagttgatatggctggtttcttgaattagaacaattcttccactgtgaaattgccttcttttttttcataattagatattcagatagctcacatattgacatgattactgtggcttgcagttagaatcgtagtcagatttttccagacagtgttgtgtaacaaaggcaatcacttaacaggaagataaagtgcctactgctatttctgtttgctactataagtaatctaagtggttgtattcatgctctgtagtatttagtaaatagctccagtggagtaaatcattttctagttaatttttaaaaatcttaactaatatccaagatagtttattctctcatggaaactgtccacatacagtgagtggactcttggcatttgcaaatgctctggctttgactcttcctgacgaagtccatgagatgtggtaatttatgatttccctgaggtatggatttgaatcattcctgttaattgtgtaactagctaatgagttctacaaataagaacattgatttagaggtgtttgggcattcagagaaagttttggagagttctaaacttacccactccacatgaaaagcatatgtcatagatctgtggagatggaaaacctcaggtataaacacacagcttctgtttagctgcaggatgatttgttggctctcgggaaaccaacttctgttgtttcccttagcttaaatagttttttctttttcttaaaaatccttattcattttttaaattgacctttggattaaaatatttctttaaatgctactgattcagtcctaaagggatcattccagttttgcagaagaaaagaaatatggcttcccttccccattcataatgcagatttatttaaaattcctcatcttaaaagatttttcataaaaatggatttttacccttacataacatagaggtaaactttcttaggaaactaatgtattttgattataatatttgagatttctaacatgtaacaagcccctctggtagtttatatgtataacatgaaactacatgatacaaattcatgtgatactttgttttgaattttacttatatgattattgcttttttttaaattttgagctgcttttgatgctactaagtatattcgatcatgtaataaatatttagtaagcacctactgcatcctgaacacttttctaggcttgatgtaaagtggagtaaatgatggacaagacttaagaatttcccgtgctcaggagctttacattctgggagctaagacagaattagtgggtgactatagaactagagaagacaatttcgggtagtaaaaattaataggaagaaaatgaaacaggatgatgtgttagagattggctggggatttattcagagtggtcaacctctgggacagggagtgaggggagagtggtggtaacctgagacttgatgataagagaggaaacagccatgtaataatcttggatagaacacttcaaccagaagaataaaaagtggaaaggctctaagtgggaatgagcttagaatgctctaggaacaaaatgaaggaaaacgtagtggagcggacaaaagaaggaaatcctgttggagaattaggcaggggccaggtaatgtaggaaagtttgcaaggatttcagagttgcatcaaggaggagagtgatatgctcagccctgtattgaaaaggatagttctggctccagtgtgatagatgaactattgtgttgggagtgatggggagctgtggaaattggagatgagttggaaggctattgcagtagtccaggtaaagatgttgatggcctggataaggaaagttataggaagtgaagaggagtaaggtatattcatagtacgttttgaaagtagagccaaaaatacttgcagttagtttattgtggtgtagaattgatcaaaaggagccaagatttggaatctgagcaacacatggatggcattgagacaggaaagaagttaaggaaaggggccagagatttagattaccttacttgtttaatgcagcttactgaaaattggcctaatcataaagaccaagtcactcagtttttatctggaagtgttctggataaaatctgtggcacaggttggcagctgttttcatcttgaatgcactatacaatgacagatgttttacaactttatactaattgtcatttaaatatataatcttcaaaacataagaaagtgatggaaaaatttgttgaacatatatcatcaaattcaagatatcttgaatttttttatatataaggacttctaatatatcttttgttatttattccaaataacaatattattcaggatttgaataattcttatcaaatatggctttccttttgattatggcatggttgctaactttgaggatgttttgacttcttagaaggaacacctttttaaacatttttaatgcaattttgcatggtatatatttggtccttaaataaattacacttgtgattatacataaaaataagcaagccattgtttgcaaataacatacaattttatttactaaatctgtggggttgcttaatgatatgactgtaattgagactattgatttttactaatagttttcctgatcatggttatcataacactggtaactactggagttcattcactcatttgataaatatttattgagtacttactttgtgcaaggttagagataaggataaagcagtaaattagatatacatgactaatattctgtcaggcgaagaagataattaacatgccatttcattacaccaaagaacatttcattgcaaatgtggcaactattctaaaagagaaatagattaatagggcatatgatctgggtggtggggttagggaaaattttgcttgaacaagaagagttttattctggaatctgaagggtaagtaaaagtcagggaatcatagaaggaagagtagaaaagaagagaatttcttacatgggtaaatcagcatatctaagggccttcaggtagaaagaaggactttttaagaaccaaaggaaggccagtagcagagagcacaggagaggtgcccagtgagactgataatgagaagcaggatcttgaaggtcacactaaagattaagagtttcatgttaagaacaagggacagctaattaaagattttaagatgagaagtttcgtgatcacacttgtgttttaaacatatcactccagctgtaggatgaacaggagaaaggctggatgcagggaaaccaatggacgaaagccagtgagggcttgtcttaaaaatgtaagtggagatgtggatgcatctaagagcatttgtgaggtaaaaccagccagtcttgattaattggtggtagtagatgatgaggagagaggtttagaggttgattcccaggtttctggactaataaataggcagatgttggtgctgctcacttagggaacagattgagtgagaaaatcatgatgggtttggagtgcctatgggacatctaaggtgagtaactagttgaatatacttcaatttggcattaagggaagtttaagttagacagaaaatttggaattctttggcatctaaatgttagttgaggagacggaagggattgtctagagagttttgagcaacatttgagcattttatagaaaagattatttggtgatggcgatagcaaactcatggctgaaacgtaggaggagagagaagagcaggtggtgtcacagaagccaagagaagagagaattttaagaagaaagtaggatgtgtctgagagatcaagaaaaatgaagactgaaagatgtcctttgcgttgaacctcacagatgacattgaggacagcaatagtgattttggtacaaagttggtgatacaagccagtttggagtacattgaatattgtctaagggaaaaaaatgaacctggagaaaggagagagagttcttctaggtgtttgcctacaaagggatggaaaaaggaagtagcttaagggacctgaagctaaagaagggattcttctgcccgacccactttttctcatttaacttctgtaccctttctccttgccccagtatctcagccaggcagatgataacttcttgttcttcagtgagttttgcaacacctcagatatttataaacatagtataatattaggattttataacagcatggcttgtctagcttttcctataagggatctagaatgtctggaagtatattggcctactttagtgttttgttaactgcatgcttatcacatttctctttaaaaaattatatattcatcgccatccatccatctcacctcctatagatttcttactacatttttaaatattttacctctcatctggtattttgtcactacatataagatataaaagttgtcaaaaattatgttggacatcctgtttttcagactggttttttgctacatgtcttcacttgacactgaaaattatgggatcttttgatgttttgactatatcttctatcctcacattccactattcagtattattttagagttatcttggcattctattttagatggtggcttctggagtcattttgtaagtttctttcttcagtgcataatagttgctggggatgacagctgtgtcagtccaatagcgcattacaatgaagaagttttttgtgatttccaaactgtgattttcctatctaagcctttgacattataccaagaacaggaagagtcctgcataagtgagtcatttatatgattgcatgtcacacataattataaaaattggtaattgatgccttattaatgaattttaaagtaagtttgtgagacatttcttcaaattaacaagaatatgggaaatagtttagtatagtctgagcccacctccaagtacctaatttcttactgatagcctagtttctcttggattcattcaatctctttcattctgattcctgcctccaggtgtcatttttcacttcatgtcacctgtttagacattctgcctcctttgtctcttcctactcctaaccagccaggacccactctccagattaacattcataaaacatcatttattctacttgagtgttcacagtgccttcttcttgctcaccacatcaagtctgaacttctttgcccagcttccagggctgtatgtcacctggtcacatgtagctatttatccattagccctgagcaggtcacctaccataatcatttcttttgctgataatgattcatctgagttatgaattgaattatgttaccctcacaccccacctcacatttacattctcattttaaccatgagcatctgagaatgttaccttatttggaaatagggacgttgcagatttaatgtgttaagatgagataaaatcatgctggaggagggtgacaccctattccagtatgatcactttcattataaaaaggagaaatttggatacagacacatagggaaattacactatgtgaacatgaagttatcaggtgaacatgaagacagagatcaggatgatgtgactttaagccaaggaaaaccaaaatcactagcaaagcaccagcagctaggtgaggagcatggaacaagttgtacttcacagccctcagaaggaaccaatcctgtcaacaccttgattttggacttctagcctccaaaactgtgagacaataagtttctgttgtgcaagacacccagtttgtggtactttattatggcagtcctagaaaactaatacaatctggcagacatgcctttagctttttggcttaacagtccatgatttaatcattcttacagactctgcttgatttttatcttctctgtgaagatttcctgatgaatttattgtgtgcatataattactttctcatgttctctttttatcttatctgactgaacgattagcactttatattggcttatatccagttgttcagctggagtatacaacacatcctcaaataacgtcatttcatttaatgttgtttcattataatgttgatgagaaaaaatatatatattcctgactggggccacagtctgtgtggagtttgcacattttccccatgtctgtgtggattttccctggatactccagtttcctccataccccaaagctgtatatggtagactcattggcgtatccaaatggccccagtgtgagtgactgtgggtgtgtgtgagtggtgttatgatggaatgacatcctggtcagggctggttcctgccttgtcccctgggctgcccggtcaggctccagccatcaccaaccctgaactgaaataagtgggtaaataattatcttacttgtttttttagtggttcttaaatgtatgtatagctcacgtttatttccatgtttaatattagaagtgttttggtctttagttagaagtttggtgatgtttctgtgaccagaaatatgctgaaagaacttaacccttatttacaactattattagcctatgttaaagttggttacattcgttatatgccatttcatttaaagttgccatttccaagagcctacctatgttaagcgaggaggccttactgtactttattatatactgtgttatttattaattcagatgtgttatttattcattcagaattcaatatatgtatctgtgtatacttccctcaactataagtgcctagtaatcacagcctgtttattttccttgaattctcacaaacttctaaaatagaggcaatgtagagcctaagaaagatttgtttactgatagtttgaaatgcttagatatgctgaactgatgggcaccattaggctgactcatcactaaagaatgactcagggcaagcactgagtttattgagttgtgtttatattatatataagaaaatctaatcatgatactgacttttgtagctaaaaagggattgagttttaaattgatttctattgggctttaaaaattattctgaatagtgcaagaaaaggaatttgttcattcataacattcattatttattaaattgtatgtgcactgattaaataacatacacattaaaaggacctcaactattagaagtttccccatcttcacaattgcttttacagaacactcattttttcccctaagatttgaattctacctaaaatttgcaaagcaactcacttcaacatgaaatatctggtatgtataaggtgcgtaataaataccagttgactctgaagatgggaatcttagtaaacatttgtttactaagcacatgtgatgtgccagagttggaatcctcaaacattaactaataagtttttgtatttagacatcttagacatctagttcaagtaactgttttttaaacttcatcgtttatatcaataaaaacactgatttctcccacctcattcctgtctttgtaatgctatcttttggccaatgatgcctcttctaccctctttcttgttctgcatttcagggaattctagcctatgtacaaaataatgtgagcaaaactatggttctttggaggcatttaaaatgcttttcacttatcatgggtttctgtttgtttttgaggcagggtctcactctgttgcctaggctggagtgcagtggtgcaatcatgcctcattgcagcctcagcctcttgccctcaagcaatccccccacctcagcctcccaagtagctgggcctacaggcatgcaccaccatgcctggctaatttatttttatttttttatttttaaatttttttggagagacatggtttcactgtgttgcctaggctggtcatatatatgatcttatttcctccaacagtcctatgatgatgaaagctttattgtaatctattttgactccttcaaaatcatttacccaggcagcaaacagtaaatttggggttcaaattcatgtcatctgtcttcaaattctgtggactttttctctttaccacttttaattaattttttagaggcagggtctcactgtgccatcatgcccggctaatgattttacttttggtagagatggggtcttgctttgttgcctaggatggtctcaaactcctgggctcaagtgaccatcccactcagccttcttaagtgctaggatcacaggcatgagccagtatgcccagactaattattgaatctagttatttttataagaaagagtagcataagatttttctttagaaaggcatttttaatcgtagttaactactttaaaaattgaatgctgcttcttcttttttttttttttttgagacggagtctcgctctgattctgtatttcatccagaaagcagctcattgccattagagaaatcatgtaaccaacctcctttgctccagcattttctccttctttccctccctctctcctttcctccctccctcccctctttccttccttcttttcttccttcctctctccctcctctttcctccctccccctctcttcctctgcccctccctcccttcctccctctcttccttccttcctttcttccttccttcattttttccttttacccctttggcctcctttcttctctttttttcagctgcttaccatctcacaactaacttgtttagtgatgaattcctgacataaccatatttgcatatgattaactgtgagatatagaggaaatctgaaaggattcctttaagagtaagatgagcgatagcctcacaaagttgctccaagagatatgaagggaaagctacagaatgcactcaattctctgattgcaaacccagcacacaagtccctgctggatctaatgggaggcttgctaacagctaggagaaataacctagagaactgagctctatgggattaattagggaactcgagcagacactgtcactttcaaaactgtcattaatgatgcactctctgtggtatatattatggtagaatttcttaaataaaaaaaaaaaagtctaaggatactgtattagtcagggttctccagaaaaacagaacaaacaggatgtgtgtgtgtgtgtgtgtgtgtgtgtgtgtttgtatgtgtgttgtatattatatacatatgtgagatttattattataaggaattggctcacatgattatggaggttgtcaggtctcaaaatctggagtgggtaagctggagactcaggagagccagtggtatagtttcagtctgagtccaaaggcccgagatttggagactcaatgatataagttccagtccgaggttaggagaagaccaacgttctaattcaaggactcaggcagatgaaatttccctcttactcagtctttttgttctattcaagtcttcaattgattgtatgaggcctgcccacgttagggagggataatctgctttactcagtctacagattcaaatgttaatttcatccagaaacaccctcacaaacacacccagaataatgctttaccaaatgtctggttaccacctggcctagtcaagttgtcacataaaattaaccatcacaggtaaaatttaaaagagaaagagagagaagagcaaaagtatttctgatgtttccaaatgtcatgacttgaccttttaatggcttcatctatccattcaaccaagtggaaaagttgctacataaaacagctttcaggattaatatgatatatggaaacattatttttaggctttgaggaacatctgtgtaacatatttacaatactgaggaaataatggatttattttttcatgagaatcattccttcttcaattaaagaattttgttatggaagttctgaaaatccctactaagtgacatagctaaatttgaacttgcattagctattcatctgggctcattcatcatttactttctattgtgcttcaactttctcagactcaaaacaatttccattcatttctaaacttgaacaccattaagacattcaaataagagaaaaggacattttaaaatttgaagcaaaggtctcctttgataggagaggattttgaaatttataaatgaaacctgataaagatgaaaccgttctaaatttcttcttaggcgtggtttctcatacaaagctaattgaagacacaatcaatgctatccatatacaggcataccttggagatattgctggtttgtttccagaccactgcaataaagctaatattgcaataaagcaagtcatatagactgttttgtctcccagtgcatataaaagttatatttacactctactgtagtctaagtgtgcaatgtcattatgtctttaaaaatgtatgtatcttaatttaaacatattttactgcaaaaaatgctaacaatcgtccgagccttcagagagtcataataatatttttgctgatggagggtcttgcctcaatgttgatggctgctgactgatcaaggagatagttgctgaaggttaggatggctgtggaaatttcttaaaataagataacgatgaaatttgtcaactgactcttcctttcatgagagatttctctgtagcatgcaatgctatttgatagcatcttatctacagtagaacttttttcaaaattgtaatcagttctcttaaaccctgctgctgctttatcaactaaatttttgtgatattctaaattcttggttgtcatttcaacaatgctcatagcatctttaccaggagtagatttcatctcaagaaactactttctttgcttattcataagaaacaatttctcatctgctcaaattttaacatgagattgcagcaattcagtcacatcttcaggcttcatttctaattctagtactcttactatttccactacatctgcagctactccctctactgaagtcttgaaccactcaaagtcatctatgagggctggaatcaacttattccaaactcttgttagtgtagttatcttgacctcttccaatgaatcacaaattttcttactgtcatctagaatggtgaatcttccccagaaggttttcaacttactttgcccagattcttgagagaaatcactatctatggcagctatagtcttaagaaatatatttcttaagtaataagactagaaagtctaaatgactccttgattcatgagctgtagaatggatgtagtgttagcagccatgaaaacattaatctcctagtgcgttgccatcagagctcttgggtgactaagtacattgtcaatgggccacaataatttgaaaggaatacttctttattctgaacagtggactttaaatctttagtaaaacgtggtataaacagatgtgcggctgtcatctaggcttcattgttccatttatagagcataggcagaatagttttagcataattcttaagggccctagggtttttgaaatggtcaatgagcaatggcttcaacttaacgtcaccacaactgcgttagcccctaacaagagagtcaacctctccttggaaactatgaagccagcattgacttctgtctctctagctgtaaaagttctatatggcattttcttctaatagaaggtcattttgtcttgattgaaaacctgttgtttagtgtagctaacttggccaatggtcttagctggatcttctgaacaacttactgcagtttgtacatcagcgcttgctggttcaccttccacttttctgctatagagatggcttctttccttaaacataatgagccaacttctgctagctttaaacttttcttctgcagcttcatcacctctctcagccttctagaattgaagagggttcaggccttgctcttgattaggctttggctcaagggaatgttgtggttgattttatcttccatccataccactcatactttctccatgtcatcaataagaccatttcactttctataattcatgtgttctgtggagtaacacttttatattccttcctttgcatttacaacttggctaactggctccagaggcctaactttcggcctgtattgactttcaacatgccttcctcactaagcttcatcatttctctgttttgatttacaacaagagacgtgcaactcttctcacttgaacacttattaattggcctaatttcaatatcgttgtatcccagggaatagcgtggactgaggaaagggggcgagatgggaatggccagtcagtagagccatcagaacacacacagttatcgattaagtttgccatcttgtatgggcagtgttcttagtgccttaggagaattcgaatagtaaaatcaagaccattattcacagataaccccaacagatgtaatagtaatgaaaatttttgaaatattatgggaatttccaaaacgtgacatggagacatgaaacaagcacctgctgttggaaaaatggtgctggcagacttggtcaatgtagggttgtcacaaaccttcagttcataaaaagcacattatctgtaaaaggcagttgaagtgaactgcaataaaacaaggtatgcctgtattcttctttttaaacagctccccacagttgtatgactttcatggtcagctgatttttcccccctcaacttaatgacttacctataaaatattcataatcaagtctattagagatcatgattgctttggatgctatatagggaagaaataataaattaagtcatcaattagtgatatagctgtatgttaaatagcactaggaacaagcacttttttctgaggtggatctataggttcttcttgggaatttgatttttgattggcttctatcatcagaaataatatagagactctttattcagcattcatttattcacagtatttgttaagcacacactatgtaccatgcatataataggtgttggtcatatagtcatgagcaaaaccctcctactaaaccgctgccttcatggagttgacttactagcagaggtgacattctaaaatctctgcccattttccagatgcaggaggaaatgagaattgtgattgatgtttttgtgctttgttaaaaataagtaatcctgtttttatactcctttggcagttttttttttttcaagacctcagtgtttgaggtccaacatgtgatccaaagaccagcaacatgggccaccatctaggagcttgttaaaaatgcagaatcttatactttatctcagtccttctgaatcagaacctgcatgttaacaagatctccaggtgatttctgtgcatacaaaatttgaagagagcaggtttttggtgtagagtttattaatttatcatcttaataatttagtggctatctaattcttttcagctatatgctcaactggagaggaattttagtgtttacgttctcagcttattttcatcagtataaaatttggttttctaacactgtatcttagaatgtgtttcaggctgcatcaaaaccacctgaggatcttatgaaaaatgcacattcctggacacaaccttaatattgcttgagtaggtcagggttgggtctcaaatttttacaagcttcccaggcaattcttatgcacattaaagtgggagaaggactatttttaggctagttttacattgatgtctttctaaggatggatttttaaaaattatttttgagtctttagtttatgtgttcctgcctagaaagatgaattattcgatctccgatcatatattcctgtgtatcagagtgttttttgttttaaccagggtttctcaacctcacactgttgacgttttgtactagataattctttgttctgtggggctgtcctgtgcattgtaggatgtttagcagcatccctgatctctacccactagatgccagtagtacacctgtgccagcccacattcctagctgtgacaaccaaaaatgtttgtagacattgccaaatttactctgaagagcaaaattgctctcagttgagaataattggtttaaactaaataaagaaaaggagcatggttgtatgtgagtatgactgccaccccaagtatctattgttactatttgattctcttgagggcttatgccaagggtgaagagaaatgtatgtatggggacataagggctgcctggccctgtgggttggtttcaacactctatggtgagagagatataatatgatgatggggaagaggaaaaactcttacatttagtacagaaacaaggctactgaagaacctatgggctaaagaacaaaacaaaattaggtataaaaacttttattttttcatttttgagtctttctgaatatgcttctgaagactgaagatgctttgtattatataaaatgtagctaaagcattttatataatagctttgtggacgagatctcctttcaaagggacaatagggacatagaaatatgtactagctttggcagagactcagagtacatggaaaaggcccagaggatggccaggggcagggtagaggggagtggcagtatgtaagtgttgatttattcctgaactcataggaacaccgagtgcactcagaagtaattggggagactttgaagggcaacctcagatttattagcagccaggaaaatttgtatccacagcctgtaatattattgaatttctggtatgactttgagttttgtttggcccactattcttaacagattgcttacctttgcatttcttcgtagtgtgatggaaacatttactagccaccaatgttaaacaagtatttataattgttactcttttactagtcagttgtgtggatactgaaaagtaaataagagcaaataacttattttggacacattccttgtacatagtcattctagtatgtgaatacacactttgcagatttatgtgtgcagccaactataattattttttaaaaatgccaaatttggagatttaacacgcagatgaatgtaaaggatttgtatggatcaaatcaaaatctgtctatctgtgacaaacaagcgcattgctgatgtatggaaagaacattgcccaagaagacttgaattcttacctctgctgtttactaactgtgggaacttgcgaaaattgtttaacatctcagagcctcagcctcctcgtctattaaaatgggggacatttttcttatgaggttgttagggaagcaaagattaagtacgattaaaaatgtgaaaatgtcttccagaaaaataagtcagtaaaagtttgtcattaagcttgtatacttcacatgtatttattattgtcagtgtatcagttaattcattcaatattattttatttttggaactaaaatattaatttactggaaactagagacaacaggactcttagagtctgtataatgatattgtcatatatttgaagccaattataatgaaatctgtagctacttcagtaactaagttaccatgggttatttccagaaccaaactgctttatgccaagttcttttctggtctgaataatattctaaccagtgcttcaatatagaatatgtgtaatttgttctcattttgaaaattatatgacaagtctttaaattttactatggggattcatgttatttttctgtaaataaatagcaggttaaaatacttgataattacattgcatgaagttgtttattaatattagagagaaattgcttagaattaagcaattcattttaaacaaattagttgcaggtatcttatgtgatgcagccatttattatcatttttcattacagaaatgcaaattattaaaaataataaattgcctccctggaaaggaatccatttgaagtaacatataagacaccacatgattaacagctttaaaaaatctaattgatttaaaaagtctttttgcaacttcattaagtttaaggtcaggtatgcatagagattaaattataaataccaactttatcttttcttctaagaaatacaactcacatgttctggttatatttgttgaaagtcctgaagtcaattaacaactgcttgcttggagtgaaacataactcttagcattccttttgctttctcttcctctatccattagctttcaaaaagaagaactaactctagtataaaataagattatcacgaacaccaaagacatctgaaaaaaaggcttggagataggaagtggaagcttgggcctggttaatgacaggaaaaccttttagctagaaatatataagaattgcacaaagagggggaggagccaagatggccgaataggaacagctccagtctacagctcccagcgtgagggacacagaagacgggtgatttctgcatttccacctgaggtaccgggttcatctcactagggagtgccagacagtgggcgcaggtcagtgggtgcgcgcaccatgggcgagccaaagcagggcgcggcattgcctcactcgggaagcgcaaggggtcagggagttccctttcctagtcaaagaaagtggtgacagacagcacctggaaaatcgggtcactcccacccgaatactgcgcatttccgacgggcttaaaaaatggtgcaccaggagattatatcccccacttggctcggagggtcctatgcccgtggagtctcgctgattgctagcatagcagtctgagatcaaactgcaagggctcggggaggggcgcccaccattgcccaggcttgcttaggtaaacaaagcagcagggaagctagaactgggtggagcccaccacagctcaaggaggcctgcctgcctctgtaggctccacctctgggggcagggcacagacaaacaaaaagacagcagtaacctctgcagacttaaatgtccccttctgacagctttgaagagagcagtggcgctcccagcacgcagctggagatctgagaacggacagactgcctcctcaagtgggtccctgacccctgacccccgagcagactaactgggaggcaccccccagcaggggcagactgacacctcacacggccgggtactccaacagacctgcagctgagggtcctgtctgttagaaggaaaactaacaaacagaaaggacatccacaccaaaaacctatctgtacatcaccatcatcaaagaccaaaagtagataaaaccacaaagatggggaaaaaacagaacagaaaaactggaaactctaaaaagcagagcgcctctcctcctccaaaggaacgcagttcctcaacagcaacggaataaagctggagggagaatgactttgacgagctgagagaagaaggcttcagacgatcaaattactccgagctacgggaggacattcaaaccaaaggcaaagaagttgaaaactttgaaaaaaatttagaagaatgtataactggaataaccaatacagagaagtgcttagaggagctgatggagctgaaaaccaaggctcgagaactacgtgaagaatgcagacgcctcaggagccgatgtgatcaactggaagaaagggtatcagcgatggaagatgaaatgaatgaaatgaagcgagaagggaagtttagagaaaaagaataaaaagaaacgagcaaagcctccaagaaatatgggactatgtgaaaagaccaaatctatgtctgattggtgtacctgaaagtaatggagagaatggaaccaagttggaaaacactctgcaggatattatccaggagaacttccccaatctatcaaggcaggccaacattcagattcaggaaatatagagaacgccacaaagatacttctcgagaagagcaacaccaagacacataattgtcggattcaccaaagttgaaatgaaggaaaaaatgttaagggcagccagagagaaaggtcgggttaccctcaaagggaagcccatcagactaacagcagatctctccgcagaaactctacaagccagaagagagtgggggccaatattcaacattcttaaagaaaagaattttcaacctagaatttcatatccagcaaaactaagcttcataagtgaaggagaaataaaatcctttacagacaagcagttgctgagagattttatcaccaccagggctgccataaaagagctcctgaaggaagcgctaaacattggaaaggaacaaccagtaccacctgctgcaaaatcatgccaaaatgtaaagaccatcgagactaggaagaaactgcatcaactagcgagcaaaataaccagctaatatcataatgactggatcaaattcacacataacaatattaactttaaatgtcaatggactaaatgctgcaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaggccattacttaatggtaaagggatcaattcaacaagaagaactaactatcctaaatatatatgcatccaatacaggagcacccagattcataaagcaagtcctgagtgacctacaaagagacttagactcccacacaataataatgggagactttaacacctcactgtcaacattagacagatcaacgagacagaaagtcaacaaggatacccaggaattgaactcagctctgcaccaagcagacctggtagacatctacagaactctccaccccaaatcaacagaatatacatttttttcagcaccacaccacacctatcccaaaactgaccacatagttggaagtaaagcactcctcagcaaatgtaaaagaacagaaattataacaaactatctctcagaccacagtgcaatcaaactagaactcaggattaagaatctcactcaaaaccactcaactacatggaaactgaacaacctgctccggaatgactagtgggtacataacgaaatgaaggcagaaataaagatgttctttgaaaccaacgagaacaaagacacaacataccagaatctctgggacacattcaaagcagtgtgtagagggaaatttataacactaattgcccacaagagaaagcaggaaagatccaaaattggcaccctaacatcacaattaaaagaactagaaaagcaagagcaaacacattcaaaagctagcagaaggcaagaaataactaaaatcagagcagaactgaaggaaatagagacacaaaaaacccttcaaaaaattaacgaatccaggagctggttttttgaaaggatcaacaaaattgatagaccactagcaagactaataaagaaaaaagagagaagaatcaaatagacgcaataaaaaatgttaaagggaatatcaccaccaatcccacagaaatacaaactaccatcagagaatactacaaacacgtctatgcaaataaactagaaaatctagaagaaatggataaattcctcgacacatgcagtctcccaagactaaaccaggaagaagttgaatctctgaatagaccaataacaggctctgaaattgtggcaataatcaatagcttaccaaccaaagagtccaggaccagatggattcacagctgaattctaccagagatacaaggaggaactggtaccattccttctgaaactattccaatcaatagaaaaagagggaatcctccctaactcattttatgaggccagcatcatcctgataccaaagcctggcagagacacaaccaaaaaagagaattttacaccaatatccttaatgaacattgatgcaaaaattctcaataaaatactggcaaacccaatccagcagcacatcaaaaagcttatccaccatgatcaagtgggcttcatccctgggatgcaaggctgtttcaacatacgcaaatcaataaatgtaatccagcatataaacagaaccaaagacaaaaaccacatgattatctcaatagatgcagaaaaggcctttgacaaaattcagcaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggagtttctggccagggcagttaggcaggagaaggaaataaagggtattcaatcaggaaaagaggaagtcaaattgtccctgtttgcagacgacatgatagtatatctagaaaaccccattgtctcagcccaaaatctccttaagctgataagcaacttcagcaaagtctcaggatacaaaatcaatgtgcaaaaatcacaagcattcttatacaccaataacaggcaaacagagagccaaatcatgagtgaactcccgttcacaattgcttcaaagagaataaaatacctaggaatccagcttacaagggacgtgaaggacctcttcaaggagaactacaaaccactactcaatgaaataaaagaggatacaaacaaatggaggaacattccatcctcacgggtaggaagaatcaatatcatgaaaatggccatactgcccaaggtaatttatagattcaatgtcatccccatcaaactacctatgactttcttcaaagaattggaaaaaactactttaaagttcatatggaaccaaaaaagagcctgcattgccatgtcaatcctaagccaaaagaacaaagctggaggcatcacactacctgacttccaactatactacaaggctgcagtaaccaaaacagcatggtactggtaccaaaacagagatatagatcaatggaacggaacagagccctcagaaataacaccgcatatctgcaactatctgatctttgacaaacctgacaaaaacaagaaatggggaaaggattccctatttaataaatggtgctggggaaactgggtagccatatgtaaaaagctgaaactggatcccttccttacaccttatacaaaaatcaattcaagatggattaaagacttaaatgttagacctaaaacaataaaaaccctagaagaaaacctaggcaataccattcaggacataggcatgggcaaggacttcatgtctaaaacaccaaaagcaatggcaacaaaagccaaaattgacaaatgggatctaattcaactaaagagcttctgcacagcaaaagtaaccaccatcagagtgaacaggcaacccacaaaatgggagaaaattttcacaacctactcatctgacaaagggctaatacccagaatctacaatgaactcaaacaaatttacaagaaaaaaacaaaaaaccccatcaaaaagtgggcaaaggacatgaacagacacttctcaaaagaagacatttatgcagccaaaaaacacatgaaaaaatgctcaccatctctggccatcagagaaatgcaaatcaaaaccacaatgagatatcatctcacaccagttagaatggcaatctttaaaaagtcaagaaacaacaggtgctggagaggatgtggagaaataggaacacttttacactgttggtgggactgtaaactagttcaatcattgtggaagtcagtgtggcgattcctcagggatctagaactagaaatagcatttgacccagccatcccattactgggtatatacccaaaggactataaatcatgctgctataaagacacatgcacacgtatgtttattgcggcattattcacaatagcagagacttggaaccaacccaaatgtccaacaatgatagactggattaagaaaatgtggcacatatacaccatggaataccatgcagccataaaaaatgatgagttcatgtcctttgtagggacatggatgaaattggaaatcatcattctcagtaaactatcgcaagaacaaaaaaccaaacaccgcatattctcacccataggtgggagttgaacagtgagaacacatggacacagggaggggaacatcacagtctggggactgttgtggggtgggcggagaggggagggatagcattgggcaatatacctaatgctagatgacgagttaatgggtgcagcgcaccagcatggagcatgtatacatatgtaactaacctgcacattgtgcacatgtaccctaaaacttaaagtataataataataataaataaaataaaataaaataaataaaaataaataaaaaagggttatgccaacaacaacaacaaaaaagcttttaagaagctcttaaaagtattactgctcatgattaaaacgtatacagtgtttcaacgttaaaaaaaaaacaaaactagtcaaaaactgctggaaataggatgactagatatgcaaataaagtagacaaaatataagaaaagacataaaggatccatataacatagtaagagaaatggtgtatatatgtatattgacatggatatgtatgactatccaatgaataaatatttaagacaataaaagaaatttcttatctcatctaaaagaaaagtttacgacaataaaaaaataaataaaataaaaataaataaaatggatttggttcttaaaaaaaaagaattgcacaaagaaaataagtttagctttgattaaatagtgctgacatcatatttgagatctgttgtgaaaacttgatgctgtgggaaaaacaatgaaatgacattgtcaaagcaacatacattgtagtaaatgttagcttcattattaatataatgaatagaaataagaataagtttttaggggacaacaacaataactgcgatttgggggaagcaggtaagtacaagttaaatgaatgtgagagagaacagggagatatttgagttttgtgatggagaaagacctggcttctttgagtcaattattattccacagaaaacagagccccatgtgttttgacacaagagacagttaggaaattggtgctggctttaatgagtgtgaagcattggtgaagaggcgggcattatggttctgaattgtgtgtcttgttcattggtatgatataaaaatagatccctgggattttaataatacatttgactttcatttttactttaaattcaaaaaacagctttaattacatttttaaatttcctccaagtaatttttctttaatatgaagaatgtattcccaaatagatttttaaaaaattgttcatatcttcaagaggaaatgtagtggtggagaaatgggacttaaattgtggaacatatatgtttgtgtatactgagttgttataaggtcctacttcctaatcaacattaaacattgattaagattgtcaaaactaacaatgcaatccagtcagtgatttatgtacaagcaagcaattggaaattggagtggctctgtatctttcatgaaaacactgatgtaatgttcaggttaatcgagcaactctggatgggtaacaatttgggtaattttatgactgcaatccatgctttctgacaaaatatatatatatttactaaattagtttctaatttttaaaaataataatccaccttcttggaaagaatgctgctattcaacttgatgaattttcaaatccagcatgacaagacaatcatttaaatgagactgtctgttctttaatttcaagcaagttggattcagccaagatacctactaactacccatgaataagcacagacaaaaagtgcagaagtagagacagatggaatccctgtggccagaggttagggaagatactatgtaggaattgagacttcatctgggctttgagatgtgactccaatttagattggcggagaagagtaagcaaagggaaagggcaagacatgttctggaaattttctacaacaggaggcttatatccaggagtgttagtagactaaactgcaaagatagggaccagcttgtggaaggacagtggctaataattagtgattctatgctggatttaccagacactaacttaaagcaggcatttgggaaacgtctcaacttcacaaaggttctgtggctgtgaaaaggggttactgcctgttctccccaggtcacaggatgattgtgagaattaacatacaatgcatatgaacatgcactgtacaaagcaaagtgttataaaaatgtcaggtggtggattcacacagctgtgtgttcatgctttgagtcctgtactccgcttggtaattctactgtgcatcccagcagagttttcgctcatttcctacaatgatgattgtaaaccttcaccattctctgaagcctttgactctaccagttctcttattcctgacagatgacttccttaccaatgaaacagaaacagacagtaacttcttcatcctcctgctccaatttcataagccagcatgccttacttccaccctttcttccttctccctagtttcagtggaatagaaacctctcctcccgggagtaataggtacgtgtgaatactaaatctcatctcttcctgtcttcagaggaaatttgcttcatctattatatcttcaaactcagttttcaatttcgttctctctgtttgctccttcccatcagcatttaattatgcttaatctctcccttaactctacatcccttctagtttttgtattattgccgtttcccctttatagctgaatctcttaatgtaatgattttttctcacagtcttcacttcttcatctcagactttctccttaacccacttcaatctagacttgtcatcacatatcccctccgtactactctcaccaaggtcactgataacttctctattgttaaatcagacaactttccatctgtattttgcttggcttctaggcagcaattaattctatcgacctctcccttcttccaacacttatttaccttgtcttcatgatactacactgtattgatcagggttttgaattgcaaacaacagaatccactctgacgttttaagcagaaaaggaatatgttgaaggacgttaggtagctcacaatgcatgtgggaggactggaagacaggttaagatgatattcagccaagaaaatacctattacatcttggtacaaatcccactacctctaccttttggtatcaacaccacaactcacataaatgttgtgaacgttcactgatgccatccaagactggactccagaagtgaatgccatggcgaccatgctaaatgctgatatgccttctctattatgcttgctaaattttgcaacctgcaaggttataaagttatcttctggattgaatttttgcatgagtgctcccatttggtagtaccaggtcactagtttctaaggacactgaaaatttgagtttcctttcttgaagaaacaaagatttttccaaatataggtgtgttcaaaaggtgatgactgcctaccgttttgacatttgtctctccaacactcctctagttttgctgctacctctctgagcaatttttctccacctgctttctttacttgtcacttaaatgtccaagtcccccaggtatccattttaattgttttctgctcattctacatcctctacctgtgtgatactgtctaacaccatggctttaattacattctttgtgcctatgactctcaaatcttgatctctagcccagtgctgtttcctgagtaagctctagacccacatatctcactgcctctgggacatttttatctggatgtgtcataagcatctcaaattcaacctgtttaaaactatgcttctctgtagctcaattgcagtcctccagttccctacactatggacccacccagttgtttagttaaaaaagaaggatattatctttgagagcatccctccctaatcttcagacatccagtcagtgccagagtgcaagcaatattagatcccatgtattttttttaatctgcctcactcctttcatgttctgcagtcatagttacaagaactgaaactagtatcaagtgagcttcctcctagcttccagttttactcttctctaatttatcctctaccatgcatttataaagatattgtttagcaataataacatctcatgtccctgctgaacacccttcagaggaaaagcacaaacacatatgcccctatgtgtatgcttaaataggcatagaatatgtctggaaattgcagaagaaattgataccagtggttgtctcagggattaggagtgggagaactgagtgactatgactcagatttactttcatggtacactctactgcatcttttacattttacagcatgtgtatatatgacatgttttagaataatttaaaaaacttcagtgattaccattgattatatgataatgtcaaactctcatatagtgtgtaagacctccacacaaatgcagctcctgcgtacttcattaggtgcattgagtactttgctatccttcaagcataccaaattctcttaatttccaacattcttcgcatatagtctccttgtttgaaatgctcttttattgcatctcacctggctacttttcctttagtcctatgcttagatgttaatttctccctgtttgtaagactgggtttggagccctcactttgctttccagatggcgctgtccttctcaaactcccattccattttttaaaattactagttgtctcttttgtcagatcctaagctctgcaaagacagatactgcatctgtttcattcaggctatgctgttggtatctaagttattatagtaccttggacatagtaggaagtcagaaactattatatggacaaatctacacatgcctttgttccccacattccacattctctcatttttctccatgtgtgttatttatgatacactctcaaccctgtctgagattttcctagtgcatgtctctattttttttaattcaggaatcccaaagctaagaataatatattctatcaagactagcaagaaagctgatataatgccagagctttcactctttttgaggaatgtaccatacaatttacaatgaatgaaattacaaaatgaatgaagcaaatttgtggccattattttgagatgtcaagaaaatcatatgtttcagtcttatccttcaatcatacattcagatgaatacagtttttaatacatagaaattaatatatggtaaacaaactcattaatgccactgactttaaagcatatgatagctggcagttcctttcagtgttagcttatttgtaaatgatattttaatttattctttactggtatttcactgagcagcctacttaaacttagaaattttatatttaaaaaaattcttatcttcccaaatgttactctcaaatctctttccagaattacatttcttagaacttagtctttatcctagtttgtgaattattttattgatatctttgccaactttgccagccagtatttcacagctggtgagtcaagacttagcaataacccatattgatctgtattatttttcaatatgtggagtctttgcaattgagctgcatgacttcaagattttattgggtgatcaagaaggcattagtgttcattaacatactaatataatctttttacaggatataatcaagataaatgtagctttggaaatacactatactttaaaaaacaaaacagcaccagtgacatcctaggtataatgtggcaggaaagggagtgtcatgcctgagtgctcactgcctctgagactcgtctggacgttgagtccatagactaattttaaacctggggtctagaaatgttgctcttgttatggctgccactcattaactatataagcctgtcctagagggatcttccaaaaacacagatctgattcagttaatcacctcttaaaacctttcccattttacataggatgaagtccaaattctttaatatggctcacaaaagctttgtgatcccatacctgcctcctctttaatttgtttctggcttctctgtgcctctgtttcttcaattctaaattactggggttagatgatttctaaagttcctctcagatctaaaaatctatgattccgaataattacaaagttggcctcatctttcaaataggataaaagggaatttataaatgtataaattctagtttctaaaatagaccagcttgaattatcctggggcaagagaagctgttcaagtataagaaacactgtttacttttgctttttaaatgtggtagaatatgactgtatagcttacaaaatcctggagaatcagaaaccactgcagccacatagatgacgttccctttgttggaattgcaaagttttgtggctagtagtgacttgaaaattatcttttaatgatgaaattaaggtctgaagggactaaatgcttgtcaggtttgtaataaatgcaggtccagagttcaggcttctttattctcaccccacttttcctttactatgcaagactgtttcaccaggatggcttgtatttgctattcatacaaaagcccatgtctaagtaaatgcccaggcagtgtgctcagaagacaatgaattcactctgccacgttgagcttcacatcagaccattgtaaatgaggacactttcccctttgtccttttaaaggaaaagccataaaaagattcactgattcattcaacagatatttattcagggccagcctttgttgtggacaagctctctaccctcttgaatcttatattccaaaggacatagctagcagatatattaaaaaaaacttaataaaatactttcagataccaatgaagataccatatgaagaaatttggactgggtagattacttaagattagtaaccacttaagactcggacttttattaattcataaaaggtcttcttaccttgaatgcacttcttaccaattcctcagttatgccattttaccaactctcataagatatacctatacctcctccctacccgcttcttccaaatgctttaatgtctttatatcactacaaagacagtgctgtcctcgtatttgttggtcatttaaatacattcacattatgtcccctttcccataattgtatttccattattttcctgcacaaatgctaattaaatggattatttattgttcctgaacatttcatgtttttgctccttctgcagcaaaataacatgaggtcttacattataagtgaaggggatttcttcaaaatccacctgaagccctgccacaccgttatattttccctggatatctctactcttagtcattaacctttctctgaatatcagtccctgtaggatttgtgtgtgtatgtgtgtgggttttttggcacttacaatgtaggaactcatgttgttattcatgtaaatatatcttggatttttaatttcgctatcagcttctcaagttggtaggagggggcagagtcagaaaattatttatatcaccagatataaattcccaaatgtgttctgcattaatgggttctcagaacaaataagcactgtgttttaaaaaaagtctgttgctccctattcaatgcacaatgtatatgtttctgttatatagtatgcatcactttataatgttatcatgtatatgttattttctccagctagaatttatctttgtcacctaatgcagtacttggaacatagtgcatgtccattatatactcgttgagtaaatgaatgaagtttttttttttaaagtgtctcagagctcataattagcttatgtacattatgagtgtttagaaggcaactaggaagaactatagtaatatagtggtcttgaaacttatttgaccatgtaatattttgttttcaaggaaccatgaacctctattagagatattgctctttaagcaatgctgcttgtgaaatgctggcttcaaatatagaaggcagctaactggttgacagtgataatgatcatcatccatttcctggattgtaagcccttttaaggcagggtctatcccttaactctgtaataaattttggatgggatgcgaaggtccatgtggcccagtggggcactctttgtttaattctctacaacataaccagcttatgtcagaatatttctacttggcagcctaatcaaaacctgtgcagttctttctgcttagtagaaagtcataataagtcaaaacctacccctgatactatccacttgtcgctgtggttctaccccatagggccatcagaaaatccaataaaatgcctttgtacatagaatatactcagtgaatgtgtagagaattgaaaatgaattgtgagaatttgacttatattaggtttttgaattgggatttggaactaaaatacaccctggactaaatttgacatgattttccaccagattactttttagtcatgccatttttatgcctgtaaatatctgtacatgtaaatggaaatgacttttatgtaactttgcaatttcagtacataaacgcaactctttggggagttcttcctctgcagacagggcgtgagaaatcaaaaaaggcaagcggcaattagatctacagagttatggtggtattttttgctatttttacttcgctctgtctcacaacactactccaagtaataggctgacactttagatctcttggtcatgaatcttatatgtctatgagatccaaatcattgagttcgtaaaaggtttcatattcaatagcctttttgtttttgctttatgatcctacgtggagttttctctgaccctatgatagcttaaaagggaaacatctataaaagaagattggacaagtcactgtctcctaagcctctgggatgtagacccaacactgaacattgagagacagtttttagaaggccaatttactcttgcacaatcatctccatttatgtttataaataaaattatccaccattgtggctgtaaatagggtcacattaacagaaataattctaattcactggctcttttccccacctctctcacagaactttagtgccatcaaagttcccatctcttaagtattcttgggagatatctgaggtatttcacacatacttatgagttcaattaacaaagtttgatagctacttctgctggggtaggctacatctatggtagtagtccccagtctttttgcctccagggactggttttgtggaacacaatttttccacggaaccaggggtgagggctctggggatggtttcgggatgaaactgttatacctcagatcatcaggcattagtcagattcttataaggagcacacaacctagatccctcacatgaacagttcacaataggggttgcactcctataagaatctaatgccacctctgctctgacaggagaaggagctcagacagtagtactcacctgccactcacttcctgctgtgcggcccacttcctagcaaatcagggactggtactggttcgccatcccggggttggggacccctgttctatgggatattattttgtctttggagagagttatgttgcctaatgtaattaacgtttgctccagctgggactcactgtcctgttctagacactgaagctgctttcctatctgtaccaggaactatcatctctcaccaggaaccacttttgtttgaggaaatgccacagtgtgatcaaaataattcctctctctgataaccagggtgttttcactgaattgtttcttataattggctctttcatccccatgggtaaattgttcatatctttgtgcacatggacttgttgatgggaccctctctagctcacaagcttaagcccaggggactcctactatggctttcagagggtctgggtctaattaagcagtaaagccattttgtctttggattttctctgttgggagactttttattcccgatccagtcttgttacttgctattgatctgttcaggttttttatttctttctggttcagtcttggtaggttgtatgtgtccaggaatttatccatttcctctaagtttttaaatttattaacatgcagcaattcataatagtcttttatgatcctttctatttctgtggtatcagttacatggtccccatttttgtttatctggtcttctctcttttattctttgttattctatgtaataatttattttatctttttaaaaagccaacatttcattttgttaattctttgtattgtctgatagtctctgttttatttctggtctgatctttgtcatttcttttcttctactaatttgggtttggtttgttctcacttttgcagttccttgaggtgcattgctatattgtttatttgaaatatttctactttttgatgtaggcatttattactataagtttccctcttagcgctgtttttacagtatcctttaggttttgctgtgttgtgctttcattttcatttgcttagagagaactttttattgtcttcgtaatttctatattggcccagtggttgctcaggaacatgttgcttaatttccatgtatttgtacaatttctagaatttctgttgttattgatttctagtttaattccattgtgttctgagcagacacttgatatggtttcaatttttaaaacttttggagacctgttttgtggcctaacgtgttctatcctggagaactttccatgtatcggtagaggaatatttattctgcaactattgggtaaaattttctgtaaatgttaactccatgtagtatgtagtgcagattaagtctgatctttctttgttgattttctgtctatatgatctgcccagtgctaaaacgagggtgttgaagttcacagctattgttatattggggtctctctctttagctataatagtattttctttatataactgggtgctcttgtgttaggtgcgtatacaattacaattgttgtatcttcctactgaattgattcctttgtcatctatattgacctactttggccctttttatgttttttaacttgaagtcaatttctgatataaacatagctactccttcacacttttggttttcatttgcatggattttttttcgtcccttctcttttagtctatgtgtatctttatagatgaaataggtttcttgtacttgcatcttgttttttaatacattcagctgttttatatcttttaattgatgaatttaagccatttactttcaaggtttttattaataggtggggatttctgtcatattgttaattattttctgattgttctacatattctttcttcctcttctgttgtttactttacaatttgatggggtttttttatagtgataatatttgactcctttctctttcttatttgtatatctgctctaccagtgagttttatactttcttgtgttttcatgatggtagatatctttctttcactttcagatataggattaccttaaacattttttgtagggctggtataacgatgatgaattatttcattattttctcatctgagaaagaatttctttacccttcatttttgagggatagcttttctgggtatagtattcttggctaccagttgttgttgtttttctctttcagcactttgaatacatcactcccttctctccaggcctctaattttctgctgagaaatcaaggtagtctgatagggattcttttatatgtgacttgatgctttgttcttgctgtttgtctttgacttttgacagttttactataacgtgccttgaataagaccttgttgaattacagctatctgggaatctttgagcttcatgtatctggatgtttagagttgggaatctttcagctgttgtttgttaaataagtttttgatgcatttgttcatctcttctccttctggaactcccaaaattcaaattttagttactatatagtttcctataggacacctaggctttcttcatttcattttattcttcttattctgttttatttcttttgatttttggtctgactgagttatttcaaaagccctgtctttaagttcagaaattctttcttcttctccttgatctagtctattgttgaagctattacattttttattttattctttcagtcattgccttttaggatttctggttttttctttttatggcatctatctctgttgaatttcttattcaaataatgacttgtttccctgatttctttgtattgtttatctgtgtttgcttgtatttcactgagtttctctaatgtctttcttttgaattcctttttagacattttatagatttcctttatgttgggatctgttacttgataattatgatgttcctttggagatgtcatgtttctttgttttttcatgtttcttatgtctttatgttgatatctgtgcatgtggtgtaacagcctctccttccaattttatggtttggctttagtagggaaagacttttttctatagatgtgtacgtattgttggtttagtaagatgcttttgctttgattctgggtaggcacaatattgtagtctgtatgatttatcgggctataattagtatcattggtatctatgagttcctcagtgacttaagctgtgattgttagtggaggctttggtgatgctttgctgggaatgggaatcctaggtgggctggtccctgggcaccagtggtgcattggtgggctgggtgtggctagtccttgggccctcagtggccttcatgggcaccagcagtggcagatatgggtgggcctgttcttgggcctctgggtggtgtgctcaggttctggtagttgcagtggtgggccaactgagtgggtccttgatcacttagacagcatttgtgacactgatggtggcactagtggcagttttccaaccctcaggtctctgagccacatgcccaggtactaacggtggtggcagtgggttgggcatgctggtttctgggttccctaagaggtacatgtgagtagtgatggtgggtggggtaggcctgtccttaatgtccctggatagtgtgcgtgtattccagtggcagcaggcatggcgggcctatacccaggctcctggccagcataagtgggcagtgtgggatgatgtccagattgtgatagtgcacgtgggcaccagcagtggtggcagcaggagagacaggtctctcaagaaccatgatggtgcacctgggccctggctgtggtaggtaggatggatcaatcctcaggtccctggataaagcatttgggtgctgatggcaggggcattgggtgggacaagcctatcctcagcccccaggagggcacatggccagtcctgaggtctcctaaaggcaagtatgggtacatggtagccctgctgctggagagggcaggatcgttgtcattggcagtgaccctgggcaggcggctctcagtttctagggagggtacgctttggcttcctttgtcccaggggttgcttcctcagtgtgttgcatcatctattccccagtgtgtaggacattgtgtggactagagtgctggggacccgcttgcactgatgggtccagctggtattatggcagcatagccctctggatggatgtgaagggatgccatggtgctctagggatgtagaaaagcaggggcttttgggcctcaggacaggatgttgtcttttgagggatggcctctcaaaactgcaccatgctgtagttgctttggtctcaggagggtttgtaggaccctatgtgaactccctttccggaacaatgccatcctatggattctaggcagtttcctatgctaggctcagggcctgtgagggcccagggtctcttttgtggctaggattatatgagtctgtggtaggaatgtggacctctgcagatctttcacttacctttcctcacaatagatagttcctcctggctttgagctgatcttgcctgggccaactgcttcacttctctctcccatgcctcagaggttctctgacactttcctgctgaatttcagagttatctgttagaaactcaatttgacatgtggctatctactcgctgttatgatccttgtctgtcgaggagatgagtaccaggctcctctagtaaacatcttgaatcctcaccctacttagtggtgattgttaaacttggttatgccttacgtcagaagtcatcaacttatgacctgtgagctgagccgaatctggctggctcaccatccatttttgtaaatgaacttttattccaacactgccaagttcattaatttacgtgttgcccatgacttccaaagtctagaaaatttactatctgtccctttacagagtttttattttcctgacccctgtattacactcatcatggagaagatttttttaaaaaaatcattgcatgtgttccaccacaaacaagtaaattagaatttggaatgggtttttggcaattggcccaagaactagtgtttttttgtttttgttttttaacatcccagatgaatatgatggacaaagttaagaaacactaatagataatttataccattgaggaatatgtgatttgtttgggagaaagaaatttataaaaattaataaaaatacaattgatgcatctataatggaaacatttacaaaatcctgaggtagcactgcgttgggagtattttagttcattagggaagtttttgtaggagggacatttaaatagattcttgagggattaatctaccggtaaacaagatccactgggatggtgtcagggagagaaggtatagcagttataagtagagagaacagtatgtataaaggatgataggtaagaaagagcaggtaggttagaaactatgtggccagaacactgagaggggagaagggagtgaggtcatcagatgtgaaattggaaaagtaaagaccaaaccaggaaacattttgtaggctcagataagaggtttggaatttattatgctgtccatggaattgaatagaaaattgagtttctctaggactcagttttgtccctctataaaataaatagttagctcagatgaatgataagaaccctacagttctaaaatatagattcctgagattatgtcaattatttcttttgacattctcagggcggggaacatagttgggcttacacaaatgacatggcccctgtagtggtgtatcacctagctatctcttatagttgatccatttctcttaacagtataaatgaattcagtgctactttgtggaatcattagaaggatatgagaatgcagacttctggatgggaaattccttgtctgaccaatgcattaaggtccttaaatacttgtaaaatgatttatgttctatgcagagagatgctattaaatgaggacagtttcattgtgaaatgtgaatgtgaaaattcacattcttcacaatgagtagcagtgcttcttatgggttagcatccagaagtcattatacatactcaaaactcagtgtgtgaattaccatgtaagatctttaatataatatcttattttactattttgtaacttctcatctatatcaggtctctattgtaactttatctgtatttagatacttactgggatagctatatgtctacttttatctctaataagcttgtgcaattggcttcatatctttaagtgaagttgttacaattctggtttatatcgaacactttattttcctctttcagggtctgctcaactgtacagaatagctggtgaatcaaacaataatatgtggcaggctctgtgattgaagattgcaggatactaaggcagcccagtctttgcattctgattcattttatcaagcataggcagatgaatgcgctgaaaatttcaaaagatatttagatgatggaagttaaaatagacagacttcttcaaaactccaagaagagctgttggaaaaaaactcatgatttttgtcatttgaacattaaacactcctagcaaaggagatatcatgaatgcttttctgaaatgctattcatttagtaaatacttccctctccctaccaaagaaaattatataggagctccagaatattgcccactgttgacctctttgtcctgtttttcttcacagacatcgatgagtgtgctgaagggcgccattactgtcgtgaaaatacaatgtgtgtcaacaccccgggttcttttatgtgcatctgcaaaactggatacatcagaattgatgattattcatgtacaggtaaacggtggctatttgtgaaataaaatatttttatgtcttaagtttacttttaaaaatttctttgactctcatttttttgataagtataccataaatacaacaaaacattagcaaaatcatatcttcttgatttggtagttatttcttaatctgttctaaagaaaaaaaacacctgcttgctctggataaatatatactccaatttggaagataaaaatcctaaaaaatgagtatatgctacatttatacttagtatttatgctcaaaatttgtgtgaaatactatggtcaatctgagaaacagtccctaaatgatatatgatgatagatttttgaatagaaaaataataacataaataatgtgatttttttcagagatagatttagagttctaggacatgggactattaaatataaatgagcttcttcacatgtctgagaagtacaattgagaactacatcaaagaagttttctatatttttgttgtatgaaataccactcttttagtatcatctaaagtcttgttagggatattgtgttagtagtgtctgaagttggtcctggcttggggtaatacagcatattccttttattctatagctttctacctgtagaatatgaaaacaaaacaaaacaaaacaaaacaaaacatgatgctagaagagtagcttgaatactgtaggatttgaggaaatgtgggtgtgaaacagaacatttcttttcatctctatatttttaaatagaagaaacaaaaataacatattttagaaaaacaggtagaatcataaaactggagagcacccaaaaatgttattcttgtcacctatttctctagctccaactttatgatctttatcaggtgcatgtataaacaaaacctagatgttttcagggaaagagactccataatcctccctagtaaaaatatgaatctataatagaagtatcactttgtctttgttttagttgtctgcttctaagtcttcattatagtgtccatactgtctgctaattgatagccttatcacagggaaggatcttcttctaaattcaaatatagtatttataaaaacaaaatgatggcattcaaaaagaatgagaagtgacttcccgatttatggaaaataactgaagatatcctggaggtagaagatatttaatataaaaatgctgatggatttacaaattcctatcttttttgtcagttcatcctaaacatttcctaattatggaaacaattcttcatttttttagacaaaatttaagtacattgagtggaagagtttcttgacgtaggactacagagatgcttttcagcataaaaagaatataaaagaacaaattataataaataaaaggaatatatcatttactatactattgataataccaataaatctgaatttccatttcatctttaacaagaaaactaagataaaactgctgcatcttagaatgcatatatttcaaggtgtgcttattaaaaatgagtgctagcagttccaggggagcccactgattctttggtattatagacttgaaaagctttgtgcatttttatatttcctaatgattctctttgtttttgttatattcttaaagtagtgttagaaattttaagtgaaaggacatgggacataatttggcctactgttgagtaaggagtatttctgcagggcaggatatttttaagagattcatttccattctgagtctgttggatataaatccaaggaatagtttagctttcatacatttacagagagtcttctgctttggcttcgcctctcccagtgcactttccttccaaataaaatcctacaaattaatgtttgtttttgactacttgggaggaattttcccttaccatttcaaagtatctaatgacataattgagaactattcctttgtaagaatgggaagggagtagaaaatcattttaagaaacgctattcagactatgatttttttatgcctaagaaaccagagccaagaatctcaggatctggcagatgataaaatgtatttctttaatgaggcactagcattttcaactaacaccactatttctatgctaccacttaaagaggagaaactttcttgcccttaaattttctctctattatgactaggtctatgaacacaaaacttggattttttttagagaatatgtcgattttatttttagtccagagtcaggtgaatattgccaaagcttatttttttttaatgttaggccttagaaggtcaacacatattccaggtttctgtaaagaaaatacatgttttcattttatgtcctgggattggctcccccacactttgatattagggtctgtacacaagtcttaaagaaattactcccctaatgggactttgccttgtgaccaaagtcttctatcctgttcctttttgagagctcccttaagaccagagtaggactttatttatcttataaaatattgagatttatttttttctaaattttagtaacagacacccacatacttgtagtaggagacgttccagaatgaatgtcaaaccatcactgctgagcctgtccctgatgtttgtgtccgagctcatggaattccatgtttgttttgcttctgtatccctgcccttctttcctgttaatgagccccctgctaacagaacaacagatactcccagcagactctcaaagttgcttatcccatgtggaaattaatcatagacattctaatttaaagaagattccaagagcaatacacattacttaataatcaagagctttgatcaataaagaagcctttttctgctttatttgtttaacctagtaactctggcatacaaattacatatgcaagttggtcaaattgcatattttttctttcagtttcagatgatttgagttagattttcctcatgttcataaaattttgtagatggaagaattattaaagataatctggttaaatcccttaagtttcacaaatgaagaaactgaggctcagagagattgctttatccatagttaaacatctagtgagaagcaaagggggctggaatatgaacctctttattataactcttatactattcactgtttgtctaatttgcagtcatacaaaagtaaagggaaatgattcatattttatgtagaaacacactattcaatacattatgttcattatttaaactactgtctttataggttatttcagttaattagcttcaattccaagagaaatttttaccctacagatcttataataatgaccctaaatcagaagttagtggaataaatatgaatcaccattttctgggcctctgactctattccaaagttgtggaaatgactcagttgcactatttgcacaaatgatgcatttgtttttgctcttctaaactcaatataattttcctttcattgaaggtgttattattttttctaattaatgcttcataatttctctctttacatcgtttcgtgttcctatagaaaaaatactgggtatcacaagggaagaaagacagagagagagaggagcaggagggagggagaaaagataaaggaaaggaagggggaagggagaacagagagagggaaatagagaagagaaaaatatggaagggaagagaaggaaagaaatggaaaagggaagagaaaagggaagagagtggaagagaaaacatgagccaagatgcttgaggcccattcttcaggatctctgcaaaagtaacctattttgtttatgcataacaaagtttcttgattacttatatggacgaatggctttttttggttcactcacgtaagcattaattaaattgggtagatcttcttgagttttactgggaatctcttcttggaactggccttgagtaatggaaaaagcatgaaacatctctagaaacaaagatggaattgttaccagtggcaaatatctgagtcacatgtcactgtgttactggtggaagacattcgagttaccggtggtgaatccatacaggtctgcaacaacctcactgattacctcctcagaagaaagaattcaactgaggactgaggggcataaggcagaaaaagagactgaggcaagtttcagagcaggagtggaagtttattaaaaagttttagtgcaagaaagaaagtacacttgcaagaagagtcccagatgggtgacccaaaggacaagtgctgtgtttaaccttgatcctaggactgtataagctggcccacctccaacatcttgcccccctttcccatgattcttcccttaggatgggctgcctgcatgtgcagtgccctccttacgcttgggaagtgagcatgcacagtgtatttaggaagttgtatgcatgctcatctgaggctttcttcccttttccactggaatgcccctggaaagtcatactatgtcattttgtctcttaatgcacatgccagggaagttgcttctccctggcatctgcattcagttaacgctttagtggacacgtgtggaccctcaggaaatggcctttccctagtgctggctgccaattcatcacttttaaagaagcaatgtgataattgccaaaccatcacctaacattcctggtgagtggaggagaaccctctcctgccccactcatgcctgtctaactacctataacagaatcaagaattttgagtaaagatctgagtgaagagacactcatttcagatcttcctcacatttctctctgctctctactacaacaaaaaaggaattctgattcttcttttgtgttgatgagctctatgttgtgtagttctttagcgtgggaataggagaatgggaagaatggatgggtagaagggatggaaaattctcttgccccagcctagggattaaattgatcctttagggtagtggttgtcaattgtgcattcccacctgacaaaggatacttgaaaatatctggagatatttttggttatacaactatgtgggaagcggttactactgggatctggtaggtagaggccagggatgcaactaaacatcctgtaatattattaggctagctatctgcttaaggaaatgttttatttccttgggaccccatcaatgggaatttttctctggttacctttcagatgagtgattaatcttcatcctttacaagatatctggcacaggacgctaggtcctcatcctccaaaaagatttacatggcccaaaatgtcaatagtcccaaggttgggaaatcctgctttagagtcacccaattaaaattgtaagatgcatattttccttttaactttccctgttcccctttgaatttcctttaggccctgtatagggataccttctcttacttcttgtggtccccagtgtccttttattgtcctttggccacaaaaaggaccctgttttaagtcccactcaccactaagttcttctgtctcctttcttctatcaaaacccggattttagcttaacctaggtgaatgattctccgaagataaaattacaggcctcagcagaggcagcagagaaaatttcttagggcccctcaaattacactatcctggtgcatgctccatatactttctactgatttttactgcttctgttatcccagggccttctgatgctggctttggtccatgtcacatatcataggaggtttataaagtgtctaagcacaaggagttctactagatacttgagtttttgttgttgaaaaaaaaggggctcctctggtgttcctcaaggagtttcacttctgaaagtacttaactttttatagcattgaatatgcctagtgcttatattttattatctttttgtggtcaattctttttctctaacatggttgatgttgaatttttttaaaaagttatcactaatgaccagagatgatgagctttttttcatatgtttcttggccacatgaatgtcttctgttgagaagtgtctgttcatatcctttgcccactttttgatggagttgtttgcttttattcactctaaatttgtttaagttccttgaagattctagatattacctttttatcagatggatggattgtataaattttctcccattctgtaggttgcctgttcactttgatgatagtttctttcactgtgcagaagctctttagtttaattagaccccatttgtcaattttggcttttgttaccattgcttttggtgttttagtcatgaagtctttgcccatgcctatgtcctgaatggtattgcctaggttttcttctagagattttatggttttaggtcttatgtttaagtctttaatccatcttactttttgtatcaggtgtaaggaaggggtccagtttcagttttctgcatatggctagccagttttcccaaaaccatttattaaatagggaattctttccccattgcttgtttttgtcaggtctgtcaaagatcagctgtttatagatgtgtggtgttatttctgaggcctgtgttctgttccattggtctatatatctgttttggtaccagtatcatgctgttttggttactgtagccttgtagtatagtttgaaatcaggtagtgtgatgcctccaactttgttctttttcttttcttttttttttttttttttttttggagacagagtcttgctctgtcgcccaggctggagtgcagtggtgcgatcttggctcactgcaggctccagcccccagggttcacaacattctcctgcctcagactcctgagtagctggaactacaggcgcctgccacctcacccagctaattttttgtatttttagtagagacagggtttcaccatgttaggcaggatggtctcgatctcctgacctggtgatccctttttgcttaggattgtcttggttatgtgggctcttttttggttccatatgaaatttaaactagttttttctaattctgtgaagaaagtcaatggtagcttgatggagatagcattgaatctataaattactttgggcagtatggccattttcatgatattgattcttcctatccatgagcatggaatgtttttccatttgttgtgtcctcttatttccttaagcagtggtttatagttttccttgaagaggtccttcacatcccttgtaagttgtattcctaggtattttattctctttgtagcaattgtgaatgggagttcactcatgatttggctgtttgtctatttttggtatataggaatgcttttgatttttgcacattgattttgtatcctgagactttgctgaagttccttatcagcttaaaagagattttgggctgagacaatgatgagataccatctcacaccagttagaatggtgatcattaaaaagtcaggaaacaacagatggtggagaggatgtggagaaataagaacacttttacactgttgatgggagtgtaaattagttcaaccattgtggaagacagtgtggtgattcctcaaggatctagaaccagaaataccatttggcacagcaatcccatttttgggtatatacccaaagtcttataaatcattctactataaagacacatgcacacgcatgtttattgcagcactatgcacaatagcaaagacttggaaccaacccaaatgtccatcaatgatagactggataaagaaaatgtggcacatatacatcatggaatactatgcagccataaagaaggatgagttcctgtcctttgcagggacatgggtgaagctggaaaccgtcattctcagcaaactaacacaggaacagaaaaccaaacactgcatgttctcattcataagtgagtgttgaacaatgagaaaacatagacacagggaggggaacatcacacaccagggcctgttagggggtaggggactaggggagggatagcattaggagaaatacctaatgtagatgacgggttgatgggtgcagcaaaccaccatggcacgtgtatacctatgtgacaacctgcacgttctgcacatgtatcccagaacttaaagtataatttaaaaaaaagaatttcaaatcttttaaatgtggtctcataagacaatgtgtgaagaatctcaattaatggtagtggaataaacggctggtaatttgaggaaaaattcagttttgagtcatacctcatataccacacagatgcatgcacatccgcacacacactctctctctcttttctttctctctccagtgaaatattaaatgagttaaatatttttatttaaagaagttatcactagtgtcctgtttgtcagtcttgtttaatttgctaattatgaagaaagagtggtgaattttatgatgatattttcttcacttttcctcatcactattgattttctagccttaaaagagtcttggatactatttttgggtgcaaaaggttacagaaaagaatttgctgctgagcaactaaagcaaagattttaagtcagttgtaacccatgcatgcccctttctcaaacattgctctgtgtgtttaatttatttaaaataataccagaaaggtaatttctttgatggatttaaagaaacgatatgttgaaaaggcagcaatgttattgtttttattcttcttccccaaaaatttgtattgcagcaaaaatttattgtatggacaaacaataccttcatatcagctatttaaaaatagctttcaatggatttatcaaaatcacaagtacagaacaaaacagataatttatcgtgtgtgcatgtaccataataattactggtatataaatggtaaaagaagtaagaatactggggacaatgacagagtagatagggccacaagaagcacagattgagaaggacgatgacaaagagccagaagtggaaatatgcatatcagctttcacaaaaacattaaacaaagttattttagttgtaaagtgccttgtacacttttcctttagtaaaatgcttactgcaaaagaaatgtttaatgaacactagctgtttttattgtgactcttatggttagacaagttcttatgttgaggaaatgtcttatttctcactgggaccctttcaactgggcacttttctctggttaattttaaactgagttgtaaacttacatgagatagctgtgttggagcaatggactcaatgtgttattgtttattcgactgtacttcttctgtacctgtgaataggggcttaaaaaccttgatgtacggttactctggaagttggaaaattcctgcctttggaggatttgttgtacttcctaggaagaatttccagaatgaatgttagattgtgatacccagggactaaatggaaacattcagggtttcacaatactaatcttcctggggtaaagaatagcacctctaaacaatcagcaggtctgggccattctcaagcaggacagattttgtgagcctggctgcttctgtgtgaatttattttagaaagagccacagtcaacaatcagacaatcctaccatctggccactagttgccatcattattggaaatgacttttgcatttttgtgaacaaccatttcaaattttcttttcctgaaatcagcattgcaaactatcaggaaattgtggcatatatcagcctttttataaaacttgaaaatcagacaactttaggttttaaaatgtaaagtatgccccctaaagctaaatgatgcctcattcatctcctgtggttcattatctattatgacaatgttacttattaagtaatttgaaaatataaacatgatcacaaaagcaaattaaaataccaggccctaggactcaaagaattaatgatgaaaaactatttctaagcaaacataatccaggaagcatctctagaaaagcatgtactctggttaccaggaagggttaatgtttggaaaacttcaggccacatttagaaaactcacagagaacagaagtgagacgtgtctccacagttactgaggaggccaaggcaatgtgcttatctcttttctgaaacacatatgtgcatgcatacaattagcagtcagctcaaaatggaacaggctcaaagcctctgggagctgaattgccttttttaaagatgaaaagcttggaaaggagtctgtgctctctgaatctgtcagtgagtgggggaagcacaccagcttcaacgtagtggcttttaggcttgtcagagcctttatgtagcatcatatgcatctgtcatatccatatacaacctccagcccagctggccatagtttggtctttagagcaccagtggcatgtttccctgtgaacctgcctctctgcaagctcacctgaggactgggacggtgggagccgcctcattagcaagcctcacctactttgacttattagtcaaaccctagtttacctttgtcccaggtggatgtattagttgtttcacttcaagatttttatatgaaaagcagatagctgaaaactcccctaggggaataaaaggattatacatgcccggagtgtaataataacggtgtcttagcaacagacacctgcagaggagaggattgctgaatttgaagctcaacagatgcctttcatttcctttcttgattgttggctttgacatgttagccaggatgaaatttgaccttccttgtgccttatcaccttctgagtgctccgtggagcagagttcgtcttcccattctgctgctgatctaatcttgcagtgggtgtataacctcctggtgacattgcctcgcctcgctgctcttctttcctccccagcccgcggtgcctctgcagtgtcacattcatgacaagtcatggttttgggccctgagatagagtttcttcccccaaatcagaagcctcatctctcctgtgtgcttctgttggggtgagacacagccacactgactgcttgaagagtgtttccttactgtgtctgtgggtcaggaatctggttgtggaatagctgcattccaataggaactgacatcctgttacttttgctgtaaactattggttagaaacaaatcactaggtccagcccacactaaaccgaaggggattacacaaaggtatggctagcaggagatagatatcagaggggaccattttagagactgactaccacaaacgatgagtattatatgtagttaattaacccacttcagccaagtacagataaactgtatcaggttgaaggacaagagtagagagagttagagtagtaaaaatgtatggtgtaggaactgtgtgtgagtgattgtgaaaaacccataagctgtcacacatttcttttacttttctttacaccagagctttcatataggtacatggtaaggttattgtccaatttaatagatgggaatagtgtaaatcaatcattacagcacagtatggtacaatttgtagccaaaaaatgtgcagagagctgtggggagctcagagaaggcagtgagtcatctggctgaaacctgggtatggccacacatcaccaactaagtgacattgaaattgaggtttttaaggatgaacagacgtttcaagagagaaagaagtgagagaagacatttcaagaagcaggaagagtaggttgttgtataatagcaagtttagtgtgaatggaattgtaagagataaagccagaaagtcttacagaaaattctaagacacatttatggtttctgaaacatttctgacagtctatagacattctaattaagatgtgcaactttaagtgttaacgctttattttgtctttgttgtatgttatttttcttttttgccaaaaaattgtttgttaaattgatgagacttccaataatcaatgcaggcctagtattaaggtgatatagtattacattccaaagaaggcagaaggttttgttggtgttcttggaactccatgaaagcaaattttcagtgtggcttagtgagagctgattttagaatttttctcaaaaattcattaccattaagttgttatctgaggaatttaaaaaatgatttgcaaaaatatagtgaactaccacaactaacaacaacaaccagaagacaggaaatggcgtagaatctctttagtttgtccaaatcaaatcgtgatctttccctggcccccttttctccaggatcattttgtggcatttagcttgtggataataactcactcaggtttcttagatttgaattcttcttctactatccactagttgtgatgatgaacaatttgcctaagtctttagtctcagtttcttcatctttaaaatggaatgatgttacataccttatatgttgtttttataacagaataagaaaaacacatgtaaagtagttagtatgatacctggaacataataagcactcagtacataatacttgttattattgttggtatttgtggtaggtagaataaaagccctccaaaaatgttcacatcctaatccccagatctgtgaataatatgctaccttacgtggcacaagggatttttcagatatgattaaggttaaggaccttgaaatgaggagcttatcctgggttatccaggtggtcccaatctaatcacatgagtccttagaagaaacttaagagggaaatgtgactatggaagactggtcagagacatgcaaccttactggatttgaaaatagataaggagtcatgagcaggaacatagacatcctctagcagctggaaaaggcaaggaaacagattcaccactagagcctccagggagaaacgcaggcctgtggacattgtgattttagcctggtagatgtatgttggacttctgacctatggaactttaaataaatatagttcaagttaccaggtttaatttgttatggcaacaatagaaaactaatgcactattactattagctaacactgttgacttgtccataactgtatttaaaaatgatttttagttcccatttttccctaatgattgaagaaaatacataattctggagcaagtttggtgtttgtagagagagttagagggatagtctgttgaggagaagaggattcagttcacatttatgcctaaattcctcactttaatgattgagttgctttttccatatttggtttttgctgtaaaaatgaggggtgctcaacatttttagaacattttcattgtctgtttccagtgaacacaaacacacaaacacaaaatcacacagaaatagactatacatttacccaacatataatatataaaataaatgtatagcacatgtctcatctgctctttttttaggagattctgaacttaataatgtggaggaagttcacagacagtaattttggaaactataaaaaatgtagatttacatggttattgggggtatcgttgttgtcacaatctccagaatgcaggattgttgagaatgaccttttaattcaggagtactctatgccagcaaggctatttctgagccatccattagtgacctatgggccacaattagctctcaatggggatttatttggcttttgggtgtcttaatgattcaacacttaaaaattcaaaatattttgtcattaaaatctggatttccagccagattttcagattaatccctattaattttggatctgcattgccgtacctcaactatcaattacagctgaaatagtaacagccttcttagaagaaggtctcccctctcctagtcactgagattcagcagttccagtagaaaaacatgttcggataaatactaggaattcttatagccagcctgtttcacccatttgctttatctgtctgacccacaaattggagcatttttggcttgtgacccatgatttatggtgttcaagtgatcataaatatgatcatcttaaaccatggagattttactataagaattaatgtcaaaggtttgtcttctttatgagtcatattcctaatagattcacaagtcacactgaaataaaccccagaagaaccagtagacacttcaataaatgtcgaatcatctgcattagttttcctttcaaaattaaattataataaccttaaatagtatagtcacagagagaatatatatatcattatagtgtagtatcagctgcccaattttaaaatctagaagtttaatttattgcaaagtgtataacagaaaaaattgtttagatcaacagacgcacaagatttgtcagtaaagtggaaaatatccatggaagtgaaactattgaatactggattttgttttggctttcaatagctttggatttttagtctacttatgttaccataaaaaaattccattgactgcgtgtcttaaaccagtgatccccaatctttttggcaccagggactggtttcatggaagacagttttttccatggacaagtggggtggggtagggatggtttctggatgaaactgttccacattagattccataggagcatgcaacctagatcccttgcatgtgcagttcataatagggttcatgcttctatgagaatctactgatgctgctgcagtaatgcttgttcacctgctgatcacctcctgctgtgtggcccagttcctaacaggccacagactggtaccagtccacggcccaggccttggggacccccggcttaaataacagaaatttattttactttttcacttttctggaggctattagtccaagatcaaggttcagggcaatttaatttctcgtgagggctcccttcctgacttgcaaacagttgccttttcactgtgtcctcatgtggcctttaggagcaggcaaagaaagaaagaaagaaagaaagaaagaaagacagagacctctctggtatctcttcttataaggacaattaacctattgcatcagcgccccacccttatatctttatttaaccttaattacttcctgaaaggccccatctctaaatacagccacattggggttagggcttcaacatatagagagggggtggggccaggcacggtagtttacacctgtaatcccagcactttgggaagccgaggcaggcagatcacttgaggtcaggggttcaagaccagcctggccaacatagtgaaacccatctctaccaaaaatacaaaaattagccaggcgtggtggcaggcgcctgtaatcccagctactccggaagctgaggcaggagagaattgcttaaatctgggaggcggaggttgcagtgagctaagatcacaccactgcactctagtctttttttttgagaagctgtatcaaaaaaaaaaaaaaaattggggggtggaggcaggtaaagacattcagtccacaacaggcagtctgttcttcaatatcttcaatagatgtaatatcttttaaaagggaatagcagtcaatgacttgtaaggaggtaacaagatattataagaataaaatgtaattatccaagggaatacatcacctagattcattttgcaggatttcattgtaagttaatcaatgaaagagaatatgttacaatttgcaactcctttgcgagaggagtgcagcctgaggctgtaggttttagcttgcctgatattaatgacattttttattttattcagcttccctttacacacattgtaattagtggtattacccttcctttagcagtaattctttccacattcctatgcagaatttgatgagtccagtgataaacaactgacagcacttagtgggaagagccctgtgcagctgccaactaaatgctcctgtgatcacaggcaactctcagtctttttgaatctcagtgtcctgttagcaaatggggaaaatatgatttctttgtttgtagtcaaggttttcagttgcaaataataagaaaaacgggctgtcttaagcttaaagagatttcctggcagggtatgggggctcaaagaatacacataaagcttgaggagcagtctggaaaatgtgcagagaccaagtcatctctgaagccttcaatgctgtgacagtcttctcaggatggggcaattgtagtatgtatcacccctgccactggggaccactgcaggatgtggggacacacagcaccaaaagtgaattccgactatctctttgccttccacttactcactctacgttcagaattcctgggcagaagcttatagttgtattaatttatgttgcaagaccgtggatttgccaagtggcagcaggttgatgggacagaaagcatcttgcctcttttggcttctgtagtggtaggggcaccctgcctcctacctggaatcacgcagtgggtgatgtttccaaaacagagaggtggttcagacgctggattaccaaggcaggcaggcaggcagacaagaaggagggaaggagggagggagggagggaaggaggaagagagaaggagaaaaataaggaaggatctacattgtcctttctccttaatctgcttggttggtgtgtggttctatgacaagattatacatcaaagaatgttcaaagcattatgaaaatgtaagatggcattgtggccgggcacagtggctcaagcctgtaatcccagcactttgggaggccaaggtgggcggattgcctgagttcaggagttcgaaaccagtctggccaacatggtgaaaccctgtctctactaaacacacacacacacacacacacacacacacacacacacacacaagctgggcgtggtggcatgcgcctgtaatcccagctacttgggaagctgaggcaggagaatcgcttggacctgggaggcggaggttgcagtgagccgagatcacgccactgcactccagcctgggcaacagagcaagactctgtctcaaaaaaaaaaaaaaaaaaaaaatatatatatatatatatatatgatggcattgttattcccactgccacaatctcagttcaagccttcattttttttacctgaaaatattaggtatgatactatctcattctctgtaagtttttacctcttcattatgacctcaattttgtcaccagctttgtcttcacatgcagtgtagttgtttccctctctagaaacttcgttgacttatcgcccacagagtaacactcacacaccttagtagagcagtcttcctttctagtttcatgtctttttacagcttctgtgtcctcaaaccacaggcttctgctttgcaaaactattatagtagaagttgttaaggtaccacactgtaattcaaatgctgatgtagctggatccagcccccttaacctggggcgaactaaaggtcttagcttttttgggctgagggaggaagaagggaagtaggaagtgactgactcatgatcatttgaggatttagcagttaaattcgaaacatatttaacattgcaaagatttgacagaaggcatatgctgaaccttctttctagtgggaggaagcttcagtgcttccaacacgtgtcattcccagagtccagccctatatctctccccatctgtttctgcctgcctcttccacacagtggagccccctccaagcatagtgacctgtgtggcaatctccactgctctcttctactttgagtcagaagactgaatagctacactgcctaaaaccaagagtggcaaggacaccttgaccctcaccttccaaccacatgatgcatcacctagtaactggacaaccaattgaaaaatatttttttgtcattaatctcataacatttctacctttattttactaggttggattttgacaccccacttatcccattatggcaagttttattttacattttctaagaatgtcttagctgatgtggttttcattggccagaacagccatctttattttttattttttcttcacttattgaaattctattcaccttctgttgcttaacaaacagctcccacttgtataagtttctttgtgtcttctcattagaaagtgggataatttagcagccagtggatcgaaactcaagtggacttagtattcaccttcctagtcacagaatgacattttcaatagattttttcatctgcatttctatagctcttaattaaatctgtttgattttgtattagttatttacacatccatcttcccctattaaattatatgttatttcagactttatgtctttttcatctctatgcagcagatatccctgttgcatagatgagaaagctaaatctcagagaggttgaataacttgattaagttgtcagattttctaagtggaggaacccttattcaaatagggagaggaaaaaacatttggctactcttcttccatcactttagggaaggcaaaaccattcctagaatttatgtgaactagacatgtggttgtaaactttggctaactcagtctcatcctcaaattcgtgttctttaggttatatatcagtgccagtcccggatggatttgtataggggccctgctacccactccttggcatttccctctatgctcttggtttttggtgtcctcaaattctaggtgtttagaatgcatatgtgctattgcactgtggaagtttgtcttgagcagaacgccccagggtctgtgcttactatgtgctggacataatgcttacaacgctttatatgcattttttatttaatcttattaaccatcttttaggtcagtactattgctatccccattttatgtatgaggaaaccgaagctagagaagttcaagtagcatcccaaatttgtaagcttttaagtagtaggactacttagggaagcaaaattaaagtatctcagtagtattttgacttagcattcaaaataattacattgcctaagagtgatttgtaaactccattcactcaagtttttctctgacttctttccttaagttgaacttttcactgcacattcactaggcagtacagtagtcccctcttatctacagtttcgctttccatggcttcagtcatctgtagtcaaccaaaatctgcagcaatccaaaaatggttgagtacagtacaataaagtattttgagagagcacactcacataactttgattacagtatattgttataagtgttctatttcattattgtcactaatttcttaccatgctggatttggacattaaactttatcatgagtatgtatttataagaaaaacatagcagatatagggtttggtactatttgtggtttcaggcattcactgcaggtcttagaacatattctccatcaataagcagagactattctattgtactgtctacaagatcactctagagcccaaccacttgtgtttgaaatctggttatgcagcttattaactgtgtgaccttttggaagttgcttaactctcagtgcttccatttcccttatataaaatgggaaggaaagtaatatctcacacttgctgtaaggattagatgagttaatatatatgtgagatattttcagtagtgcctagaacaagtggtttaaaaaaaagtactatttatttgctgctatttggaaggcatatgcttgatgctatggaggataaaaaaaaaagacatacccttgcagactttataatctatgaagggaggtagaaatgtttttatttagtcattcaactaaaattaataaaagacaaagtgaattgattgctaaacagttataagctatgtgctatggtcatttgcttatataaaattctaatgatggatgcaagatgagggtaaaaaagagtataatatactataatatactggataaacattggctggagttaggaattaaggagtgtatagacagacctatcacatgctaactgggaaactcaaccagttactaaccctccctgacactctcttttggtaaaatgggaaaattatacctaccttttaaaggcattttaaggattaaaaatattaaaaggtatttaaagtgcctacaggattggctgtgaaataacatgtggttgattagataatatgaaattctattactcaactatgaaagggattattgtacccaaggagcaaattgggatttaaaataagaaaatgtttctctcccaattttacccacttttgcctcgttcaccacccatttgctaacaccatggacactgaggccacccttgattcctctctcattctggacacccaacttatattcatgtcctttgttttagttttcaaaataaaaagctcaaatccacacccttgtctttgtctcccttccattatagaagtctaagtcagcaaattgttgtcactactatattggtttgttacatttgcttttgctatctccagtatgttctgcacacagcagacagagtaataatttaaaagtaaaaaattggcccatgttcttcccttgcttattgccatttagtggctccctattacaaagctatcatgtgtcccctccctccctctcctaacttgtctcattccacttgatgtcttgcttctcatatttagtcgcattgacctcttatttcctagaagaaatttcagtcttcttttttcttcgtgaattttctatattctgtcctattacttgaaacataattcttccctctccttttccatagttggctcttacccatcctctgtattttaacctaaaaattaccttttctgtctcctctatctaaatagtctcttccccatccactggggttctattatgtttccttcagaagctaacagtcacaaacttttttttcttcctaactgtctgcctcctgcttctgtacacccacaaaacaaggataatgtctgttgtttctgctttgttcatcagtggacacccagaatggttcctaggaggtatagatgaatgagtagcagcagacatttgggaccattaatttagccaataaatattagctaccaagagcatcaaagcacattatgtcagagttctaaggaataaaaaaaaggtatagtgagtatgcagtgttgtgtgtgtgtatatatatatatatatatgtatgtatatatatatatatatacatacatatatatatatatatatatatactttactttgtctggtataggatgtcttcagggtttattaggtccttcagaagattgacagtcaaatagctcttcatccaaaagctgagcctgcatcaaatgaagactttccctcctttatcatatccagttgcaatactcaccttattcttctagaggagaagtttagggcataccttttaaatagcaataggtggttgccatggttctcttccatttcttcgttaccttgcctagaatttatctcagatttattatacaaaattcaactcaattacatgccacactgtgaactcactgtctgtcagtcctgctagcaccttactcatatttattgctttttacaaaagcaagcctattttgtctgtatttttttcttctgctgctacataatggcctgaatttcttattccaagattgtctccacagaggaatagaatgaggttgttaatcttgcactggcctctgtgttcatagtctatcaatagctgaatcttcttttgtaacagtagtaactgtaagtttgagacacttacagcccaaatgttctttgagtattattcctttacagtttgtcttgtcctatcaaacatctatctgattagataggttttcctggtgaaatcattgttattgttccaagtagaaactcttgcccatgtttctaactcctgtttaaggtcttttaagtatttgttgaaagtacagacacacttttttgttgttgttcattttccaaaatctgcatcattatgcacataatagaaccattccagaaaaacgaatttggataatatttatccatagaaactctactgaaattcaggggaaaccaaatacacatattttgaaaagcttggcattggttaatataaatatactgcatctacgtggaaccctaaatttgctgctttcttgttgctacatgatttcttttgtatatgtatgatttttctttcagatatagatgtaatatgtacacaggatatggtgaaaacagaggaggccaaagaagaaaattaaaatcccccagtatctcattttttagtgatactgctgttaatattttatcttttttttccctttggaaggtctgaacctcgttaatattttagacataactttttattcttttttctacacatgcaatgcctacgtacctttgtaaattacattggaattatactatcataatgttttttaatctaaaaatgatcaacttgtatgaatattttatcatatcaatatttcacaacataatttagaatggtattgtagctctataaaataaactataattttttctgccagtcagatatggttgaaatgtttagctctttctagaatttcactcttcagatagtatgtggtataggacttttgtaatcctccctgataatattcttaggatacacttctatagtgttattaggcctcaattgtgcacattttaatactttaatacataatataaaattttcatctgaaagtttgtaggagtttacatttttatcagaagtatatgagaaggctggttctctgaatccgtgtttgtattgaaactgttttccttttattggtttaaatgtgtgtatgtgtggaagggtatgtatcttcgtgcttttaatgtctctttattgtggtaagaacacataacacgagatctaacctcttcacaaattttgttttgttttgtttttgagagggatcttgctctgtctcccagactgaagtgcagtggcgtgatctcggatcactgcaacctccgcctcctgggttccagtggttctcctgcctcagcctcccaagtagctgggattacaggtgcacaccaccatgcccagctaatttttgtatttttagtagagatagggtttcatcatgttggccaggctggtcttgaactcctgaccttaggtgatccgcccgcctcagcatcccagagtgctgggattacaggcatgatccaccacgcccggccacttcttcacaaattttaagggacaatattgttaactgtagatacactgttgtatagtagacctccaaaacttatgtttttgggtaactaaaactttatacccattgaacagaaacttcccatttcctccttcccccttactcctagcatccaccattctacctgctatttatttgagtttgaccatcttatatatttttatgagtggaatctatgaacattgttttattatgtgtgtattgacttttttttccttttgtgaattgcttattcacgtcctttgactctttaatctattttggctgttgatatttttcttattgattcctaatgagtgttttcaacatctttttcagtttggatagaatgcttatcaggttaagaatcatctgtgaacccttgcctagatggtaggctagcagcacattgcacctgctcacatgtatccctggtgactcataaatcaagtggcagaaaagtgcaatagtgactgcatggatcaatcctttctcacttcacaaaagcctctgaattgggcaaggaaggaaatattgtccccatttcatagaggagaaaattgtgactccaaaaatgaagaaactgggccgggcgcgctggcttatgcctataatcccagcactttaggaggccgaggtgggtggattgcctgagctcaggagttcaagaccagcctgggcaatactgtgaaaccctttctctactaacatgcaaaacgttagccgggcatggcagcatgtgcctgtagtcccagctacttgggagactgaggcaggaaaattgcctgaacccgagaggcagaggttgcagtgagccgagatcccaccactgaactccagcctggatgacagagcaagactccatctcaaaaaaaaaaaaaaaaaaaaaaaaaggagaaactagtacaagtcctcacgagtttaaataccaaaactcaggactatgactgactaggttttcggatgccaaaatcctgcactctttctcccatatagccttactcatatttatggggtttttttcttttattcttcattacagtttattttcctcattatttttttaacaacatgtcagcactagcagaggcattttgatcacatggttttcttacgttgtcaggtaagattggctttatgtcagatactgggcattactggatgccctgcaaaaagtgaatcatttgattatccttcactttgtccatatccatttgtatcatgaattacatttgattaaattttacagttaattttattacttactcctaaaaatacaatcttttaataataagctgagggaaaaatatgatttagctgacaaggaaattagatcccctttgcattgttcctggttcgtgctttggatatgtattatgtacgtacagatttttcccttagcagtatgccactaatttatttttaatgtaaaatgatagcattaagccactatttttcagatgtgttttctttctttcttctttctgttcttttctctctttttaactagcggtgagggctttgcatggagctagccatatgctccatctcagttacatctggttccaagagaacatagctgtaagaattctggataggatctgagatctgtggagcagttttttcccctttataaagtaaacatagttctttccaaccctgttgctcttaactggttcacttctaaagttttaacatcttcagttacatgttgtcactccccaaccatgttggattccaaatatatttgatgacggaaggaaatatgtggaaatgaaaaccaaaacattactgaacagaaaagcattcttcttattgtttatgtgatattatagattgtatcaaatttgtccccttgttcctcagctatttctatatgaataatatggtaactctatttaaaaaaaaaaacaaaatacaatctggaagatagttccacctaataatccttgttgctatgcaaccatgttccaaaaatagcaactgaagcagtgcaatgtcagcataagatatctacacaatgtagaatgtaaaaactgatcacatgcatattgattttaaaatttttgagttgttagtatggttgtttattaaaactagagaaaaataaattacttaaagcttatagaaattcaaggaggcaaaacaattatttgtagagatggacagatcagggttcaaatctcagttcctattatttaatttcacagacacaggggcaaagtatttaccccttcagccttagttttatcattgttattacagttgggataatagcatctaccttgtggggttgttgtgaagactaagagactcagtgaaaagtgttcccatagttcctggtgcatagcaagtgtgcaataaatttaaattgtaatgatgatcatcatcgtttgaaaggtcttaaaacacatttttaacccatttatatttgtgaagcaatcaacagctatttactgagcattagcctttagtggtaaactatgaaaactatacaaatgagtccttgtccttgaagaatttacagttttatttgaaaattagatatacattagagaaaaaaaatagtgacagccaggtatatactaaggctttgagttgggataaaaggttggtatgtttaagggactgaaaagaggccttaggtttgatgcatagtgaattggggaaggtggcatgggatgagaatgaagatgtagggtggggtccgatcatgcagagtctgaaaccatggaaggagtttccatttcaggctagatgtcatggtaagccattgaagtgttttaagtaaaggagagacatgatactgttgatgttttaaagacattgctgtaagaactgtgtggagtatggtttggttagaaatagaagggaattaagaggaccattttaagaggctcttacggacaatagatggtggtaattcagattaggaggatagccctggaaatggaaaaataaagtggacttgtgatttatctgttacacagaatgagggaaaaggaaaagtcaagtgagtctcatatttctagattgaactgctgagtagttagtgaaaaaggagtaaaatggcaagagtagtaaggaaaaggaattgacaatgaaggaacttaaggtcttgttaggaaataacaagtagcccagcttagctgaagatgatttatgagtgcgctgcgggtggagtgaagtgtcatggtcgtcgttatgataacgctggaaagaggttagtttacatgggttcatgaatttgattcataaagaaaatatttgtgggtgtctgtggcttatccatttatgtcattatttacaatcatatctgctatctgtagaatctctcttctaccttttcctctaggcatacctaatacttttgtgggatgaaaaagactgggagaagaataccaagaataagctgtctagacctgtgccgctcaataggctagtcactggaaacatggctattcagcatttgaaattttgctcaactgaattaataggtggtttaaatgtaaaatgtaaaccagaatttgaagacttggcatgaaaaaagatttaaaatatctcaataatttttatattgattatatgttgaaataatattttagatgtattgggtcgaataaaatatactattaaaattaatctcagtacaatttttaatgagactattagaaaaattaaattatatatatgactcacattatatttctgttgaacagtgctgatatagactacttctaactcatgccaatttatcagcgctagctggagaatgagcatccatttggcctgtacatagtgtctgcaagacaaagatgctgttgaacaaagcaagtgagatagagtggatgagttgttacaagatgtgttatcaataaacatttaaccagggtcctagggtgaagctagaggtcagtttacccacaaaagagttgttaatcctctacaactcaaaatatgggatatctgcaaagcatcccatagctatactgatttctcttctcattttgttcctggctctgcttacaagactcagctctttcttaaggtttgtatgatagaaattgcatgtgtattttccctaatcaattcttcccacttgaaattatgtgttgtgcattttattacccttagctaggtaatgttctgaagctaatcaccacagaaaatgttagtatatttaggacttttacataacctgcatacatcttagaatcctcaaaaggtcatttacctcacagtgctatctatgatatgagacatttgttagcggattctgtaatgactttagatgagattcaagtgagtaactattaagtacacaagaagtcaaaggaattgtgcgtctggtcggaacagaataagtctaaaaatcacctttgttttttcagttaagaaagactagaggaaggaagggatgtttcaggagttcttaaatgaatagagtttgcaaattaagggcgtgcatggaaatgaatgctttgtaaattcattgaggaagaaaattctcgggagtgagagtgaaagagttactggaagaatgaagtgagtacagaggatgagggaatctgacaaagggcttttgcagtaagaaagaattcctggtccatactgttaccaaaaggtcacagtgaaacaggttggaccaatgtgtacagaaaactgctgttgtagtaattttgaaaatcagctggacaagactagtattatagacacaggaggctagtcttatgaggctgcattgcattgctctacatactttttttctcattaagatgcatatcaactttatagcaacttctttctgaaattttcaggcttgtttgtcatcatgtttgcccaaactgaggttgttgcatttggtctctgcttcatgtcatttgagaaacacatgttttcttcatttctcagagacgtgaggctttttcccgcagttaggtctttacacgcgtattccctctgtttgtaacaattttttctcttgttcttgctggattaattgcaactcatactttagatcataaggttatctgggaccacccaatttaatgttggtctccctgttattcgctcacaaaataccccacactttttctttcataacacctactgtgatttgtgtatcagcttatttcctgttttcctcattactttaagctccacagtgtaggaaaaggtgagtatgttttcaccactctgtaaccaacgtgtagcatagtgcctcatatagggtaggtggtcaataaatagtttttggatatgtaaaagggttcaagagcaaacaaattcaaaagctagcagaagacaagaaataactaagatcggacctgaactgaaggagatacagacacaaaaaacccttcaaaaatcaatgaatctaggagcgttttcttgaaaagatcaacaaaatagaccactagccagactaataaagaagaaaagagagaagaatcaaatagacacaataaaaaatgataaaggggatatcaccactgatcccacagaaatacaaactgccatcagagaatactataaacacctctatgcaaataaactaaaaaatctagaagaagtggataaattcctggacacatacaccctcccaacactaaaccaggaagaagtaaaaaccctgaatataacaataacaaggtctgaaattgaggcagtaaataatagcctaccaagcaaaaaaagcaccagaccagacggaatcaaagcaggattctacttctgaaactattccaaacaatagaaaaagagggactcctccctaactcattttatgaggccagcatcatcctgataccaaaacctggcagagacacaacaaaaaaagaaaatttcagaccaatatccctgatgaacattgatatgaaaatcctcaataaaatgctggcaaaacaaatccagcagcacatcaaaaagcttatccaccatgatcaagtcggcttcatccctgggatgcaaggctggttcgacatatgcaaatcaataaatgtcatccatcacataaacagaaccaatgacaaaaaccacatgattatcttaatagatgcagaaaaggcctttgataaaatttaacacccctttatgctaaaaactctcaataaaccacgtattgatgaaacatatctcaaaataataagagctatttatgacagactcatagccaatatcatactgaatgggcaaaagttggaagcagtcctttgaaaactggtacaagacaaggatgccctctctcatcactcctattcaacataatattggaagttctggccagggcagtcaggcaagagagataagtaaaaggtattcaaataggaggagaggaagtcacattgtctctgtttgcaaatgacatgatggtatatgtagaacaccccatcatctcagcaaaaatctccttaagctgataagcaacctcagcaaagtctcaggatacaaaatcaatgtgcaaaaatcacaaacattcctacacaccaataatagacaaacagagagtcaaatcatgagtgaactcccattcacaattgctacaaagagaataaaatacctaggaatacaacttacaagggacatgaaagacctcttcaaggagaactacaaaccactgctcaaggaaacaagagaggacacaaacaaatggaaaaacattccatgctcatggataggaagaatcaatattgtgaaaatggccatactgcccaaagtaatttatagattcaatgctatccccatcaagctacaattgactttcttcacagaattagaaaaaactagtttaaatttcatatggaaccaaaaaagagcccacatagccaagacaatcctaagcaaagagaacaaagctagaggcatcatgctacctgacttcaaactatgctacaagtctactgtaaccaaaacagcatggtactggtaccaaaacagatgtatagatcaatggaacagaacagaggcctcagaaataacaccacacatctgcaaccatctgatctttgacaaacctgagaaaaacaagcaatggggaaaggatttcctatttaataaatggtgttgggaaaactggctagccatgtgcagaaaactgaaactggaccccttccttacagcttataaaaaagagttactcaagatgcattaaagacttaaatgtaagccctaaagccataaaaaccctagaagaaaacctaggcaataccattcaggacataggcatgggcaaagacttcatgactaaaacaccaaaagcaatggcaacaaaagccacaattgacaaatgggatctaattaaactaaagagcttctgcacagcaaaagaaactatcatcagagtgaacaggcaacctaccaaatgggagaagatttttgcaatctatccaactgacaaagggctagtatccagaatctactaggaacttaaacaaattttcaagaaaaaaacaaacaaccccatcaaaaagtgggcaaaggatacgaatagacacttctcaaaagaagacatttatgcagccaacaaacatgaaaaaaaactcatcatcactggtcattagaaaaatgtaaatcaaaaccgcaatgagatactatctcacgccagatacaatggtgatcattaaaaaggatgagttcatgttctttgcagggacatagatgaagctggaaaccatcattctcagcaaattaacacaagaacagaaaaccaaatactgcatgttctcacccataagtactccaggaaacaacatattctagaggggatgtggagaaataggaatgcttttacactgttcgtgggagtgtaaattagtttaaccattgtggaagacagtgtggtgattcctcaaggatctagaaccagaaatactatttgactgagaaatcccattactgggtatatacccaaaggattattaatcattctaatataaagacacatacacacgcatgtttattgcagcactattcatgatagcaaagatttggaaccaacacaaatgcccatcaatgatagactggataaagaaaatgtgggcacttatacaccatggaatactatgcagccataaaaagggatgagttcctgcctttgcagggacatggatgaagttggaaaccatcattctcagcaaactaacacaggaacagaaaaccaaacaccacatgttctcactaataagtgggtgttgaacaatgagcacacatggacacagggagaggaatgtcacacactgggacctgtcatggggtggggggctggggaagggatagcattagcagaaatacctaatgtagatgacgggttgatgggtgcagcaaaccaccgtgacacatgtatacctatgtaacaaacctgcaccttctgcacatgtgtcccagaacttaaagtatgtatttataaaaaagaaatgaatgatagatgttataaatatatcttccatcaaataatgtctttggttttgtaaaatcctttacaattttcaggttatttcatgtacattttcttaaagtagttctgcaagttatatagtagaagaaggaattggatcagtgtcagttacatataaaaaatgtggtcaattaaaattttattttacgatagagcttttcagctggcaaccttttattatgtctgaatatattctctcttagggtaaagaattttacaggaatggttatgagtgtaggaagagaagtagcaaatttccctcttcagtagaagctcttttaaaccaacaatgacagccaactgaacacattttccaaaatatgttgtttcaccaaaaaaaggttggatatttaggaaaacttgatttggtcaagtacttaacaatgtgttatcatattaggggtgggtaagaaaattgtaaaatattggagaacgtcatatgaatctactattcattattcagatttctctggaagaatctttaatttctcactgcactttaaattaaagctggaactcctacagaatacatatttcgtgtgatttgtaaaggcatgactttgaactcaaagcaaaagacttggctctccattagtaactgacaagtaaatgtttgtttgtatattttaagcatttaagatgtgtgtattacttctttattatttctttctctgtcacactgctgcaaatcatactgggtaaagggggttctatggatttcacattttgtagtatgaagaggaccccactctagctaccatcctaacttatcacaaagtaaaacagcatggtttgatacgctgtgcttctctagcacttctttaccacttatttgcctcttgtaaactggcttttttctctcctcttctggatttactcacatagaaatcaccagtgacctaaatacctacaggaaatcccttttatcatgtctctctggcattttatactgttgcctttacctcataatcaaacttcttttcctcttagcatctattaacctgactattcagacttttcttttgcctaactacatgttgtttgtatttgtgtgtgtatgcatgtgtgtgtgttttctttgactcctgtatgggctcatatttcttcctactttcttttcctattttctattctccctattttggttttttttccatacatgattttcagtggtagtcctatccactagtgtagtcaagaagactctaatactctctatggcctagttatagcattctcctttgggaaaacaaacagaaaaaaaatgatagagataattgaattataattggagcaaaagaaattaatgagaagattctaaggagactgagatactggtgtatttggtcagggtatctcttccacagataataaaagaagaatgtacaaaggtttttcttttccaggcttcatgtagactgtcttttcttttttctttaaatatgtcaatgccattaattaaatgttagtcaacatttaattaatctgattttttttggcttccgaagggaggtggtgataatattttaaaaaagagtgcctcaagtatgtcagacatggttccagatgctttatttatgttatttaattcaatcttcaaaacaccatcctaagtttgatattattatcttcatcacttaagtgaggagcataaagcattggaattttcaataggttgtttaaagtcacactactaataaatactggtgcccaggtctgcttgttttgaaagccatgtgtttccaatgtatgcatttatttatttttattttttctaatctgattgctttttatttcctttcttgccttactgtgctggctagatccaccagtgcagtgttgaatagaagtgagattagacacctgacttgtatctgatgtcaacggaaaacaacaagcctttcactattaagtatcatgttaactttagtttttcgttgacgccatttatcaggtttctgaaattcctttctctttctagttttctgagaacttttatcagaatggataatgaattttagtgtagactttttctgagtcttttgagatggtcatctaatttttctatttcagattattaatatggtcaatttcatggattgattggccagtgttaaaccaatcttacattcctgggataaactccacttagataggatgtatgatcctttttatataccgttaaatttgattgactaataatttgtttagaagttttgcatatactcataagatataccagtctgtagttttgttttttgtaatgcctttatcgggcttaggatcagggtaagctccctgacagaataagttgagaaatggtctctcatcttcaactgtttagaagactgtgtaccattgatattcattatatgcttgatagaatttactaacctattcatcattatatacttcatagaatctacttttttaataatttcaagttttattttagattcatggggtacaaaataggcttgttacctgagcatattgtgtgatgctgaggtttggggtgtgattgatactgttacccatgtattgagcattgcacccaacagttagttcaaccctactcccctccttctgtccccaccctagtagaccccagtgtccgctgttgccgtctttatgtccatgactaatgaatgcatataaatgtataaatttctatctaatatttccttaagctatatcccacaaatataatatcagtattctttatagcatttagttctaaatattttaaaatatcctttgagtccttcattgtgattcctttttaactcatgggttctttggatgtgttttccccataacatgtggaactctgcttttgctactttattaattttattatctaaaataatgtttatatatatttatatatattatttatatatatatacatttcattatttccacacctcacctttatatgttagagaagaagtaaaagacatagacctattttgaaagaacttagtctgttggagaatttctataacaaataagagcaatcaaaagaagccagtataataatacctaggagttctgaaggtaggaaattcaatgaggatggttccaatcagaaacattttcttgaaagtgatggaatgtagagtacatttcaggagagatagaatttgggtaaactagaagaagaaaaaagattttaggcaagggggccaacacaaatgaagttgacatggaatgagtaccatattcttgagtcagtgattaagctatccttattttacaccctggagcacaggaaaatgagactaatctttattccatctaacagcactcaaaataatgtttttaaaaactcactttctcggggtatccttttttaaaattagctcacacttccaccagttattgttcctaattaatttcttcattattatgactgttctcttgatgtgttttagtgaatcctcattcttcgtaaagtggggtccttgtgatgggacatgaccctggacttcttaaaggataattcccagggtgaaacctgtaagaagcaccaactgtgaaaccttgaatatggaaagtgccttctgttaattcgatccacagtgtggccatgtggctggggttgatctgtagagcagttaaggggtaacatgtttacttttcaaaagatatacactttcaaatgaagaagatcgattagttcaattcagagcttcttaacttattttaacatttaagaatttagtctctaagtttgacagatctatttgaattctagttcctctacttaaaattctttgaagaaattttttcaccccttttcatgcttcatttgccttatagtatacaatggggttaacaatactatttcatagggttgttgtgaaaattaaatcaaaggacaaagtaacttatattttatagtacttggcacattgtaagtgctcaacaaatagctaaacataagcttgaatgcaaatgccagccaaatgatgaggcatttttctgttcatatcaagtcttcttaattatacaagtacaaattatatatcttcaaagcggtagaatgttaaatatgcaaaatatgcatataggtattgcttctgcatggataatgaaacacctcaacatgattaatagggctattagtaatagaggacaaagtaatagtgcttcactattcattataatatgtaaccaaccaacatgtgattctacttggaaatgtcttcagaaggacaaagacagattagaaaagaaatttctagggcaagatgatattctgaaatcctttatgaacttacggttctaggtcaggaaataattacagtgttgttgaaaatttatgacagtgttggcaaatatgtatcacaatgcaagccagcttctgtggttggtgatgatgtctggggaaaatgatttgttaataaatatttccattctgcattttgtttcaattaccatgatatttgtaaaaatgaatgaggaaaataaccttttaacccagaattaccagagagagttctcaatgcactatttcattgtatgtgcccgatctgtctctgaaatatggagtctatccatgaagactttggcttaatagatatgactgtaaggatagcatctggtacatttccaagcaagcttacctgtgacatctctgtaatgctttgctgctggtttattactgcaggggtaccgcaattctgcatcctactcctaaacacaatgtttctttacctgagtcttcatattttaattcctttaaaaatcaatctgattttagataattctattgactagataatcctatcaataggaaaaatgttttcaataaaatttaatttttttaaattctgagattatttcaaaatgattttctgaagctaacattaaactctcctaacctgatattttgcctttatagtggactctattagaatgctggaactgaaattataccctttcatgcttcagtgtgaaagtgactatttaggccatttgaattgaaatgattctcacccatagttcaaattaatacagtggaatggatttatattatttgactcctttgtacccaaatttagatacactttacataatatcatgtctcttgaaatgtaattgcattcaaataaaagcctgatattatacagttattctacactgaacagagaagctattagtcttattcctcacctgcatattcactagtctcaagacctctaaaatttcaaatttagaattatgacatatagacaaaggcatacatagggaaaatagtcctttagtctgaaaggtacattcacctaattcatatttaggtgggcacacctgatacggcctgggtactgggctagtcacccgggtcatcccctcattgtctaccatctggcgggtggggcgagcaggcagattagtaactaagcaagtgggtgagtattatcaaatgctaaataggtgctatgaaggaaagctatagaggccagcattgggacctacttagggtatgtgttcagatagggcctcactggggtcctgagggatgaagaacctggggaagaacattacagggtggagaaatgagcagacccaaagactccaaaacaaaaatgctggccaatagcaaagggcaagtctcaaagcagggaaagctttatagaacccagtgggattggagactagatgaacaaatgtatttcaacaccttgatctcagcttgcatgagaccacattttggcttggattgtgtttcagtgcagtagctaagtggcttaccaccctcgaccatgtgggtgggcatgctgcaattcttcagcaaccactggataactgcaaagtctaagaaattcagaaatgatttactgatttatcattactttcacttctaaaaatgagactacaaaacccattgtattattcattaacattgcatgttgttatattttaaaatgtaatttttctccttttttgtcattatggaatgaggatctgtgtgtgaagatacgatgtacttaaattacatattagccctcttttctcatttttgttttactgctgtgcacattcagcattgattataaagtacgtgtcctttacttttgaactcttcacccatttattcattggtttttgctgacggtgccaaactatgttagaacatgtgaatccaataaggatatgattagttccatttaatgataatcagccttctggtgtggtttccaggaatacattttatcaataaccaggaaccacttatttgcaaaatcaaaatcatctggttgctaatacaattctgctaacatattggtgttcttgaatgtacttgcagaagagcttgtactacttttccataagttggaattgctttgttattactatgtctaagctatttaatctaatccagtcttagaatgggaatttggtgattctacttgtttttttttaagaaaggggaacaagttatatctgcaggcaagtatgtccctgtgcatttttattttttattttgacagcctacctataacttgtgaaggattttggctggcagccagactcagagcagtcaactatacaattgtttgtgtctgtgtgtattctcaagtgtctttatagttgaaatgaaataagtaataagttcgttgtacagcggaccactctagaccagggattttggcagatgctttatttattcagttctgattttttttttttttggtacatctgctttttctgtgaagtattctgtgcctctttataaccaatgagaatagattcttgattcaaagcaaaactttgttagaaagatttccatgtcaatgcaaaaaattagattaaagcaaaatgcatccataatgcttgaattacactaagtaataaatgcccacttagatttgggctctaatttttaaacatttatttagcaaaatactgcctcaaatatgtatgcaggatttgggttggattgacaagaaatgcagttctgaatttcataaagcattcactagggagactgtattgtcagcagcagtaattacagcaggtaattgtgtcatttaccctgttacagaccactgaatttgacgagcatgggacataccagctgtcaaaccctgttaagctttcacgttctgggatttgcaaaatcacactagggctcactgttagtgaagggaaggaaaacaaaaaataaaccaagattaaaaactattacaatttttagagagaggcttttctaaaaaacaaaatgtaaatttctgtaaaatcgaaattcattgtgggtatccatttgttttgtttgtttctttatagtcaaaagctgctggactggaagtaaagataactaagattctgtcacctattaattctgcgacttattaactgtggccttggatatgtcatttactctgaatgaacctcaatttcttcatatcatcaataaaaaaaaattggtgagagatgcagccgacagggtccaatttctcttaaaattctctgtttctactgtaaacaaattctctcttacatgctggagatgtgtcagtgaataaattagggtctctgtcctcatccaacttttatttgaatgaggaagacagaccataaatatataagcaaataattttgtatagtataatgttagagaggaacaagtgttgtgaagaaataaatccaggtaaaagaagtgatctgagacagagcgtgtctaaggaggtgtcctctgagcagagttctgaaataagtgaacaagtgagtaagctacaaaaacctgtgaattaatagcatctcaagaagatgggacagcaaaatgctttagctattcaaggaacacagagaggccagtgtgattgggaagagagaagcagaagatgactacattgcagggcacactgtggccatggcaaagactttatattttattcaaaatgggaaaataagtcaaatgtcatgatctgttttatgttttgaaatgattgttctgcttgttgtatgaaataagaaggctacaggtgaatatgtttgcgtattaactgactacattcaaatatgttgatatatatattgtcatttttttaaatcatgcgcttttaaacttatagggaaaacattttttagagatgttagagaaggctaatgattaaaattgagcttcttctgatatactttgatttttttttccaattacctttggagtttcattttaccttaggtaatatagaattgtccataatattcacagaagaagtaaaaatactaactgcttgtgtgctggcgagcttcagtgtttcaacccaattcaggaaagattgtgagatagggtcatgtgttgttagattttattaaccacagtgtaataaatacttttctagatgtttttctctgaaatagttgactggagacagagagaggagagtccaggagtttaaatctaatgacatacaaataaaagccttctgttgcaagtattcagcaatcaggtcaggagcttcttagaacattctagatggattttttttctcctcttgatgtatcatgccaacctgctccattttttttaatgcatgaaaacattcaatcaataaacacagatgaagtactaaattctggtcagacactctgccaaacacaggatatagcaggggtacctgccgaaggtttggcaatgataaataatatgtttgatgtagggagctaggggcctccttttgaagttgcatttgcacatcaaacatatatattgtttttacttggatgtgtaggggtggctggagagttggttgatgccattatggtggggccaattcccttttaaccactctttgttatgttaataagggtataaaaatgaaacacatctttataatgaaggcagtcatcacctagaagcaaaggttggtaggcaaatatacaactgccatgcagggtgttcaataccatgataaaggaatgcacagcagtctaaggaaacagtttaggcaaatatgctgagtcatgaaagtcctgaagtagtgacagagagtaaatattttaaaaaagaggactttcctatccccaaaataaatctataattaacatcagtagtgtactttccccaacattcacttgttcagaaatatatatatatatatatatatatatatatatatatacacacacatatatatatatttgtcatcttctcttttagaaaattatgtttctcaagagtttcacattatgattccattattctgtttttcactgatctggaactttccataatggtcacgtctcactttcaaagtaatcattttcatttagtttattattttggattgcgcgtggaggatggagaatgcagagaccaagttagaagacagagaagcaggagcattagtgagtcaccgtcaacttgatcaatctgtcctagaggccctggaggctacttgagccagctatattttgataactgcaaatccttttcattttgcctttctgccttcctcttgtcccactttaccttaaagggatattgtgagtgagtgaatggattttatcattcatgggaagatatatggaacatgtgtagataacattacaagagggaacctttaaataacacctatttgccagttgtactagatctgggatcccagagaaaagaggttgggggaaagacgatagtgaggagggaggtgctgggtgtaattagaggagggtagaataagagccatgaatacaaagagtgagcgttttccctagagcaggacattgctgattgtaattaaaatatacacttgcagttggggagaagggtacattattttaaagtttttaattttgtggaagaatataagaaattgaaatgaataaattggagagaggtgtgagtaaagcttgcaactgggaaggaagcaagggcaagaaatagagatataagaaggcaagtagtggaaagagaagggaaagtaaagaaagttggcatcagaatcaatccccatttgttgtcattcagttgcttcttgttttattattatactttaagttctagggtacatgtgcaggatgtgcagttttgttacatgggtatacacgtgccatggtggtttgctgcactcatcaacccatcacctacgttagatatttctcctaatgctatccctcccctagcccccaccccctgacaagccctggtgtgtgatgttcccctccctgtgtccatgtgttctcattgttcaactctcactcatgagtgagaacatgcagtgtttggttttctgttcttgagttagtttgcagagaatgatggtttccagcttcatccagttgcttattaagctacacatcttctggtcttcgggtcacgtttctattcatgtctgagcaacagtctgattggaatcccagaggccaagggcataagtaaaaatggcaaacatcagaagaagggaagagttagcttgttggtgtgagaaaccaccagggaaagagaatgatgaattgacattaaagtatctcttaaactcccctgaaaacttttagtgattcctgggggcaagagctcccctctgtgaggcacagtgagagaagaattactgaagtttaaggaaccttatcaagtaaaagtgaatgattctgagtgagatttagaataaaatccattttaaattctttaaaaaaatatgatataaaagaagaggcactctaaccacattatcaaaagagaatatccttttgtattttagaaaagatgacttttggaataacaaaaaaaaagatttcactctatttctaaattgattcctgccactcgagcagaacaaaacacaggtgtaagttagccattacttgctacttaatatctatctatgtctagtgcatataaattatatacatacacacacatatatactatatattcacacacgtacccacatatatgcacacataaagaaatacagttgtatctattattttatgagggaataatatccatagatatcttgagaatgagaattctgccttactcatcttgtaacgaccacaactctaatttaagcacaggagaccttaacacgtatttataacatcaataaacacaccactgcaaatcaaaatattaaaagacctttaaagatattagctctaaaatgttagaaataaatagtctgaaacacaataaacacagaagcatgaaataaaactgcacaaaagatacttttatatgcttcttcctgttttatcaagaacaatgtatgtaatcctttggaataggaaattatcttttatcttgtattttgctgcaggagatattgaaataacatactctaagaaagataaattttgtaatgaagctcgttttaaaattaagcccctgaatgaaaacactgataggtttcttttgccccatagtctcatcactttaaaatcggaggaatcattctattttctataagttggaagattaaaggtcagaaagtagtatctgatccaactgtggaaatctaatatcttaaaattcattggaaagactgtctatgttggaatgctatggttgtttttcttaggaaattgtatatttcagaagttaccttttatatttcattttgttttgaggtacttttttctggtgtagtttgttgagtgtactctttaatcttatttatttgtagatattaaaggagagcaggccttaaagtttttaaaaaatgaatagatcatatggggttaggtggaagtgatatttctctccagcagagattttcactagcttagtgaaagccttttctttctttgaaataaatgtcaatggatggaaaatcatgcctcttgccaaatttaggggcagcactgacatgaaaacacaggagcaacaaggttgaacttttgcattggtgaagttaagcatcatgatttcttaagcagcgtgtagatacttttctaaatattaaatctcacgggtgttacagggattctgagtgagtgcaatgaactctagatgtacaatgctctgagaaattgaaaaatgttgattttgtatctgttggagcctaaccatcattgattcatccatatgtatcaagtgcctaaaacgtggcaggcgttaacggcaagatgtgagggttcaaagatctatactaacattttctttctcaagaagtatactgattatggagtgacaggtaagagaattaacaatccctgacagcgtgaggacagctggtgtaatactaactcatgaagcgctacgtgaaccaggattattctcagtgctttccagacgttaccacatttgagcctcacaactctatgaaaggcatgcatatccacagtcccttatctatagatctaaactccaaaaaatctagacagctgtgatgatcaaatgtttatttactttattttctttgttttttcttattaatttttatttcaaagaggttctatgtggatgcagttaaaaaaaaaagttcgagcacaataacaatgagtaaatccacgtgaaggatgtaggtacttcaaatgtttattttttagaattcatttggcagcaaaatttgatcagatatgaggctattttgcatctttattgatcctatttggtttgaatggtcatatttttgctgccgaaatacttaattattgagtatggccccagatcctgcagaggattttgcttctgtactgtttttagactcattttgtagaggaggaatctgtgatttgaagagattaagtaacttgcccaagacctcatagctagtaaaaggaagagccaggatttgagctgaggcagcctgactccaaagtcctttcacctaaccacttcacattctggctttcaaatgttataacaaaatgaaacacaggttctacagggctcatctaaatgagactgagagagtctcaaagaaaattttctgaaggagttttgtgtgatctgagtgggaggtgagtagaagagttaagcaaagaaagtgggaaggggctttctgggccgagaatagcacatgtggcagcaaggaggcacacgtgaaagacatggcctttagtagagtctcaacaagtgatattactactagaagttgcagtgggtacatcaatgtgcagtttggtaaaagcagagggccatgatgaaagctttaatgaggatgtggtgccttgatggccagtgaaaacaatggtgtgccaccaatagcaaaattaagagagaggaagagagaatggggaggattggtgggggcagaaggaatggagattagattttataaaaagttattctgataatggtctgaaagtgcaccaaactggagacagtgttgtcattatgaggctattgcactaatccaaacaagagctatttagtgcccagtttggggcacctgcagagcaatggggatagagatgggaggacagaaatgagaacttttaagaaagaagaatccaggtgacctggccccggataaatgtggggagtgagaagaagggagggaggagtctatggtgactcctggattcctggttttggaggaagaaagacttaaggatagatttagctgtatatttgtctgtggatgggaaatctgaggacattctctcctgatgacctgaatgtttatctgtgaggttgctggtgaagtaatgtgctgaggatggaaatggggcaagcacttgaagagacaataagagatactgcaagattgccattctggaataccttgaatattcagcattgtcaggtctctgaatgttttgcatgttagattgagacacactatagatcaatgatgcattccttaacagatattcattggagaccaattttgtgccagtcattttgttttggatgttgagggtgattgatgaattagacccacgggtttaccatgtaagtggcggtcgttaaacagatttgaggtgaagagtgtttatttggtttatgatcaccatcaatagagtacattttgtttcctaagatggtccttgcctttatattttgactttttacttctatcttcttctttgccataaaaaaaaaaaaaaaacaaaacccaggcgaacaagaataacaaaatacctaaaggtaagaggctctcttatatctattaatctcatcaccaccttcccagttgcctaggttaagaacctaagttatctaaagtgtttcttcctcttggctcaaatattgattcactatggagcccaaaattggagtacaaatctacccttctttctccatcattttctccgttatactttagaccttctattcaagacagtttaattcacaaaatcacaggggcttggatgtgtaaagtgaatgagacatggttcctgccttaaagggattcaaatcttgtgattttgttgtaaacttcccgatgattcctcttctgtccttagtacttccttatgctgcatgtatacgttacttagcacagtgcttgacaggtaataagcactcaagtttctttctgtttttctttgttgtcaacatccctcctcctcctcctcctccttctcctcctcttccgccgccttctcattcttctcctctttctcctcttccttctctcagtgttgcacagactcctgtctcaactgtcagtaataatctaactcgaatggaaaagaaataaaggaggaaagagggattaaaaagagagaggaatgctaactttctaacatgagaagcccattttgtcaaggaatgttaatctctcctcatctacacattactgttagattagttttcctaaaaatcaactcaatttttcacgccaccttttcttctacagctggaagcagctatttattgcctacaaaataaaattctgttgtagtctggacgctactgtttagcgtccagtaattatttcttactgttctcttttagtcatcaccatctgccagctcaaatacttgagggcctttttataccccatgcttttatcttgtgcacctgtgttttctccagctgcagtgttcttccccgtctttacccttttctgttaaaaaccctccctgtctgtcaagagccacctgttcggcctgtttcccatgtaatgctttcccagaaccttcagtcagtcctcatctctttgagctccttaagcttcatgagattttcgtttacaggttgtatattttaaagcactgaaggtctggccttgttactttctagctatgtgactttggacaaagcaccttattgctccaagcaagctctgtattctcatttataaaataaaaataaaactaatacctacccgaacaggccttttatgaagactaaagaggataatgcatataaaacacttagcacagtgctttgcagtctgtagtaagcacttaagaatttagctactatcattattgttactgttattgttttctttgttatggcactaaacaacttctacaatatatcatagttagttatctattcgtatcaccagtccttgaataattaagaagttccttggggtcacagatctcagattatccatctttgcactctccagagcactagaatgatatagctgaaaccttaaaatcatatgttgagaaaacaaatctatctggttacaagatttttattgccctataatgagttcggacaaagcttatttgatgaaacacaaaatattataaaacatgtcttagcaataaaatcaatagttggattagcttatgaaattactataaggagaaggaggaaatttgaatgtgctttggttgttaagattcttggtcaaataaggattaggaaaggaggctgagcacaccagtgaaaagactagaagaaaatcagccaagcatgtcaggagaagaaaatcagaacaaattcctagttgccaagcaaactgaagaataacaagaagtcagtattgaatagaatcggtgtggtcagtgaacaagaaacttaaatagtgaattaaaaatgcctgggtgttaaaaatgacttttagagaatttgctactgatatgggcatcaaataagtttacagtatgacttctggcagtcactttagtagcattaaaaatagatttctgttaaaatgacatggtagtaagtaaaatttttctataatataaagtgagtaaataaggtaatcacaagaaacaaaatgaatagctgttgctcaatatgtcagcaggcaattttcccctgatgtaatcattgaaagtagtggggttttggaaacaagaaaaatgtccaaaatagatttgatttcagaaaagattgtgaggagaacaaacactgtgggacatttaggctttctccacagaattaaaatgaaatggaaaagagaagacatctatctagcaaaagcaaaagaaattgtcccactgaagtagataataggcaactaatttttcttaagtgtccttattgttgcaagcaattttactttcatcctttaaatttattcttcacaactgctttttcttttttttttttttttttttttgagacggagtctcgctctgtcgcccaggctggagtgcagtggcgggatctcggctcactgcaagctccgcctcccaggttcacgccattctcctgcctcagcctcccaagtagctgggactacaggcgcccgccactacgcccggctaatttttttgtgtgtgtttttagtagagacggggtttcaccgttttagccaggatggtctcgatctcctgacctcgtgatccgcccgcctcggcctcccaaagtgctgggattacaggcgtgagccaccgcgcccggccacaactgctttttcatagagatcctaatttcctcattttaaacttagaaagcttagctaaccttctcaggtccagagaactaggataaaatggcatctaaaccaagcctgtctggaaattagaatatgtactatatacactgcctccctgttattgttcattacaatagtacataattctctcattttttctactttatctttcaaatttagttgtggtcctactacagcatagttgatcaaggacatttaaaatcatctaatgaattataacacaatgttttcatataccagacttgaaagggaaggaaggaagaagggagaaggaaggaaggagtaccacttttttcttatagacctaaaaccagaaattctggagttgtaacatagaacattctttaaactcagcttgtactcattttggaaagatctgcagtataataattatattgctaaagtactgaggtgctgtggacaagttcagagagttgttcagtacactaggacagagagagagtatattttatctgaggattcacagttgttgccattctttttggaataaagcaagaagtctcagtattgcagatctgtgggctgtgtgatttggatgctcttcacaaaccagtgcaggtcactacatatttgctttggtggggacacttaacaagtgatgcttatggatggacatcggtaaaacccattgatatcttaagcaatctagtctacagaaatattagaggaatatgactaagcagccatacattttttagataaaccatccctctaaacatgtaatttgatactgttgttataagctactcaagagcaattcatacctcttttatgggcttctctgctccaagacttatttagcattaagtctaagggagctttttctcaggtttctaggaatcaaatgatagttacgactagaggttggttgtcactatgtttagggccatatctgctacaatctaagagataatttacttacgtgaaatttatattccagaaaacacttgggttagggaaagtgaagcagctttctttgtgaaacttacacctgtatgttactgtagctgctgtttttccaacattttaaaatttgaacagaagagtagaagatgcaagataggcaatatatttcctgtggcaggagaaatacattagagaagaaagtttctctgagggtagtgggctgactatgaaggtatattatgttctgttaccagaagagcagaatctagtgtataaaggtgtcagctagaggatctaggatattgctggtagaatgaagcataattatccagcacaatgcacagtgtttctagggcctgaccactggtggtagaggagaagactctcagacattggaggtgtctatttgccaaactgatttaatgttgcgcttcaagagacttttaagtgcgggcaattggtgctagagtctaagttctgttagctggttactttgtttggcagggatttgaacttgaacatgttgttatcatccttttcttttaaaaacttatatctaccttgtgaaaatgtgggttttagtatgaacagaaagtgatgtctgtcctttgccttaagaagtgctataattctaataagactccttttagatggtgtttttaaagaggtataaaatacagtaaagagatgataacgtcctaattgtaaagcagcagaagacttcacatacaacaaaaagacattaaactgtgtaaacataaaaaacttctggataattataaagaagaacactagaataaaaaatgaatagattgggaaaaacacaagcattaaatatgttgggcaatcaattacatagcaatcaatagcctgaattttggagtcagatgtaattcacaactcccctatttactagctgtgtgttcttgggcaagccacttagcctttccaagtcaagtttaattttctgttatgaaaatgtttttagttaatataaggattaaatgagataatatatgtaacaaagtatgtgatatgtagtaagcactgaattttagctatgattattataaattattcagtatgattcaaattataagggcctcgagattccaaaaacaaaagagacaaagtatgtgaatggtgtttttaattgggaatctgcacctgccctcaccaacacatgtaaaaaaaatccatgtcaaattctttgttctccaagaagtcattcttggattcctacctgatccaaccagatcctcccttgatctcttgcaaccccctgtaagcagtgttacttctctactttagcaatttctcataatgaatccatttactaaagctttgtgtttttttacttatgtcttcaactaaactgtaagctttttgaaggcttttaactttataatcatttttaacccccaaatattccaaaactaaatacatattgaagaaaaatgtactaaattgaatttaaatgtagatgcacttaaatggtgacttttcactcctattttctgaagtatttgcattttatattatactgaaatttttgaacagagcatggattatgttctattgtacatctattttgaaatcacagtgaggaaagctatgtgaattttagagcagctggtttgtttctaggtagcacattcattctgcaaacagctcaatatgaataccaaatttaaacctcatcttaagtccatgttattatgactgatgacactgttggatatggaatcttaaaatgattttagatacattagcatacccaggttgacttaggggttaatcagtgaaagccaagtattattgttatacataacatctgcgtttagatgcatccaactgtgtatattattacttttttttcccatggacgaactttactatattgtgcctcatcactagtatgaaatcaggtttacattgtatgtacagatgcagaacaaagaaattatgacacacagggaaaaatattttctaactatcactatacaattatagattctatatataatgttccatagtgattgacatccaaattactttttagtattgttgagtgatggtgtcttccttcgatatatttttcttttttcatttcatttaaatttcaaattcatagacacaacgaataattaaattctgattaaaataaccatgtgctgatatttttgatgaagaggagctagaaaatgatgcatttgatttcacttccagctgttaattggattgtcatatcatataaacaatgaaatttttactgaggatatgaagatagcattgagtcttatagattggatattccaaacatcagacctgaatgtctgcctttcaatatatgagacataaaccttgaaatttattcactattacatcctgacatgctcttcttaaacattggaacataatattgatttaaattttaccttagaatttccttccttattctatttaattttacttactatatattggaagtattggaggaagtactagaaatggagaggcgaactagtgatttgatggtggagtcctcaaggaagtgtgagtcagagaaaggatgagaaattgacatttgaccaaaactggaaatggagcactaataattatctatttattgagatgactttacagaatatttgcttgttgcttcatttatattctgtttttgtgaaggattatcaaatcttctttgagactacagtcgtttaaaaagggttttcttaagctcacagtttacattagttcataaattgtagctataaccaactttattttaagtagtgtgaaaagatttaaagtgatagtgtaaaggaattaatattttctgttttcaaaagatgtcctaatatcttaattaatatttgaaatatccaaaatcaaataaaactgcaccatagtaaaatcaatgtgaaaaacagctcggatttttaagagctctgtgtttggcatgtagtctacaattgagcaaactgggattgtcttgaatgatggcaaaggaagtagttcctatcttgccccatctattcatttaatcatttatttaagaaaccttctttgaatgtttaaatgagatacaaagaaaaatacaaaaatctggtctaaaaattcacagtcccagagtggagcttaagaatggagaactaaagagaaatggacataaaattacaataaaagagaataatagaaccttgtatgtggtgttagggaaaatagatagcagcccctaactctgtaggagggggagactaaggtatcttcgcacaatacgtgacattttattgtaatgtttaaaaatggtaagtgttttccaggagaatctgtggggaaggacacttcagtcacagggaacatatatatatatgtaaaggcatggatgcatttaaagccttcagaactgtatttgcctttgaattgcctaggagcccactttctcatttcagtacccatgagagtaaatgacaacagaggaaaccaggtcccagactgtgtaattatttagcgtttattgaacattatcatgctagatgctaaactgaatcttgttaggtcctttctctacccggtgagtatggtccaattaaaaagacaaccaaggcagggattaaaacagcatcaaatcaatcagcagctctgttttaagggcctacggctgtccatatagagatttatagattaactgcggcacttcgaattgcactggggatgaaattggcagcaggtgcaaacctcattcaaagtgtagatttattttgcttcaggcagcagaacccaaaggtaggtgggctgcccattctagcccttctgaaattttatggtggtccaagggtagcctcaattaggagacccatgtgtaatccagctcttttctaagctaccagtagtaatcatgaatttataaaaactatgaaatgttctgtgatactagataatatgggtggaattttgtacaattttgggttattcagccaggaatttggaaaataatatatccatttgtgcagttctagaaccttggtgattgaaatctttctttcctctaaaggattattgggaataatctctaagaatgtagtttcagggttataattaaagctatcataactttgtgctcatatagaatgagacataaaatgccatagcaaaatgacaatttttatttttttaaatgaagggcattttattttagtagttgaagtaagtgattttagtctaaccttaactgtatatgccaaagacaatttacggatatattacaagttacagatctattatgccaaagacaagttacagatatattaccattataatgtctggaatacagagttctaaagttaaatcaaatatttcattgctttcatgatttatattacgtgaaattaatggctcaatcaatgtaatttattaaaatgtatattttgttttaggcctgaataatattcatgtaagagactgagtactaagtagtgccactgtagggattttagatggctgaactaatttgtgtgcattttctcacatattgcatttcctcctcatctgtattttgatgttagatttgtttgctttctcatgttcactgtatttattccttacatttacatctttgctgaatgctgagctagaattctgaagttacttgatattcctgtgaacttgggcaggctacttaaacactctgagccaccgttgagtcaccttgaaaatggttacaatgatattggttctgcctctcccacaggggtgctgtaaggatcaagtaattcaatgctttccagagtttcaagttataagcagttagagcagatactatattgattacatattctaaagtttgtatttgcacatattacaaaagcaagtttgtcttttaatagatttgtgctgctttctttgcagagtgagggaacttactaaagagatcaaagattccccagacagttagcataagtatctttaggcttggaagtgtggctgcaggtgttaacggcaggcacctaactcctagaacttcagctttattatcctacaggtcatgacttacaaagcaatacaatttcacatcgttcacatgctacagagatgagttaggtgacagatttatttcatgagagtaactccccaaatattaactgtatacagctgactttgtagtctacttctagaattaatcctcatctttgcctcccctctctatttcttgcaaccgttggtaggccttttgtccaaattattttgcattcaatgtttgtgaatgtgtgaacttgtatgtacatcaagaagagtatataatacttcaaaatctgagctcttctataatttataatttgttatgtctgtggttgaaagaatttaccatgcaataaccaagactgaaggtgtagtttaaaatatagctttggaaatataactttgagtaacaaaattgtattcctcatttcagaacatgatgagtgtatcacaaatcagcacaactgtgatgaaaatgctttatgcttcaacactgttggaggacacaactgtgtttgcaagccgggctatacagggaatggaacgacatgcaaaggtaaaaggtttaaatgccagtgcctcttccattatgtataatgccatccatctctaccttcctctacaccttatcattactgttatgtacattccaggtacttcctacagacatcaaaagctttggtgtgtggctcatagtctttccctcaggtcttgacatcctcctgggttacttcagtgtttaagtgaccaaaccattcagctcctttgacctaatgttccttgaccttagccacagtggttttcatctctgttcctttctatcaaacccacacccatcaccacatcctgggcatttttgtggagaactgctccatcttggaagtcttaaacttcaacattctattgtctaatcccaagttcctcttcttccagtttgctcagtctgttctttctacaccttttgatctttaatttcgttgaaccttccttttcatccagtttagcactctcccagcttcagatgtttcttttcgagcccaaacatgcgtacatcatcatagctgttttctggcagcgttgtcaacctatttgttatgctaccatgtgaatcaactccattttgagtcagtaggacagtttttttttttgtttttttttttttgctctcttgtgagctgtcggaggctactgtggaagattaattaaccatgaatattgattctctacatgttatagtttcctattttagcttctttgttaatgccgattgatcattcttttaaatgtcccattgaaatcagatttctttttccatcagtagacaatacaactgtagttcaccacaatccattaactcgccttttcccccactgtactctttccctcctacctcctaagggaaatagaagacctttttggaaactgtgaactcccatagtataacatttacatcccttataatgtcatatgatttatccaatttaggcattttaagcttcaaaactgctgatttctcaaatataccgtgtcctttatctcagagttcactaaaatcagtttgctatgataccgtgtctgtgtgaggtaggaaagaacaaggaatagttgttaacgcagtgtcttataaggatggttcttaaggcctggtctacaaaaatacactgtagccagagatgggtaggccagaagattaccctgattttcaaaactccatggaaatcatcagtgtaggtcattttgaaaaaggcctaattatttggggattcaaatcccacaaaaatttgcttggaaaaactaaacaaatcctgagaaaagctagacttttagaatgtaaagtatagtacagcagttccctcttacccacagttttgcttttgatggttttagttacccacagtcaaatgcagtctgaaaatgttaaatggaaaattctagaaataaacaattcttaagtttaaaactgtgcaccattctgagtagcatgatgagatctctcactgtccaacctcatgctgcctgggatgtgaatcatccctttgtccagtgtgtccacactgtctacaactagccaccattagtcacttagtagccttcccgattatcaaatacactgttgaggtatcacaatgcttgtattcacgtaaaccttattttcactgggcttggtggctcacacctgtaatcctagcactttggggggccaaggcagatggattgcttgagtgtagagtttgagaccagattgggcaacatctccaccaaaaaacaaacaaaaacaaaacaaaacaaaaaacaaacaccatgtacaaaacctaactcaaaatgggtaaaacaaaaacaagtaatttttattttactgttaatggccccaaaatgcaacataattgacctattttattataaattactgttgttaatctcttactatgcataacttatactttaaactttatcatagtatgtctgtataggaaaaatatatatatacatatatatatgtatatatatatgcaaaaatagatttctgtgctgtctgaggtttcagggatccactggggatcttgaaatgcatttccaatgcatgagcggagactacaatataactaagtccttaggacttcccccaaatcacctgaaggttctgagagtttgcttaggcttaaggtttcatctaggagcccaaaagcttttctcttatttctgcttgatacaaattcctatgtagtatgaagaataaagttcatagaataaagagctctgaaaattatgaacagatgcagacagataattcttgtatttgaaagaaggagaactttcaaggatctataaattccttctggaagttaggactacaggttgcccgaataaagactgttcggttcctgtatatctttgtttggaatgggaaaaatctgagagataagtagattaaatgtaggagctgaatcattgagttctgtgcggtatcaacaggctgcaaccttgcaaattactccagtgaaaatatgtacatggtctgacacgcacattctttatcacttatgaggtttaaaccaaagaagccaaatggactctttgagtccatttctttaactcatcactagaatttcagatttctacattttattactctgaaaaagtgtattctacctaactagaggaagcacatgccagaaaactatagagaaaacttttgtcttaatgccgggaacaagctggtctaattcactcattatagactttgtcaggctgaggaagcagctgctgagccttacagagccaaagaataagccaaagtggaaataaaagcttctaaagggggctcagtctcatccatcttgtttttctcttcttctcttgttgtactcacttgtcttgctcttctctccttcttttatgcacttcttcgaagacagcacatttcaagagatcgcccttgcaatggtacagaccttggctcccttgcaatggttcagcttcctactcacagaacaacttgcctcattcccaaaaccactctgataaaacaggttatatagtgtcttggcccttgatcctggattctgacctatccttagcagaggaatttaagagtctccctgaagaccactctaatgaatttttcttactattggttaattcattaccaggacccgcttacaaatttttgaaggatggaacatttcctactattttggcactttggctagtgtgcaaaatggtcagagcctcatgggattcaaccatttcctgtttcatggtctcgttctttagatggtggtttgctccatctaggatagctgccattttcaggtttattttcaaggtggattgttacaatgagaagaaatctgaattttaatgtacttcctattgtgtaaatttgctgtttgttgttcaaataaatttcagtattttgttttaagggtgaaatacttctttaacattggaaagagtactgttttacaagttgtgttgaagtttcttaaatgtatgggaaatattacatgaaaacaaaattaaaatagcttttataatttgatgtttacatctccaaggggataatgaaaagctaggtttggagtttattaaactacttacttctaaagtgctaaaatcatgtatctgaattattttagcattttgcaaagatggctgtaggaatggaggagcctgtattgccgctaatgtgtgtgcctgcccacaaggcttcactggacccagctgtgaaacgggtaagaatatcatttcatcttctagaaaatgaatttttatgccaatgcataaagtaatccatgaggaaaataatgtttcaagtttcaagtgggctctcaaagcatggagctattaataaggaagtgataggagggaggaggtgggaagtttcagtgatgcatttcgctgggcgattccccaaagtcactctaaaaaggttttgcagctattataactagacgcatattgaacttttcagaaacatgtgtggaattacccaggattttatgacttcataattcattttactcatttggaatccatttttactggaatctatatgactatattaaagcctagatttcaagcttatggccaactcagtgccgagaacacactatcacctgcatccacaattaggaatttttaataaatttttatctggccctttaattattcattaataattatttatctggaaaataattaaagttttctactcctcaattatttctcattcagatccattctgaacttactctttctgatggacgtgaatattaaaaactttaaaaattattttaaaaacaatatatagtctacatataacttataaccctaaagtaaaatacgttgtccaatgaaaaacacatcttgggaatttaaaaaaatgttttgagtattaagtcctaattaaaatcatactagtagtggttttggttgcattgggttcagtaggttccaatagtgatgacctcagaaaatcaggttattcttcctaaaagaaagcttctgccactggcaattgacagttgtcatctcatactgcttttcataaatctcaatgcaatagatacagtacatgctctgcctctattccacttgcagagtcatctagtttaataaaaacactgatttaccagaatgtgagacagaaaatgttctgctccatttgggaagtgaacattttactgaatagaatctgctactgtgcacagaaggatgctcacaaaagggcttacatcactagatcatctctttctataagtactgctaagtggtgtttttcaaacttcagtgactgatttcaaaagtctgtgacggacaatgcatagtgtctatctttggtatgtaggattctttcttaaggggatcatttcctaaatcagaagctccctaaatttattgtgcatgagagtcacctatagagattgataacttgttagaaatacaggtttttagtaactatcatatgatatactaaatcaaatcaggcacctctactgcagtagtcctctcatgtttctatggcatgctctccaccagtttgcccctacacatcaaggtgcactgtggacctcctgcacatcaacacctctgatcacaaggcttcctgaatacaatatttgtgtgccgcttctggtacagaggctggatacagaaatactggctttttcaggacatttcaatggtgtgaagataatggtgtggaattttgaaataaaagctgtcccagaaaatctgggatgaacagtggccgtgcacaatcctgcacaggattcttccactaggagaaaatatcacaagattgtagaaatctggaatggcataaaattaatactggcaatgtaatatttaagactggagttaaaaataacccaagagaacatgtagctatctctatttcattatacttgaaccttcagtctgtaagaagacaatcccagactgattctaaatagctgtctgtggcagccaagggctttgagaacagatgtggactcaaaatttagttgtactgtttatatgttatgttgccttgggcaagttacttaacttccctctgtgttgtaccctttatacatcaccttactcttcgccattctcttctaaggcagttattatctgtatttgcatacagaaatactgggttcagggtgtttaatgttttcctttttcctagcatcagagttagaagctgatacaaaggtcattctgctcccaaatccaggcttttatccagtgcatcccagtatgtttctttggggggccttaaatccaaagacctcaatctgaattcattatctcctccatgattcatgcctcaccagttaccatcctctaccaaaacctgaatattcttttcttccttccttactagtttatttcagcgaatagccaccttatccaccaagtcttctaagccagtcatcagggagcaatttccctcttgtcctctttcacatccagtcaaatccttttgattccttgtctttaccagggtccattttttctattctggtcagtgctacagttgttggggactttcaggtttgtctctggctagtccagtatccacagaataacagagcacaaatctgatcatatcactccagactgaagaaaaactttcatgttccccattgccctcaggataaaggccacatttttaacatgataaataaggcccttcaggatttggccctgcatatctacccagctttaccctcttgtccttctgccatctcacttcattcccacccccaggcagtgaatctcatgagggtacaggatgtatcttatttgcttttgtatcatcacgaaacagtacaaggcctgcctcttagtagttgttccataaatatttggtgaataaataaatgcacacatgagtgatcaattaaatgatgaagaaaaagatggtgtggctgtgtccatatttgttggacttttctgaatattagttgaagctttcagagttatctagttctgtactatcatatggcagatatggcacagaaacgtgaagtagcttatataggtgtttcattgttgatccagatctacattctagaacttgggtcttctgatttctagcccagtgtttctcttttccttccttcccctttctctcactccttcctctttccttgcttccctccctttcttcctctctctctctttcctgtcctgccttcctccctccttctctttcttcttttcttcctgctttcctttatttcttatgccatgcttcgtcccaggaattcatcacaccatcatccttcatcaggtctctgccttttgttatgcccccttcaacctgttgtctttaacagtgaagactgtggcagtttttctctgcaaagttaaaggatgcttccagattgacaaaatttccaagtataggaatggcctaaatttggcctgctggagttggatgctgcctgatagcttagaaaggaaattattgtgcagccccagtggccatctgctgagccatcacagtggaatcactgaggatgaaataataggatttacttgctttttgaaatcttaatgtgtcttgcacttaccaccccttgttcctttagttgaagtctcttctgaaacaccctcccctcatttctgtttctgcatcatgtgtatcttagtaggaatggttgcattcatttaccacttcacaaaagggcgatgtgtatgatttttactgagcgaaattaattttttatggacttcttttttagccactgtataaaatcacccgcatgtacagcataacttcatttttaattaaatatcctaagattccatcaggtgtttaacttggatttagcagggtgattatttcttgggtaattcaataaaatgtattagaaagctgaagctatgtgccaaggtttacagctttatcactgccatattgtatttattacacaattgctaaacctcagcaaatatgtgtctgatgatctaattaatatacaaagctatcttattatactaaaagcaaatctttcagtaatgatttaaagcataactctaaaagatttgacagtcccctacaagcacttgctgacttaaatcaaattaaaatatttataactgggaaaaagttggtaacaaatggcaaagctgaaaaaaaattgctgcagtatcaaagaagagatcagacattttgatgataaatgctttttttttctgtgcaaataatggatttcttagccacatatcaaagcataagatgagattttaattatttttgtgagttgttaaatgaatataaatttaagttgcacccctaagtgtttttgtagctttttaatatgtgttgtttcaaaatgacaaaaatgaagcatgaggcctacatgagtgttgctttacttcaaaagtaacttcaaatggattgaggttggttgattttttttaagtttattttattactgttatagtatggataatagaaattatttttgttagaaaaaagttatcttgctagttatatccaaagttagcatttattattaatgtcaaactattacatttcctggcatggccaaattagcacatttttcatcataaaaggtatatgttgatttcattaatatttgtttttttaaggcatattttttccagaaatatgtataagtgtatatcatttttacatacgaagtctaaaaaaattcagaagcaagggaaaattctcagaacagttgggacatggcataccttttcttaccaatatgactcacagtggaaatacattaccaaaatatatatctttatgtgagaaaagaggagaaattgagaagaaaatctgagacaatttgataaaaagaaattaaaaagaaaaactgtagatacatctgcttttccaataagaattttttagttttattttgaatttattctgctttatctgaacaaatgcaaatttcatgtacacaaatcattaaatatactttactgtaataaagacaatttggaattaaggaagctttgcttctagttctttactatcctattaaattcagttttctgaatcttaattttacaagggaagatctgcaaagtagctcttgggtagattttgcagagtgggcacatactcatggagggttctgttgatctgcctaagggatctacactcatgctcactcactagacacatctgatcttgaaactgtctccagtgataaaagtgattcaattatgtttgataaatgaatgtgttttaatgaactttgtgtgaattaggggtgtagataccaatgattctttttctgttataaaatgaacaaataaaacaacaaacaaaaagcactctcaccaaaggctttttgaccgtaccctgcttgaattggcttagataattaagacgtaacttctctttatgttggtgatccttaatctgttttaaataagattttaattgcttaatgttatgccaaaccccagttctccttgaagaatttaacatagtggtcaagaacacaaaagttgaagtcagagaaacattggcctgagaactagttctattaccagccagctatgtgacccttttcatgttatttcctttttttcactatgccttaatttgtgcatgtagaaaataaagatgatagtaatatctatctcatgggtttgttctagagattaaatgaagtaaggcacatagcaccatgttgaagacttggtaagcactcagtaaatgacacctgatatgatgattttgtaaattttaagttgaactgtaaataaacttttatagacagaactgtttgagactctttgacatccttgagttagctggagatgccctgagatgttataagagaaaggttaagagcaataaaggattctagttttcttgatccattcataaaccagttttaagtataattttactgtactatagtggtttaaaatgtttaatttagtgatttgcattctgtacatttgcttaaaattgctttatttttgtcctaatgcaaactttaaaaattaatcttttatgaaaatataaatctttatattattcaaaaagtagtcaaaagttcttagtgttaaatctcaaagtcattcttccaagtccttcaggttaattggaaaaaatctaactcactctatatatcagtcgtgtataatagataacaactatgatggggaaatttttcagactcttttgttgtaaggcctacctaattaacactggaaatgaggacacatcatggagaaaatgtaagaggaaaaaaatagctttcaagctgttagagagcaggtctccaagaaaaagaaaaaagccaagtggaattagttgggaatttggataagatcttcagttttattttaaaaatattatttttttcaatagatcatttttgtatattaacttgtattgtgcctttgaattcgcaggatccctattccctcttatttttttatttgaaactagccaaatggagtcacttttaagataattgtttaaatttgttttaaaattaattgaatattaatattttgaataaacattatgtacatattgtataaaatttaaaagtacaaagagcatataatgaaaagtaaatttcctttatagccatttcccaaccattgctttttcccttaacaaaatatcctggaaatcataccatagataagtccttgttagacagagtagttcaaataggaaagctgaggctttctgccattcaaatagtagacttttaatttgtaaaagtctgggtgtcaataggaatacatgtcttagggccaagatctttctctttttggggggtgcccccatgtgttggctgagaatgttctgcaattttctcattcataaattctgatttttttatatagataagctgatgaacgtctattgatcagaagtataatcgggggaggcataaacttaatatgctggagaaacgttgttgaatgcaacattttatttatactgaaattgtttttgttttttgcattctattcctcccttatttgtttcatttctttcttcttgaaggatatattttagtactctcttagagcagttctattagtggccaactcttgggtatagaattctaggttttccggccgggcgcggtggttcacacctgtgatcccagcactttcggaggacgaggcgggcggatcacgaggtccggagatccagaccatcctgactaacacggtgaagccccatttctactaaaaatacaataaataaataaataaataaataaataaataaataaataaataaataaataaattagccgggcgtgctggcgggcgcctgcagtcccagctactcgggaggctgaggcaggagaatggcgtgaactggggaggcggggcttgcagtgagcagatatcgcgccactgcactccagcctgggcggcagagcgagactccatctcaaaaaaaaaaaaaaaaaaacggaattctaggttttccctacgcactatgaaggcagtattccattgtttttggggggcctctgaggtttctgttcagaagtctgctttcaattcaattgtaattcattttaaaacatagtctctttctctctaattactttcaaggttcccttttctttggagtatgtggtttcaaagcattgtgcctgcgtatgaatttattaatatttttatttaccttgctagggactcctttagacgactgaatctgaagagttaaccgctttcatcgttttggaatccactcaatatttatcccttcggatattgcttctttccccttctctttattctctccttctggaaatatgttggcccttgtcttttctataattcttcactttcttttatacttttcatctctttatctctcagtgttgtgcctttgataatttttcaaacctatccaccagtgtacagatgaattcatcagctttgtctgatccattatttagtttatgttagtttttaaattttaataactttttaatttctaggagttctctttctcatatcttttggttcttttttccttagttcttatttttgtcttgtggttttgattccttcttttatgtctttcacaattttaaacgtactcatattatattataaaatttacagcattgctctattgcctgaagttcgaggggatctaaattatcttttattgtgtttgctgacttttgcctcatgattgtttcctcatatgttttggacttttggtgtctgaccttattatcttcattgaagctttacctgtgaagtctgagatcttttccctccagggaaaatttacatttgtttccgcaggtgtagcaggggtattacaatgcataatttgcattaatgtttttgccaagtggtatgccacacaaattatataaatttttaacttcaaaattctgtaagagctaacatttctttttctccccactcaagcataggtagaaataatgtctcctcctaatcgcctgtgctggtggattttttttatctgtgagtgcgtgagagagagagagagagagagagagagtgtgtgtgtgtgtgtgtgtgtgtgtgtgtatttctttcttactcttaaactgaggggcaggccttccaaggattctgcctatgctggagtcttgagcctcctataagaccaggttcactctgttgtcaatcacttggcccataaatccatatctggtgtttggcttcttatgccacataggaattttcattttttcaatgaggtcagttataagtttaatattatatttttaagccatgtgtatgtagaaagattttcaggttatgcaggtctcagtattgctggaataagaaagaaaatcacctgttttaaacataagtatgatttcactgatgctcagtgaatgactcctaagagtgatgaactttggccattcagaaatctgcagactgtgaggtgaaacttatgatgagagaatgtaaatgaggaggaacataggaaaaaacaataatgatatgaagtttatgaggtttactaggaatggagctgggggatgaggctgtttttttccgttcctaaatttctaatgctcccagagtctgtacttcttcccaaagggttctcatctatggtcagtgtctattgctttctgtcatggaaactttctggaagaagccactaggacttaggtacaaaaaaaaaaccttacagcagtcagccctatccatctaatagataactctcccttaaaaacttactgttttttttttttttttttttgagagaataaattatattccaggttaatttttttagacttacagtaaaatgtggtgcacaaggatcaagttaaatagcaaataatggattttgggccaagttaaagaagaacaatcaaatttgtgaatgacagttttgagagggtagcttatatgacaaaagacaggatcaagattcagagctattcaaattgtaggaacaatgggatcaaataacattatgacacttgacaaacaaaagcatctcctgcatttgtcctgctttcagccctcaacatttctagatccttaattctgatctcttccatctttggcccacactcattgtgttctttgcccctttcctttagttttcttttctttaggtgtctgtctttcctcccttacctttttcctcattccctcccactggagtatgagttccatggaaagtagagatggaacctatgattttgtgtttttcatagggcttgtcatcatgctttgcatatagtaggcagtccatgaatattaataaagtataaatacactcttgcatttaggttagaaaaaccaactgtgcaacatagagggaactaagtttaacagtttttatgctttatttggctactgattcgaagttaagtatgagccaaaagtataatgtgctagctttaaaagaaaatgcaaacttaacctataattaaaagaaacagggtctatgaaacaaaactctccttaaattctacgttacttattttataatggcatactgtatttactttgggccaatagttttaagaggctatcagcaaatggaagcataattgaggaaaagttttccaggagatgaaagtcctggcagatataagagggtagttgaataaatcttcatcaggaatatttttttaaaaaataagaaaaatgaaaggtgctgtaaaaagctatccttaaatacatgaagagctaaactagtgtgtggatttgggattagattaatctttgttgctccagagaggaaaactagtaaatttaccaggaggcaggtttggactccaaataagaaatttactaatcacaagaaccataggaaaaagggatagatcaccctgcatgttcaatcagagtctagataacgaaatgctaaggacacttaagatttccacactctgggacaagatggcattgacttattgggattatctaaaattcttcttgctatagttgtttggaacagtagctgcttcaaactccatgtctaagggcatttagtgtaataataaacaagcagtgcagcatgatggttaagagttacaagtaggcttggaggatggctctctggctataaatctaggctctgcaaatgacttctctatgtggaatagggcaaattacttaatatttatgtgcctcaatttccttgttttaaaatggagtgataataatacctattttaggcaggatgtgatgtggcttatgcctgtaatcactttgaggcagatggtggaggatcacttgaggccaggagttcaagaccagcctgggcaacatagcaagtccctttctccaaaaaataatagtagtttaaagaagaaaaaaaaacctgtttcatgacattgttgagagaattatattagttaatatggtaaaccaagcaatggctcagtaaatgttagctattatcatgaccttactgcaatccctacaataaccctctgaagtggttattattactagatgaggaaagtgaggttgaaaaagattaagtaatttgctctggtctgtacagccagtaaaatggaatagaaaagaataatttctaggactgtcatattaaaattttccacgctctttctgttctgatatttggcctcccactgcaccataggatgctaaaatgactgaaatagcagtaaactttgtggaatatgggtgccaaattatccacattaaagatttcttaagttcttgtgtgtgaacagcacaacatgatgtgtatgaagatgcagaaagtaaaatgcagttcttttctcttggggcttaatacctctgactgtcaaaatgcacagagagcattttatctcaatgacagagaaacagatgggtacaaaaataatactaataccttttaagtgactgctaactacaaatcttgtcaggtatggtaaccccagaagaaattgctcttaagaagaatgaattctagagctataatcccaatagttgtaatttacaggggaaggctttatgataaacttctactggtgggaaccttaggaggcaagcaaacagctgattaaatgtgtgaaaatatactttcaagtgttagacaaagtttccattgccgattttctcaatattcatgtcataagataattagaaggctgaataagagtgaacttgaacctttaggttaatcaaaagccttaaaaaacaagttaaaggggccaggcgtggtggctcatgcctgtaatcccagcactttgggaggccgaggcgggcagatcatgaggtcaggagatcgagaccatcctggctaacatggtgaaacctcatctctactaaaaatacaaaaaaaaaaaaaaaaaaaaattagctgggtgtggtggcaggcgcctgtagtcccagctactcaggaggctgaggcaggagaatggcatgaagccgggaggcggagcttgcagtgagccgagttcgcaccactgcactccagcctgggcgacagagcgagactccatctcaaaacaaacaaacaaaaaacaagttaaagtaactcttatattcttagctttttaagatatataacttcttcttctccttcttaaatgaggtgtgttttcatttgccttagcagcttttaaaatataaattactttttcactcacggatgttttttcttcatattttaaaagggacaactccagccttaaaataaaccttgactttgtccttttaatatgaagccaagcatatttactagttgttatcattttctttaaaaatgtttaattcgaggaaaagaaaattagttgactacagttgcttgtgtttctttttgcttgaaaatccatcaatctaacagattgtgtaagcatgacaatttattattcattatgatctttttggtttcggccatttacaacaaaaataaattaattaaaacacagatacctctaaacattactgagtgggcaagaatcaagagtaagttacacattacaggatgccaaaacttttactcagtgaatgatgagaagggggactctgtgtataaatcataaaacttaattacaaaccagaaggtactgaatctcttttacactggtaactttgtaccttacactaactgtaaggtatgtaagtataagtgcaatatttagtaagtgtctaaaatacattagattagaataaataaactaattttagataatgtagaagcagaatggggagatttgttagatttattaataaatatttacactatattttctgagaccagatctttatcttcaaggactttatattcttgacaggcaaataggagggagaaatttgtctataagcagtattctatacttgttatagtcatttaatttagacttcacccttccactggaatgactctcttggaaatccgatataacttcttaatcactatctccataatgttcacatttcttgacctttctgcagcattcaatattaggaatcaaaagttttatggcaaccccctttttctctggttttcttgacatgatattttctccagactaaagtattgcaacaattttatgtggtaggtattttgctcacataggtgttttcactcacttttttattctacatttgtaatcagtatttcttgtgtacatatatatatataatatatttttaaaattatacttaaagttcttggatacatgtacagaaggtgcaggtttgttacataggtatgcacatgccatggtggtttgctgcacccatcaacccgtcatctgcattaggtatttctcctaatgctacccctctcctatcccgccacccccaacaggccccggtgtgtgatgttcccctccctgtgtccatgcattcttattgttcgactcccccccgccacataaatgagtgagaacatgtagtgtttggttttctgttcctgtgttagtttgctgagaatgatggtttccagcttcatccatgtccctgcaaaggacatgaactcatcctttttaatggattcacagtattccatggtgtatatgtgccacattttctttatccagtctatcattgatgggcatttgggttggttccaagactttgctattgagcccgtatagccaagacaatcctaagcaaaaagaacaaagctggagacaccatgctacctgacttcaaactgtactacaaggctatgggaaacaacagatgcaggagagtgtgtggagaaataggaacgcttttacactgttgatgggagtgtaaattagttcaaccattgtggaagacagtgtggccattcctcaaggatctagaaccagaaataccatttgacccagcaatcccgttactgggtatatacccaaaggattataaatcattctactataaagacacatgtacacgtatgtttatttcacccacttttttaaagaaaagatagagtaagtaaattgccaaaggtgacatagctattaaattgacaagcctgaagttacacacagtaccatgtaaatgtaaagtccctaataaaacactgcaatatagctccaaaatggcagttctcacacccatgagcttttactgttactcctctccctcctgcctgactgcctttttttgcattattttcttctgttgctgcttatctcctaaatgtggaagttttacaagattatacatgtaatcatctcttttctttcttattaccatctcctttctggatctcagtcactttcaattcttcaaaaagagttattctatctcgacacctctcctaagcttaactcccactcccaaggggctatattgtattttcacttggacatttagcactatgcagtgacttgctttccttgggttatatagatcatgaatgcttttcttttttatactggaatcacctatgcctgacagactcatctcccttcatttccttcattcccctcaaagcaacacccatacaaacagtttgtagcagagtgttccaaattttgaggcaaatggaggaggaccaaagaggaacaaaacaaatgtcaaaaagacaaaatgaaatagagatcccatttttctaaaaatgctttggctatttcttctcacaaaatgagaggcagattttccattaagctaatgaagtttaagtttctgctctcttaatgcaaccaggcttctttccagcccttggaaagagccctagcaatgtgctcacttggccatatatttttgtaaaatctgcaatagcacatatcttggtaatatttttttcctgaggggccctcaaaataaataggcttctgtccccagagactgacccctgcacaaagttctttcttaccaggtaggtatttctcaccttacagccctccattttccctggactgtttctctttttatcctcccttgtggctctcaatttcacatctttacatttcctctctctctctatctccctcttgttctgtgtctgtctatctacctaactatctaatctttttcctctccaccatgctctgggaagagggaaacaaagcatcactttctctacccaaagaagtaatcaagatattttcctaaatcaagaccttttcctttattatgacatataccactgtcctatttatgcatttattattttgacctgcctttctaaattttctgagatatcagctggtcattactgaaaacttaccacatgccaaacattgtgctaattgctttacatttattaaatcatttaaatcataatagcaactttatgaggcaggtataattttttctgatcattttaaaaccaatgcttagggaggttaaatcatgtatccaaggtcacacagctagcatttggtagactcttgatttgaatagttaaacttagccacagatgtgtgcttttaccccttccccattttgccatccagataccactcttccgaaaaactctccttggtttgtctaacaagaagtatccttgccttgctctcaactcccatgtttgtatcaattttatcctctttcttcaaattaccttgtattgttattaatctttaatttttaaaattttaagtggcacataatagtagtacatatttatgaaatacaaagtcatatttcgatacatgtatacaatgtctaatgatgaaatcaggtaattagcatatccatcacctcaaacagttatcatttctttgtgttgggaacattcaaaattctttcttctagctatttgaaaatatacagtaaattattattaaatataatcactctacagtgctataaaaagctagaacttattcctcctatctagctgtaattttgtatcctttaaacaacctctttctatccccgctcctttctgtcttctagtaaccactgttctactctccacttctgtgaaataaacttttttaggttccatgtatgggtgacagcatgtggtatttctctttctgcacctggcttatttcacttaatataatgttctcatccatgttgctgtaagtgacacaatttcttcctttttatggctgagtagtattccatcatgtatatataccacattttcttcatctgttcatctgttgttgggcacctaggttgattctgtatcttggctattgtgaatagtgctgcagtaaacatgggggtgcagatatctcttcaatattctgatttcctttccttcagataaatacccagtcatgggattgttggatcatatggtaattctatttttagttctttgaggaacttccataatgttctccataatggctgtactaatttatattcccaacggcagtgtattagagttcctttttgttcacatccttgccagcatttgttattttttctctttttgataatagccattctaactgtggtaagatgatatcttctcatggttttggtttgcatttccctgatgattattgatgttgaacatttcttcatgtatttattggccatttgcatgttctctgttgagaaatgtcaatccagatcctttgccctttatttttcttggagtatttggtttttttctgttgagtcaaggttggtttttttttttgtatattctgcatattaattccttggataaatagtttgcaagatttttcttccattctgcaggtggtctcttcactcccttgattgtttcctttgctatgcagaagcttttcggtttgatctaatcccatttgtctacttttgcttttgttgcctttgcttttgaggtcttacccataaaatctttgcttacaccaatgtcctgaagcatttcacctatgttttcttctgtgttgttattaatctcaaaagtacaataacactatcttaaactcatggaacttcatacattgcttcgtgggaaccaatccagtattttatgaaatggtttttgtggcaaaaacacaatttcagttacatctagataaacgaaataactattataaaattcataagtatactgctttaaaaaatctgttgaaaacgtaagcatttattaccttcagcaggatataacctgtatggactagatctcttaaggatgaacctgggctgcattttgaaaactatatacctgtgacattcacagggacttcaaaatgcaatgtgtcatctctcctaatgggtgatattggctttaacaactgggaagcagctgttagaagaaaacaggtgttcttagttgacagggaaagtaattataagcattataattattaatgcaactatgataaatatatatatactaagtataaaaatatatatgcaaaaataatatgatataaaattaaactataagtaagcaactataagcattataattaatgactgcactctcacctgattctgagaaatttgcctgctggcatatatgcaaaaaataataaatcagtacctataaattggattagggtgattatacagtaaaataaactgtaagttaggagttgggtaggtatcagtgtgactcagggaaaggaatgtgacaagaggaaggcagggatcagatggaatgggcatatgaacaaagtgaaaatgaaattggacaccagtcattcaagtaatagtgatatgcatttgatacttaactgtatggtatttagtgggttggaaaaagtaggtgatattcagtgtgagaatggatctgtgcaaagtttctgttaggagaacttgaacaggcatgttggtgaataaattttggttttcctttgttacaaacaaagccaagattactaattaagagcaaccttaaaggatgcacttttagcaagcatcgcttaaaagtagtgtctcttctcatgcctgtaatcccagcactttgggaggccaaggtgggcggatcacgaggttaagagattgaaaccatcctggccaaaatggtgaaaccgcatctttactaaaaatacaaaaattagctggaggtggtacgtgcctgtagtcccagctactcgggaggctgaggcaggagaatcatttgaacctgggaggtggaggttgcagtgaactgagatcactccagcctggatgacagagccagactccatctcaaataaataaataaataaataaataaaagtagtgtctctttgtgcttgaaaagattgcctggagcaaatttttttcatcactgtcttttaaaattaatgccataaaaggagtattttgttgcctagcagttctgttttttttttttccactggactgactgagaggaatgagtgtaagcttaaatacaaagttagaactcagaaagaattttcaacagtaggcaggccaacatcatagtcaaaagtgtgagctttggagtcaggttgctggagttcattgttgaagttctgctacttacagtctatgccatactgagaagtaactccatctttcttaatctctatttctacctctgtgaaaaggagttaatggtaccccttatggtggtaatgagtattaaatgagttaattcatgcaaaacacttagtagccagtgcctggcacatactaagtgctaaatacatgtgaaataaaattattaaaaatagctgaatgaaattatagacagaaagtcgattagatgttaccaaaggcaagggatggaagggaatggggaattattgcataatggatacagagttcctgtttagggtgatgaaatattttggaaatagataatgataatggttacaaaacattgtgaatatagttaatgccactgaattgtacacttaaatatggttaaaattgaaaattttgaatatggttaaaatatggaacattttaccataataaaaagaaagaaagcatataaatgatggttctcactcaggtttagacctgttccacactctctttcctttgattttgcctaatgccaggaaacatacataagcatactttcagatctaacacactgattactttcagtgccatctgcagcgtactgtggcatgcaagggaagatccctgagacaaattatcctccacaatgtcccctaagccagtggacgtcattttggcagtctgaggggcctctagagtgcatgatcatgagagagaggtttccttcaacagacccccacagccttggccgtgaagcttggcttgggagggtgttcctgatggctcaggctgcctcagagaggaggcacaaggctgtggctttatgagacaaactcagccatggtgcttatcagtcactgcaagatgtgtccagatgtgctatgttccatttcatttaggtcaagcaatcaagcacaatgattcaaaattgaaaccaacttttttttttttttttgagacggagtcttgctctgtcacccaggctggagtgcagtggcacgatgatctcggctcactgcaacctccgcctccctgcaacctccacctcccgggttcacaccattctcccgcctcagcctcccgagtggctgggactacaggtgcccgccaccacgcctggctaattttttgtatttttagtagagacggggtttcaccatgttagccaggatggtctctatctcctgacctcgtgatccgcccgccttggcctcccaaagtgctgggattacaggtgtgagccactgcgcccaaccgaaaccaacttttataacgtaattttcaatccaaaaattttgctaatttagcaatagattggtgaccatcaagggggtttatcatgaggtgcacaaaagctaaggaaagctaggcccaagtgagacttttttccctgagatttcttctaactacttggtggctttcagaaaacctggagttttaaaataaacgtagctgtttactaaattggaattatttaaaaatacagtcggctatctatccatacttgaaacatatagttggactatttgactccagaagttcttttcgattctgtgattctatgtattaatcctacccagcattattagacattaatagaaaagatgcaccatcacaaatcattcccttggccaagctatgaaaatacatatgaaataatatgtgttaacaatttcgtaatgtaatatatttctaatggatctaaatgattaagcttgatagttattgttaattagtaataatcacgttagttatttttagtctcatttcattctgaatagggacaaatgtgtatataacttcatatttaaaaaaaaatatatatatatatatatatatattttttttttttttgagacggagtcttgctttgtcgcccaggctggagttcagtggtgcgatctcagctcactgcaacctctgtctcctgggttcacaccattctcctgcctcagcctcccgagtaggtgggactacaggcgtgtgccaccatgcccatctaattttttgtatttttagtagagatggggtttcaccatgttagccaggatggtctcaatctcctgacctcatgatccacccgcctcggcctcccaaagtgccgggattacaggcgtgagccactgctcccggcccatacttaaaatatttaagtcaataccttactcaactactgatgttagatgagagatattaatttgtattgcatgtgaggtcgttatgtttgtagttatttcacacatgtgtattgagtgctgactttgtgcagggcattggaaacgtgatgaagaaaattgggcaacatcgttgcccttgtagagtctattccaatctccttcaaaaaataacccttatatcttaataatttaaacgctaatatgctatagaactaaatgggaaaaaagctaactactgcaatacatctattattgtacttggcatagcaactctgtgagaaaaagtatctctgttttataagagaggaaattgcttaagacactatcaggtcaggttaataatgtagagtgcctcattgtagttgttgtttggtaaattccgtataattattttagataccttagcagaaatgtgggagaaactcgaaaattatataggtagatagacactattattctgagcagaggccttgaaaatgatagttcattgttaaaaaagttatagtaataaaagaaattttaattttttaagaattttaaagaaaattttaagactcatgtatttaatttttaagaaatcacgtatttatgacatatgtatgacatacatacgatatatatgattttatatatatgtgtgtgtgtatatatctatatatatataatcacactgcaaagttcattgcttctatccccactcactacaatagtggttttcaattagatatatatgattatatatataaatatatgtatatatctatatatacatatacattaaaacaagaattaaataaattgtgatatatttgcatatacatacagaatgctatcttctcaagaatgagatagaactaaatgtattgactgaaagacctccatcttgtagtaagtagtaaatagcaagtcatagaacaaataggtacaattttattatttcatttgaacagcatatgggtgtgaattttgcatgggtacataaatatactgaaagaatctataagtttatacaccaaacagttcatagtggttacttctaatgcagtttttttttcttttacctggagcccaataattctttgttatgggtctgtgcattgtagagtgattagcagcatctcttgcccccagccgccagacaccagtaacattctccctcccccattatgaccaccaaaaatgtctccagacattgtcatgtgtgcttatagattctttcagtatattttatatacccatgcaaaattcacacccatatgctgtgcaaatgaaataataaaattgtacctatttgttctatgacttgctattactacttactacaagatggaggtctttcaatcaatacatttagttctgtctcgttcttgagaacatagcgttctatttgtgtatgcaaatatatcataatatatttaactcttgttttattttttttcctgcctcagcctcctgagtagctgggattacaggcccccaccaccacacccagataatttttgtatttttagtaaagaaggagtttcgccatgttggccagggtggtctcgaactcctgacctcagatgatccgcctccctcagcctcccaaagttctgggattacaggtgtgagccactgcgcccagcctcttattttattagtggacatttcagttgttttcaatcttttactatttcaaatggtttcaatgcaaatcctcatatgtatattttttgtgcaaatgtgtaagcgtttctgtaaaactatttcctagaagtaaaattgcaaagttaaattgtatgaacattggatactgccaagcccttcataaaggatgtatgcaagttatattcccacaaactgtctatgagaatgataggaatattttcaatttttcaagtatgttttaataaaaattaatttaatgaaagcaaataaaattgtgctggatttcaagactgtttggacaaagtcacaaaggcctatcaagctggatcagaggacataataatggtcattagaaagtacaatgtgatgatcatggaactcattttgctccacaagcaatagcactgtgatgactaactcccatggcaggtatatccattgtctatattgttagggaaatttaccagagagctaatggattctggctgccttgttaacgtgatccagtctgtcatctgccttcacctaactgcttcgtaactgaagtaacagcagttgtccacagaatttatagcaacatggattttcagtaaggcagaggaaaaataaacctggaaacaagttgcctactgagataattagaaaagaaaccatgaataaatgaattctaagaatgagatatttggggactagaaatggaatcagtaaaacatgaattaaataatctcttttccctaaccttgccaaacagaacaactgcataaataaggctcaggtatataatataggaatgccacttaacccactacttttcttatgaaacagaaagagctggttgtaaaccatgatagatttgttggcacaaagagtgtcgtaacaagaggtctccaattgcatgactgttttgtcaacaaatctttaaaaaatctccatcagttatgtgacatttcttgcacactgctctgtcacttagctatttgtcccacagaaaggccaggctgaccagtcatctgtgaatagctgctgggtttacagtgttaaaaaaggtagatacttcctcttctttctgcatcttaggagggtaagcggacgtttaaaaccaattatgtaattatttaactaccttaatgataagagttgaaggtgctatgaaaagatatagcagagtgcctgacctagtctatggtgtagatgacaaaggcattcttaaagaagtgatatttaaggctgggcgctgttgctcacgcctgtaatcccagcacttctggaggccaaggtgggcggatcgcttgagctcaggagttcgaggccagactgggcaacatggcagaaaacccacctctatgaaaaatacaaaaattagccaggtgtggtggtgcacacctgtagtcccagctgttcgggaggctgaggtgggaggatggcttgagcctgggaggcagagattgcaatgagctgagattgtgccactgcactccagcctgggcaatagagccagacccagtctcaaataaataaataaataaatatatagaagtgtatttgagccatgatgggggaactgtatcacttgtacctttaaacactttaagcattttctaaaacacttagtgttcatttcgtatgtttcctagtgttggtttttctagaattaagctcctctatagagtgaaaatttcataaagaaatataatgtcataaatctttgttttttattaataattcacacagttcatgacatatggtaaatgtctaatttgtagtttcttttatttattcattggtttattcatttatcagtgtgtaagatgtgcccactactatctaaaccccaagaaatagtagtgacctagttgaaaaggtctctgctctcataagttttactttctggtgttggcggggtgtggtgtccaggcaacatccatggaaacaaataatttgtagcatcaagtactatacggaaaataaaatagactaatgtgacagagtgtgaacattagtggttagggaagcctttttaaaataaatggagtttgagctttgaatcttataccctccaaccctccttgtcaactttcattcattgaagattctgacatgtggttaatgacattcttccaccgtaccttccttggctcattcagtatgcaagtggataacccgaatgttttagtctgttttgtgtggctataacagaataccacatactgggtaattttagtgaaaagaaatttatttcttaccgttccggaagctgggaagtccaaggtcaaggggtccacatgtggtaagggccttcgtgctatgtgcttcatcccatggcagaagttagaagggcaagtgagcacaagagcaagaaggggccaaactttcttttatacaagcacaccctcaggataacacacctactccgagaaaatgacatcaattcattcatgagggcaggatcctcatgacctaatcacctcctgttgggccttatctcccaacactgttgcattagaaattcagtttccaacatatgaactttgagtgacacattcaaaccatagcaccaaacaatactctgttcttccagttctttgaccttctcacctccttcattctaccttagtgactcacacctgtggtcataaccttgaccttatcctcacctataactacatcactccctaaatttcactttaaagcattctacctttcggccaccacttcctgacgtttcatctcatatgccatagtatcttcacttcattaattgtttaactttgttgaacatattattttatctaagcacttttctaatacccagcttgatttcaaggttcatcaataataccactttgattggttaatcattctaaacacacctttatgaataccctaactttcttgctctttctccaaatatcatattgcccagcaaaagcccaggcctgggtcagatgtaatctttggcttccattctgctcctgagcagctgattgtggctggaggaaaaacatacaactgcactgactggtcactctttaaattcatgagcacaaatctcaaaagggcaagcagagctaccattccttagaatgtttttcttactccactcttcagaataactacttcatgcccatttctgtctcatcaagttttaactgctttctctgtcaaagcacccttcccagtctttacccaccctcctcctactatcgatggccttgtctctaccttctttgagatttaaatgaaaggaagtaattagccttgaaaaatgtggaaaaagttaaagaatacaattgtaattccttttccacatccctgctcaagaatgcctggcattctattgtgtctatttagtgtgagcttaaaatgttttgttgacttgaatttttaaaattaaagcaatcatcagatacttttttcttttcaatatttaccatgttttaggccctaatttcatctttctttttcctttgcccacaatcaaaacttgcaatatatttttaagatctctatattcaagttaagatcatagttcagtaatagctttcaattgatttttattaacttactgtaatccctcaaggggaaaatggcattaaggcatttaggaaccctacttttcacttttcaaaacaaactgaattttttcaagaatgtatttttttttcttttaaccaacctatataaagagaagtagttaaaatgagccacttaatggttttgtacataatatttttaagtgttaaaagttactttatagctaaaactcattcctttcaggaattcctgtgaaggaatttctacttcaatctgtaggttgattgttggtgtttaagcaactataaggaaagtactccagatatttagaagagtgttttgtaataagatctttaacagataacttctcagtgatgaattgagttataacccttcattagtttattctgccttctatttgccaagtgggcagtgtagattgtaaaagattttaaaaaaatcttttttcttttaaattaagtatctttaagatgtagagctctgactacttttcctataattaaaacttacatacacaaaagtagccgtccaattagtggcacattggtaagtaaaaactgatggctttaagtatagactttaaaactactagaaagttttatttattcactgaaaggcctgaaattatatgcatgtggaaatcacctaaaatagatatggaatcactttcataagtgactgaatcatttaggaagtggaaatgtaaattgtcccatgcaaatattacatttttaaaaaagttcgtctcaaaatgaaggtaacatgttttactttattgactattttgcaatcatattattttctatactgattttaaaatattgcagtaatttaaattcaaactgaagctctatatccttccaactgcatttgagaaataggcatttgttatataaaatgagctgaaatgtacagctcacaaataataaaataccctgaggcttccttttagtgatttttcgaacttaaagccattttccagaaattcagcaaattcatgcattatgagttttttgtttgtttgtttctttgagacagagtctttctctgtcacccaggctagagtgcagtagcgcgattttggctcactgcaacctctgcctcctgggttctagcgattcttctgcctcagcctcccgagtagctgggattacaggtgcccaccaccacactaattttttgtatttttattagagatgggctttctccatgttgcccaggctggtttcgaactcccgagctcaggcaatctgcccacctcggcctcccaaagtgctgggattacaggcgtaagccaccgcacccagctggaatgacatctgtcctacttctgagcacttactttgtgtcacttctgtgatgcttttctgtgagagctcacagatctgtgagacaaggcagtgagggtagcgggctgctccttactctcaacttaatctcaacagacaccattttttcccttgaatcaatgtgaatcttccacataactatcccctattctgatgaacccataacagaaaaatgacattacacagttaagaaggttataccagagtaggagtctctactacaagttaatcttaaaatgaagtgggtacaaagtccaatcaagtagacctttggagagattttctctctaaacacatatcattgcagcacattttaaaaaacagtttagccatcccaagaaaaattctgaaacacgtattttttgctttcagaaagctttctggatagttaaataatgtatataaaaacccataaaataatttgttatgaatatttgaatatggtttaacagtttcatagagctacagaatacattatgtcatttgatgcactctctcagaaagccattgaaatatgtatgacagatattccacatcttagagatgaggtaattgaggtaataaaggcattaacagattttttttctagtctcacacaaccagaaggtgtcagaacaaggaattaaagtctcatattctaatgccaaatgtgtctttaaaaataactgaccctattgatttaatacagtgagaaaacagtttaactgtatttgacacagttaaactgtgtttcttggtattaaaactaaagtcatatttagtaggcattcttctgttttaaggcggcagtagtaaatttgttttatgtggtaagccatatgaaaagctgggaatataaattttagagtcaacatcttataggacctgtcagaatatggttccactcaaaatcagtctacttccactgtctcgaaggttcttaatggacagatgtaaggccaaggtgctaacaagtgttacacttgtttcagaacaaaatcgttatctatatgcctgttggcacagcaaactggggtctaagtatttgtccatgcctttgaacagattcaaaactgatttgggggaacataatctgatctcacctataattagccccctggtatacctgcaagagtatgttacttctgtgagctaatccaaactctgattttttacaaaaacatgtagacttggttgcccatgtgtttgaatctaaagtgatgcatgctctcctaataaacaaatcaaaatgacaacaattcagggacaaatcagaaaattaaaattggaagtaactttgatccagcacctatcaaaaggtggcttaaaatctctgatgtttttagagagtaaaaatgaaaaggacatatcaaaatccattcctctgggttctctgagctccaaacctgaattgaataaagtaatgcaaaacaaacaaacaaacaaaagaatgcccctgagaaatgcctttgagaaaaaaactaagttgtgattgaacctaagagagacagagaaagtaggcttttgaaggctttttctgtttctttgcaaaacagtaataaattattgaccatcaccttaagacatttcccttataaactactcttacaattcaaaccatggaataagtctgtttcttcaagaaaacctatatgcaccattttgttggatgttaaaaactctccaaatttttctttttgactttgttgctgggtggatctcttgcccagtccctggcacacattactctctcctggagttttttgttgccacaaaaaaaaaaaaaggctatatttgcaaggtatagatttgaggagtatgcaaagtatagattttaattaaagatacacatctctaagcaaggcctagaaggaagactgtggaacagccttcatacaattttattgtggtactctcattgctttcaaggcattttcctatttctcttaactctattttcatagccttaggcctttttttttcctatcttgatcaattactttactttcaatttcttttcagaattgaagatttctatcgttttacttaaacttgaagtactctgtgataggatgaggggttttttgtttctatatatttaagtatatgttttgtttgtatatatttaacattttggtatcctgtattttaaagatcttattatgtttaagatgtttacaaaatggaaaggtgtagctccttgaagaaagttagtaaaaaaaaaaataattgttaaaacacagaagtagagggattaagaacagactcaaacagaatcagagagaaattgagttaaaacaaccatttacttcaatagatacttactgaactacatttaagggataacgtttggtactacagagtattcaaagataagtacgggccagctcttacctctaaggaatttaaatttcagtagaaggaattgaaaatacacaaattactatagcatgtgaggacttcaaaaggttcaaaggatagaaattacctccacttggtgtaatctaggcagaattcaaaaatgcaagttagaattgatcgggccacatgttaagagtcagggcaattactattatataaatgcaacgatcaaggtctgctagttccgttggagctagttttaagagaaggcaggctcggccaggtgcagtgactcatgcctgtaatcctagcactctgggaggccgaggtgggcggatcacgaggtcaggagatcgagaccatcctggctaacatggtgaaaccccatctctactaaaaaaatacaaaaaattagccgggcatggtggtggcgcctgtattcccagctactcgggaggctgaggcaggagaatggtgtgaacccgggaggcggggcttgcagtgagccgagatcatcgtgccactgcactccagcctgggagacagagcaagactccatctcaaaaaaaaaaaaaaaaaaaaaaaaaaactactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatagcatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagtaaactatcgcaagaacaaaaaaccaaacaccgcatattctcactcacaggtgggaattgaacaatgaggtcacatggacacaggaaggggaacatcacactctggggactgttgtggggtggtggggggaggaatagcattgggagatatacctaatgctagatgacaagttagtgggtgcagcgcaccagcatggcacatgtatacatatgtaactaacctgcacaatatgcacatgtaccctaaaacttaaagtataataataaaagaaaaaaaaaaaagagaaggtaggctctaggggtacatcataagatagatgtctccccaggaatgagatggtaataatgatgatgttgatggggatagtgatcatgatgataattattcaacacaagcctgcttattaggacaggcactgggaagaccctgtgatttaatcgtggaaaagactcaccacttgccctcaaggagctcatggtttagtgaggaaagagacctaatcaaaggatcccactgataatttgcagatatgactgcgaaatcttacagagaagtcagagctgctgcattgcacaactacgaaagtggccatccacgttgtgcgtggggagtgggatgggggatttgatctactcagggatgcctgaatgctttactgaggtcattggtttgaattgagatctaaaggaagcggaagatttgttggtgaagtagaggggaagagtgttctcagagaaaacagcatgtgcaaagagcctgtgatggggacagcatggcacatttgaggaacggaaagaggaccaatgtgcctggagcacagaggccaggaaagcctggtatattatgaggttttagaggcaggtaggggtcaaactatgatggcttgtaggtcattaacattttggtcttcaccctccagccaaagagaagctagtcaatattttaagtatggtcagatttgagttactcaaagatcactttggcatgaatgtggagaagatattggaagagcatcaaagtgggagtgagaagaaaaatcagaaggtctattcaatgtgagagatgactggaactgtgataataatgaagatacatgaaaatgtattgaactgtagctgtatagcaaaccctatgctcagtgctttatatgtattatcgaaagcatgcctagaaaatagtggtgctctgtcaaaataagttcacatttccacatcccctacagtttcactgcattaatccagcaaaatgcagttgctttagagtcaactggacacccaaaaggcaagaccaaagactgagacttcatcttataatattttattataaattattttggctccatatctctctgatgctaggtagaggcagatgtgagtgctttgcagcaaagatacagcaaatcaagaagtgtaaatgcttccaagcctctgagaaccaaagctgccaggagtttgtagaaatatctgcctgcacatacctgattgaaaaataaatcctcaaacttcaattattatgttatatctatttacttgtatctctcaagttttaagtaagttaaaaagggattaagtatagcagctaatagaatggtgttccattgtgctcacgaatttctatttatttttgagtcattcatttattaaacaagtatttgctttactgactactatgtgaaaggccctgttctagacactgaggacaatagtgaagaaaacagatgagaattcctgcccatgtggagcttatgctgtaagggaagaaaggcaaaccatacacaagatgtgtaagtaaaatacatgtatgttagatgagacacatacagcaaacaggatgcattctataatttatactaaattaatactagagaatagtatgaatcctataaaaaatagttttgtcttaaggaggaaagtaaagcagagaaacagggaatgtcaagtatagatgcatttgaggttgtgattttagacatctcaagaaggcctcaatgagtcagtaacatcataaatacctaacaaagataagagagcaagccatgcaaatatttgaggccagaatattcttggcagaaataacatatgtgccaaatctctgaagcactagcaactcttaattcaaatggtatttttgcttcatgttgatttacaaatttgtaatattgctataaatatcatcttatattggcacaaaataagactaagtgggtttctttttttttgctttatcactccaaactccatttaatgtggcatacaaggtgtttagtgggttttttaaaatcacaaattgtattatttttaaacattcctttaagttagaaaagacaaagattattgaaaatattaagtgggttatagatattttcactgcatttttaaatttaagacaatattaataaagtccttgatgtcaaagatgaacatattaccccaccagatttttgttcatttttattttatacattttcaaattttataaaatttcaactctttttgtaattataatttgtacagatttttcagatggtgaacatataataaaaataaaacagaacatagccaggcgttgtggcgcacgcctgtaatcccagctactcgggagactgaggcaggttcacttaaacccagggggctggaggttgcagtgagccgagatcacttgaacccaagagacagaggttgcagtgatctgagatcacaccactacaatccagcctgggcaacagaacgagactccatctcaaaaaaaaaataaaaataaaataaaaaataacaaacaagcaaaaacccttaatgatatgaaagaaaacaactagggaggttattggattgcatggtccaagaactctcttagtgggtaacacctaatccaagacaggaatgctcccaagatgccagccatgccaaactgagtgcagaacgtctccatgttgagcaatctcctagaaactggtatagtctccctgtgtacagttaaaatctttctgcgttgtgaggaattctcatattaaatacttcttaaatgtttcctcttgcatttattaaggtctctatttcagggacctcagttacccttaactgaattatttttgcctgttctccatatctattagtttcattctaatcacttaaatcttttcctttccaaccatatattctgtgactatcacaagtcttccttttaagttggaaactttattttaagaatatattctgttctttgctgtttctactttccttcagtgaagatgttttggtcttcaaatttattgcctttaggcctgtgattttctatttattagtgggttttttgttgcttttcaaaaattatctcatccctgggtattcattatttaattgatatcttcctattaagtgcttgtggtacatttctttgttttggagttacactttctcctaggctggatattttctttctgtgctacgattttgattgtcttctattgttttcagtcatcaattccattcattttccttctattttactcacacttgggcagtttggtccagattttctccttggcttctttctgccctatctcaaaactgtttgttgtaccctccacagttgtggtttgaagatgaggcattttgtgttctatccataatttcctatggcttgagagcctaatgggctgagagcagaactcagctgatggaccgtcttgtaatatctgggctatgctctcatttctaagatttcatcaaatgtttggtgtgagagctcaatccatattattggagaacatttccattcctgtagaagttcacctcagcctttgggtcagccctctgactgcacgttctcttctcttccagtatcagccctgctgtgcatgcctctgtttcttcagctttttcccagtgctgcttctaccactccttaattaaaagagaattcccagttagatctcttgacaaatctggcagtattgctgataaatttcagaatctctctagtctccagtgtggcttcttagccatgtcacatatctgcaagttgctgaggaaacttaggtttctttctttaagccattgcatcatactcatttaattgatggtggtgattttgatgtttttgctagaatatgtgctgttgttcattctaccgtctaaactaaatctcccattttccttatatatttatattctctagctttttccatttacctgtatacaaacagattcaaaatcaagtaacattgaaacactgttgtccagaaaatatgttaaaatgagtgaatatgaaagctaaaataaattcctagtatgtttcctaatttgcctaattagctgagtttctgctcatcacatttttttaagaaaatcaaaattattattatcaaaaagagcagaccaggcacagtagctcacattgtaatcccagtgctttgggagaccaaggtgggaggaaagcttgagcccaggagtttgagaccagtctctgcaacatagggagatcccatcactacagaaaaaaaaatttttttttaattaactgggcatggtagtgcacacatgtagtcccagctacccaaaagactgaggcagaagaatcgcttggacacaggaggtcaaggctataatgagctgtgatcatactactgcaatccagcctgggcaacagagtgaggccttgtctaaaaataaacaaataaataacatttgaataatttagtcttaaaaatattgtttataaataaaatgtaatgatgggccatggaataatagaatttctttcaaaggagagagagagagaaagaaagaaagagtcctttttttcttttttgagctatgcacgttttgctatgatttctctgctctcctcattttcttttttgtttgtttgcttattgtgcttattgtatacatgggtggctgtaatctacataccctgagtataaaattcttatggttaatattgatccagagttcctactaaataaagttgaaaacttagaagctgttttagaactgaatcaagagaaatgaagttctatagtcaaattattgtgcagtttatttatcttatcgtcatgggaccccaagaaaaaatatctatgtctaagggtaacaacttctcatattgcacatatgatgctgaaatgcttcaaaactcattttggtgtttcaataaaggtatttaccaaatatgaaatatcagcattgggcataaaattaattcattcatttgatcaatttatattggatgcctacgatgtggcaagaactcttctgaagactggagactccctaatgaacaagataacatcacttcccagacagagctttactttagaatgaggtagatggacaataaacctgtgaaaaaataagtaattgctttactggattcttaataagcattctcaactttcaccatataccatttcaacccagtcattgcagacctgagagctgagacagtatattagtgcaggctaattgctgactcatgcctgaattgtgtgctctgggtgacagaaccattcacactctgctaagccaagaaggcactactatgcataaaaatatataaagaggggagaataaaagctgaaactctttaacgattgccccatttactactctaccatctatagagaggaaatggttataagggctgtttaaagactgacctccatggtagattttcctctcactgctaagatggcttttgttcacacagctgttttaagaacttctttataagattctacctgccttttttctcttagtatataaagtatgtgctgtgcttcgagcctattaacaaagcacaatagggttgttctgaccttgattccttatagaagaaccccaataggtttgtcagtgcagcttccatagccgtcttgaaatattagctgtctttacaaggcaagaaagcagtaccatacaacattttgctaaatttggtttagacataatgcatttctgttcaattcttcagaccacatttactggcattcactaattgacaccatattcatggcgataattttgcccaagtctgagatgtggcaaataaagcgatttaagtttcaaggacaagttagcagagagatgaacagagtattatattatattttttaaaaagataacccttataaaaaccagaaaatcaggatataagtctttgagccaacaccccaaattgtaattgtgttctattaattagtgtaaaattttgagttttatattttaatgggcattgacatattccatggcaatgatactaataggaaaatccaaacaagtttttttaaaaaaggattgatgcatacatccaatttatcatgcttaattaagtgtactgaattatcggcttcgattgttgcaagtgtcatctcctttaatgaaactggccacgtaataggagactgtcacagtcccatttgtctgtgggtctgtgattgatcaatttttgacaacaaagaaatgttaacagggctacatggtggagcagtcactggaaaaatccctctcacaatgtttctgcctaattgtggagcaccagcatcgccacacatgacatagcaacacgattaaatttccttttgctcacatttagtgggacctgtgggggtgtgcagaaatcaatgggggatcaggagcctggaaaattacatacttgaagaattaatgaactataattccgtattacattctcaatcacattgtgcttccttttcattaatgaaactaaattggttttccatagacagggtacttttaaaaaatgcaatcatgcttctgctcagataaaagaagaaaaagttacctgcttttcagatgaggcttgttgtatcacgaaacatgtcagtaggaaatttatagagaagaacttatctgctgtgttaactcaacctgttgaagtgccttgaaattagcctttaaatccctggctggaaattgtagctaatttcccagtccttattctttttaaagagaaaaatgtttttgagttagatagtactatatagtatagtgataatcaaagacctctctgaatataatagatatcttctcataaaaaaaattcatagatcaaaatgtagttaatattcaaaatgcttttaatatcttaataagtatttcagttgcttcatattatttctgggtgccaaggcctaacagcatttggacatagtgttcatgctttataaaactgaagtctacgcttaacttttaaaatctttaaagaggtctaaaacagagccatttataaactaaaactattttcacttatttggtaatgattagtttagttaaaggaaatagttcatcgtttatacattgttggtggaagtgtaaattagttcaaccattgtggcaagcagtgtggcaattcctcaaagacccaaaaacagaaatagcatttgacccagcaatctcattattgggcatatatccaaaggagtgtaaattgtactattgtaaagacacctgcatgcatatgttaatcgcagcactatttacaatagtgaaaacatggaatcaacctaaatactcattaatggtagactgcataaggaaaatgtggtacatatatattatagaacactatgccgccataaaaaagaatgagatcatgtcctctgcaggaatattaatggagctggaggccattattgttagcaaactaatgcagtaacagaaaaccaaataccacttgttctcacttataagtggaagctaaatgatgagaagacattgacacgtagaggaaaacaacagacactggggcctattggaaggtggaaggtgggagtagggagaaggtcaggaaaaataactaatgagtactaggcttaatacctgggtgatgaaataatctgtacaagaaaatcccatgacacaagtttacctgtgtaacaaacctgcacatacacccctgaacttaaaatgaaagtttaaaaaaaagaaagtagttcatcatgctaggcattttgtacatattgctttctaatttaaaagcctaactatattacagcatgctatatatgtatgtgtatatataaagcatatataatgtatatgtgtaatgtatatatatataaaatatgtatgtacacatatacatactatatttcagaatcacaaatgagcctgtggcagtctaatctcataaaagtgaattctatcaggattcatatgtcagaaacaatttcattaatttctggttatgttattattattatatacatatccctcaaattctggcctttaagaatcagtttgcctttctaagttattatcttttaaacattatagtgatgatatgataaactgtaaaaatatagaatgtaataccatctctagatgagtcaaattcaaaggattttatgcttccacactctcactgttgtgcttcatcttcatgatatcagatctaaaatcaaaattgtctgaatgtatctcaatatgggaatagcctaattatataaaaacgaatacagagtttttgtcattaagtagtataatttggaaacacattacttaaggttggttctcactatgtgattatgtgattctgcactctttcatgaaattgtgatactctgctgggtttgaacttttcctttacacaaacttagctacgtttcctgccaccaaaccatagagtgtcatttcttttacaatcttaaatcaagtccctttttttcaacctttgtctcatctgcaagtcttttaatgattttaggcttgctaatcagaccaactacacccaacatatttttctgttttacttttataaatatttaatattcaagtcttcaattagttattttttgattagtgtgattttataggttgtgtctatgtatagtatttctgtttacctgtatacccctttcaactttaaaaattcccaaatataaatatattttaccaacattccccactttccttatcaaatgcctacagattggggaaaagtcctcatctataaagggaaggaatatgtacaagattattgtaagatgattgtctgatcagggcaatcgtatgtagcttagttatgccaggaaatacatttctatacctaaggtaatgatatgaggtgaatgccaggatctccattctggtttagggtagcaaattaagcaaaagaaaacttaaggacaaaagtaatatgaatagtgtcatataatagaatgcctgtgtcctctttatttttttcctccatatttctaggctatatttcagtacatgcttaagtcatcattcccttgttcccttgttttagcctttcttttagtagtgtgtcctctgtttttcattttctcattaccataggattacttagagtaattccaaatttactgtagcactgaggtcattcaactctgatttctatttcaagaacaatttttttaggtcttgatttttcaaatcagagtctgatcctaaactaggttaagtatatgtatctcctttctatttgatcatagtttttacaggagaattccattagcattgcatctcattggctgaggtatctaaaaaccaatagaaagatattaaaatgtatttttaaaaggaaatagtattgagaaatgaggatggagttacattttaaaactaaaaatgatttaagtactttttatcctgattcatgaaaacgtatagagtttttgtgtttcactaaaggtgtaaaactcctatcagataaaaatgcatatagtaggccagacgcagtggctcacgcctgtaatcccagcattttgggatgccaaggcaggtggatcacaaggtcaggagttcgagaccagcctgaccaacatggtgaaaccccatctctactgaaaatacaaaaattagccgggcctggtggtgcacgtttgtaatcccagctactaaggagcctgaggcaggagaatcgcttgaacccgagaggtggatgtttcagtgagccaagatcatgccattgcactgcagcctgggcgacagagactccatctaaaaaaaaaaaaatgcatatagtaaatagagtacttcataattttcaaaatgcttttacagaagtattgtaaagtagatataattgttcttgtttgtatagatgatgaaactctgtcagcaaagttagcaaatttgtcttagaccacagtcattaaatggccattgccgagatttgaactcagattttctgattacagctacaggtcagcccccagctgtaaatataggtcaaattattgtagctcctattgctattcataaaactctgtgtgtgtgtgtgtgtgtgtgtgtgtgtgtgtgagtatgtgtaatatctactagtgtagatgcaaaaaagcacatatgaactttgtgattaatatcttgttttattttcctgattaacttcatccattcctgataatattaacctactgtctatgccatttcttctccctgagtttgtcttccctttatttagaggtataggtgaatgctaattatatggcgacttctgaggttttccgttttcatttttaattttcttaagggcaaaggctgctgtaatctctacaataggcatctactctctaaaaataattcagtacactaaaaaatcttggaaatatcttttacatctcctgatcactcactcactacatcacatttgccattgagttatgtaattttgaattactttgtaattcaaactagcttttgaatctctccaggaagtctttcccactcttcatcttgactgcaaccattcttatcatccctcatctgaactattgccagaggctcctaagtttcctttccctgtctttatggtccctgacttcgaattcattgtccaaactgacactagagtaattggtttcaaattcagaggagaccaatcactatcctgcttccagtgattccctattaggagataaagtctaagcttcttaggaatgtgcaatcctcaaaatcctactcccacttgccactccagcttcatcttctctcgtttcccattccttccccactagactgttccctttcacaataatcatcattataatctgtaactgagaattgttgggtaatgtattcagcattctatttgtattatgatatttaagtcttacaaccctatgcccagagacatttaaaattaggttattccaatatcattcagttggtaagcgtcaaggcagacattggaactcaagcattctgactttagtacactctctagactaagcatgtgagtttcatgtctcctgggactttgcacttgctcttccctcaatctaaaagtgctctccctctcacagattttctagcaaacttgtgttcgtctctcgaaactttatttttattttgataatcctgtcacacaagagttacaatacaaggatagcagtctgtagaccatcctccatcaattctaagatgcacgtatttcacattttaacattccaaaaatcagaaagtgtctaatgatgatgtcattgtttaattggcagcatttttagtgatacatataatcgttattatgtgcaacttacaatgagtgaattagtaagattagataaaatatgatcgttgttagagttgagcatcaaatttgatactaagtctcttgaaggccaaaactaaaaggaggagaatatgcttcacagatctgaggaagaatgttctaaggtagaacattcttggcttcttagtgcatcagctttcaaactttaaggcacacacagatcacctggggagtatgtgaaaagacagattatcagactccattacctgggattctgatttcataggtctaggaaaaagattaaaaatatccatttttgtaaggcatcctcagaggattctgattcagggggtccacactgtgagaaccactgctgtaagggatatacagtgctgttttcaatgtttaactctcaagcggagcttccaaatgtgcatgggttgatagaggggatataccaataaggccctcatttcatagcaaatgcacaggaattatatttgcaggctgtcttcgtgtagtgtgtaatgaaagaaaaagtgagaccataatctgaaaatatatcttaacatggttttaggaaaaccaaaataacacaacctagatgtactccttgtatctaaaataataaatgaatagattcctaataagctgtatttccttcaggcagtcctcacaggcaattttatacacacacatatgcattacatgtttgtatgtgtgtgtgtgtgcttgttttattagatgtgagtctaatagggcacaactgtatctttatgccctcagggcctagcctagtgcctagcatgctgcaaatatcccacaatgtgctttcacacgcatgatttcatagtcaaatgctacactttcttgaggatactatataaatactgaaaacagaaatagtcagccctgaagactattacagtatttataccgtttcgctttccctttgataatggaaattataactcatattcaatatttctattctgtgtatttatcctcaataaagaatctcctcaaatgctgccccattacaaaataaaccatgcattttgctttctagtactttcttctgtaggtgcaattcacccaaatatattaatagcattcccctactgacctgaatttgtcgtttaactcactaaaaactataggtaaaatgtttagtttgaattggtaagtcaactgtcatatcctttcatcactgaaattatacagctggataaatatgaaaagggaaatgttccatcatatattatcacaaagtcattcatttaaccatggaaatgtgttatcatcctatttatgtacttttccaaaatagttgccttaggattatatcaatatatgctatattattgacctgcagtaaacttactaaaataagatttctgataaccatggtggacgttttcagctggaaatagtcatagaattttagggaccagaagcaaactggtaattctctgcatttgtaatatctgcggcattaaccttttctttcttcaaacctatctgtcaatttatttaacaagtctaaaattagaaaaggctatttctactagaaagtatcaacgaactgacagttccgtattttcaatgagaattaatatttataatgatggccccagggcactagaagattctttcaaatcagtaaagaaagattgagttatgttcaacatagttttaagagctaatgggtttcttatcttgtaattactcacaaatgtgtcctggcatatatgatgatctacttaattagactcactctttagctaagcggtgccaccctttccccaaaaaactatggatgaatgatgacttactaggattagtattagtatacttgtgtgcatttttaaataatatatcacttttaaagcagagcttcaaattcaggatttagaattttgctggtggcaaaggcaagagaaaaagaaaaaaaatcacctataatttctttctcccttctgatgttccattctttttttttaatttttttttattatactttaagttctgggatacatgggcagaatgtgcaggtttgttacataggtatacatgtgccatggtggtttgctgcaccaatcaacctgtcatctacattaggtatttctcctaatgctatccctcccctgtctcccaatccccatgacaggccccagtgtgtgatgttcccctccctgtgtccatgtgtgctcattgttcaactcccactgagtgagaacatgtggtgttttgttttctgttcctgtgttagtttgctgagaatgatggtttccagctttatccatgtccctgcaaaggacaggaactcatccttttttatggctgcgtagtattcagtggtatatatgtgccacattttctttatccagtctatcattgatgggcatttgggttgcttccaagctttgctattgtgaacagtgctgcaataaacatacgtgtgcatgtgtctttatagtagaataatttataatcctttgggtatatgcccagtaatgggattgctgggtcaaatggtatttctggttctagatccttcaggaattgccacatggccttccacaatggttgaactaatttacactcccaccaacagtgtaaaagcatttctatttctccacatcctctccagcatctgttgtttcctaactttttagtgattgccattctaactggtgtgaaattgtatctcattgtggttttgatttgcatttctctaatgaccagtgatgatgagctttttttcgtatgtttgttggtcacacgaatgtcttcttttgagaagtgtctgttcatatcttttgcccactttttcatggggttgtttgtttttttcttgtaaatttgtttaagttctttgtagattctggatattagccctttgtcagatggatagattgcaaagattttctcccattctgtaggctgcctgttcactctgatgatagtttcttttgctgtgcagaagctctttagtttaattagatcccatttgtcaattttggcttttgttgccattacttttggtgttttagtcatgaaatctttgcccatgcctatgtcctgaatggtattgccttggttttcttctagggtttttatagttttaggtcttacatttaagtctttaatccatcttgagttaatttttgtataaggtgtaaggaaggagtccagtttcagttttctgcatatggctagccagttttcccagcaccatttattaaatagggagtcctttccacattgcttgtttttgtcaagtttgtcaatgaatgttgacagatatgtgacgttatttctgaggcctctgttctgttccattggtctatatatctgttttggtacaagtctcatgctgttttggttactgtagtcttgtactgtagtttgaattcaggtagcttgatgcctccagctttgttctttttgtttaggattgtcttggctatacagactcttttttggttccatatgaaatttaaagtgattttttctaattctgtgaaaaaagtcaatggcagcttcatggggacagcattgaatctataaattacttttggcagtgtggccattttcactatattgattcttcctatccatgagcatggaatgtttttacctttgtttgtgtcctctcttatttccttgagcagtggtttgtagttctccttgaggaggtctttcacatcccatgtaagttgtattcttatgtattttattctctttgtagcaattgttaatgggaattcactcatgatttggctgtctattagtgtataggaatgcttgtgattttggcacattgattttgtatcctgagcctttgctgaagttgcttatcagcttaaggagagttgaggctgagacaatggggtttttaaaaatataaaatcatgtcatctgcaaacagagacaatttaacttcctctcttcctatttgaataccctttattgctttcttttgcctgattaccctgtccagaacttccaatactatgttgaataggaatggtgagagagggcattcttgtcttgtgctcattttcgaagggaatacttccaacatttcccattcagtatgatattggctgtgggtttgtcataaatagctcttattattttgagatacattccatcaattcctagtttattgagtgtatttagcatgaagcggtgctgaattttattgaaggcctttctgcatctattgagataatcatgtggttttggtcattgcttctgtttttgtgatggattatgtttattgatttgcatgtgttgaaccagccttgcatcccagggatgaagccgacttgatcatggtggataagctttttgatgtgctgctggatttggtttgccagtgttttattgaggatttttgcatccgggttcactggggatattggcctgaaattttctttttttgttgtgtctctgccaggttttggtatcaggatgatgctggcctcattaaatgacttagggaggagtccttctttttctattgtttggttagtttcagaaggaatgatagcagctcctctttatacctctggtagaattcggctgtaaattcatctggtcctgggcttttctttggttggtaggctattaattactacgtcaatttcagaccttgttattggtcttttcagggattcgacttcttcctggtttagccttgggagggtgtatgtttgcaggaatttatccatttcttctagattttctagtttatttgcatagagttgtttatagtattctctgatggtagtttgtatttctgtgggatcagtggtgatatcacctttatcatttttttaattatgtctatttgactcttctctcttttcttctttattagtctagctagcagtctatctattttgtttatcttttcaaaaaaccagctcctggattcattcattttttgaaaggtttttaatgtctctatcttcctctgttctgctctgatcttaattatttcttgtcttctgctagcttttgaatttgtttgctcttgcttctttagttcttttaattgtaatgttagggtgttaattttagatctttactgctttctcctgtgggcatttagtgctataaatttccgtctcaacaatgctttagctgtgtcccagagattctggtatgatatgtctttgttctcattggtttcaaataacttctttatttctgccttaatttcattatttacccagtagtcactctggagcatgttgttcagtttccatatagttgtgtggtttcgagtgagttttttaatcctgagttctaatgtaattgcactgtggtctgagagactctttgttattatttccaattttttgcatttgctgaggagtttttacttccagttatgtggtcaattttagaataagtgtgatgtggtgatgagaagaatgtatattctgttgatttgggtggacagttctgtagatgtctattaagtccacttggtccagagctgagttcaagtcctgaatatccttgtgaattttctgtctcattgatctgtctaatattgatggtgaggtgttaaagtctcccaccattattgtgtgggagtctaagtctctttgtaagtctctaaggacttgctgtatgaatctgggtgctcctgtattgggtgcatatatatttaggataggtagctcttcttgttgcattcatccctttaccattatgtaatgctcttctgtgtcttttttgtcctttgttggtttaaagtcggttttatcagagactaggattgcaacccctgatgtttttagctttccatttgtttggtaaatattcctccatccctttatgttgaggctatgggtgtctttgcacgtgagatgggtctcctgaatacagcacaccgatggatctttactctttatccaatttgctagtctgtgtcttttaattggggcatttaacctatttacatttaaggttaatattgttatgtgtgaatttgatgctgtcattgtgatgctagctggttattttgcccattagttgatgcagtttcttcatagtgtcaatggtctttacaatttagtatgtttttgcagtggctggtaccagtttttcctttccatgtttactgcttcctgcaggagctcttgtaaggcatgcctggcagtgacaaaatctctcggcatttgcttgtctgtaaaggattttatttctccttcactcatgaagcttagtttggctagataatgaaattctggctttgtttacaccatgacgggaaaaccatctactcaagcttcagtaatggtggacacccctatccccaccaagctcgagcttcccaggtagacttcagactgctgtgctggcagcaagaatttcaagatagtggatcttagcttgctgggctccatgggagtgggatccgctgagctagaccacttggctccctggcttcagccccttttccagggtagtgaacggttctgtctcactggtgttccagtcgccactggagtatgaaaaaaacctcctgcagctagctcagtgtctgcccaaacaaccgctcggttttgcgcttgaaacccagggcccttgtgtcataggcacctgaggaatctcctggtccgtggtttgctaagaccatgggaaaagcatagtatctgggctagagtgcacccttcctcatggcacagtccctcacagcttcccttagggaggggagggagttccctgaccccttgcacttcccagatgaggtgacgcaccccctcccgccgaccagccctggctttggctcgccctccctgggctgcacccactgtctaaccagtcccaataacatgagccaggtacctcagttggaaatgcagaaatcacccaccttccacgtttatctctctgagagctgcagaccagagctgttcctatttggccatcttgccagcccctgatgttccattctttaccttctatcttgttttgtcttgaacatcagagaagaactaattaatttgttttatggactattttttatgcagctagaaatagtgaaattggattagagctcaatcgattatccattttgtactttgtaccatccagtctttccccttttactggtcccatttcctcaacctgtaaacatattcaagtttcattaccttaagtaattccttaaatccttgcttttgttttcttctcaaaataccaacgtagccctctcctttccttcataggcaaactttttgaaatgaaatctgtatttcccgtctctattttcttgatgttccattcactttttagcttatttcaatttgtactcccccatgttccatgtgaattgctacatccagtgtcctctcttccattttcatttgactgaaccattttgaactgtggacagttctctttgttgaaatcctttttctacttttactgctcggggtgccctttcttggatctcttcttcctttggttcctctttttcagtcttgttttctctcgtgaatactcccctttacaattccatcctctcatttatttccatggcttcatttcatttttgcagtatatatcaaacaataccaaatttgcacttggttctcaatctctcttgaaccccatacctgtgttttcaatagccaattcaacatatttacccagatttctcacaaacactaaaatctcaacgtagtctaaagtgatcttccatgatttttttctccattaccttcagttgaagtgacaacatgtcagttagtcaccaagtcttgtagattccacctcttcagtacctctgcattgatcctcttggcaatgatcatcattatctttatttgtcctcttcagtgttcttcctttctctaatatagctctctttctaccatctccccttcaactttacctccaaatcctgttactgccccgtctctacccttaactgataacagcatttcagaggctaagaccagaaaaagaattttgatgctttttgtttctattttgcagtaatgttatcatagatagtgggagcagtggtcccttggtgaagaacatcagaatttggcaagtaatctgtaactcaaaaggggctgggcaaaatggtaggatccaaagataaactttccaaagcagaggtggggggccctggttcaaggctgggaccaggacatttcatgggagaacgagaaaggatgtgtgggagtgcatcatctgcttctttcagccattagcatgctgagagagcttcaggggacaattcattattgaacactctactcaaaagcttgttcatctccacattgctttcaggataatatctaaaatttcaggtccaacaaacaaatcccttcaccatctggccccaacctatatattcaccttgtctcttgccacctcccttcacaaaaatatgcacctgccacattgaatcactcactcttcttccatcattgtcgtcatcccatgtccatgcacaggctcttccctttgtttggaattcctttaccagcttgtctatctaatcattttagaagtcacttgctttgcatagcgtttctggcagagtacaggacctctgttatgaattctgaaaattcatttctagtgatttgttaacatgtttatacccctgaactagctgctggagagctggatcttagctgggttagtacctttaacaaagcccctcacatccatggaggaggcccagtttgctattaaagtgccagtgtctgtttctttaggtagaggaattgctccaggttgattcccactttctctgatttctcagcttaggtgatcctatatctggcttctcaccctatttctagtaccattggactgatgacctactaagattgccatttgggtgctgggtttattgtttgtttcatccccgcatgctgctcatagatcttgatctcacacactcccccaaccccaaggacaagctctgcctatccttttttcccacttaagatttcaaatcagcccctctgggtaagcacctgctttcctggaacagagactagctcatttgttgctgcatccacagtgcccaacatggtatttggaacttattagactctaataatatttgtctgaatggattggattttaaaaaccctgaagtaaactgcacagaccttattttcccttgtatcatgccagctatgctggattagcatcatcaaattaaagagactgtacccctcccttctcttatgtattatgcaggcaaaagaagctcaagagcttactttggtaagttatcaatagtccagattggtacttgctttctaactgctgtgctcgacagagtggacctgaaggcagcatgcaccttgggtatatgtgtacctaaagcctgtgagccttcatagctttatttcccagatctctggtgcctggtgcctagacatcctctctttaatcaatcccccactgataaaataagggaagcagggaatgaaagataaatattatgttatccatccccaggcagatttgctgctagatttgtctcctgcttagatggccttttcagaaactcagtcatgtcaaatcacacagcaggaaatcccaaggagctttctgaattggggtattgagtttgcttttcttggcctcctgtcatgctggtctctgcaacttttaatacagtgggcctgaaatttatcatgggttgaaaggttattgtgattcaattctgagactccagtgtccactcctcacttagcagacttggcagctgatcccattgctagcagtgggtctttgaagtagatgatggtgtcagttggggtacatggctaatgagctttaggaaagcctactaaaactaatgttattcttccactcaatgtttattgtcagcaatatgaaggttcgaagactcataagaaatactccctactctaggagcatgacctcaaaaagagagctggagatggtaagccacacaccaaaatagctataaaaccagttacttattttaggagatgcataatgaacctgtaagcactgtattcagagggaaaacagattcctactcaaactgaatctgaccttccagccctcacaagactctactttccacaactaggttaattgatttccaaacaggttgagtaggctgctgctcacagacccctccacctgaaccccaaccagttctgacttgggtactccagaccttccactcagttatctttgctgtcagcatcatctacgaagaatgactccatgactgacatgctgagttcagttattattcagagttggagtatgtcttcctccagcacatggcttccccattctaaaaggaggctacctactctgtgtttctaaacctgtgtctgtgaaatttctttttattaatgtgtactaaactattgtgttcctgttaagtaactccccattttaatacctgagtttccaaacacacacagtcttgcttcacaccaactctccctcctcaattctcccacttcctgtaactgaaggctaattctggctcctttgggaaggacagtttgttaccttaagtatctggaagttctttagttgttgacagtcatacaccagtaaatcattagagaccaatttctgaccattgtattgaatatgtgcataaaattgggaacacatttttattccatatgttttaatagctttttaaaaattgaaattgacatacagtaaaccccacatatttaaagtgtaaagtttgataagttttaatatatgttatacatccacggaatcatcatcacaatcaaactagcgaacatatccattatcgccaaaattttcatggtatccctctgcaagacctcattccaactccctctcccctaagcctagacaacccctgatttgctttctgtcattgtatgttactttgcatttcctagcatttatgtaagcataatcatatagtatgtactgtattgtttttctgttttatatttgatttattctcaccatgatctctaatattagttgacagttatccaggctggttagagatccatgtgtaaatagatatcttaacacactatggctccatttgtgggtctgccacctgtgaacaagatggcatccattcaaagttttcaaatgtgcaatttttctaaaacgtctgtaatcagaaggctacattattttatagctcaagtttggagtccattctgcagattcctcatgataatatagtaatatgccggtagcaactgccagcataaggtagtttcccacacacagtacatgatatctgcaatctgaagtctgtcctgttttgctagtactcctaccatattggaggctaattaagccctaaaatatttgcgctttactacatcatatttgggtgaaactagcatgtgcaagtagcttaaatgcacagatgtgtgcgtgtgtgtgcatgtgtgtgtgtggaataatgtgttgatagaaatgagcagtctctttagtttggaacatttaaatcctatattctcacaatgtccaattcattgtcctccgtggtattactttatgatttactttcaaaaacaccctactttttgtctctttgtttcgttgatatataatagttgtgcatatttgggggtacatgtgattttcgatacccatatacaatgcatactgatcaaatcagggtaattggaatatccatcccttcaaacatatactattctacttattttaagcattcatggttcatagttcactatatatttgacctttttaaaatttactgccttacactaggttatagaagtgattgttttgattcttcttttaaaaaaataggagaagagcactttatatatttgtgaaggtggaaattcttgggtatatttaagaatgttgcttggctgtagatatgaagccaaatagcagtctaaaactagcagttattcttttagaaatctactttcttagggtcaaaggttatattaggtcatgaatcaacctgggagatagaggtgaagagacttatttttttttttttctttttttattattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttctaggaaatgttcacctttaaccaactctgcagagtccaattgaaatagagagataaatagagtagataatagaagctgaccaaataaaatctcagagatgagagttccaaattataggtcatattttatggcacagttgggatccttggcctatggaaaaataaaatttgaaagtcacagcaacaactttaagacattgaaagagagagtgctattattaatgtggggctttgggatagtttcctcaaaatgtaaacacaagtaactggcttctttttgttcttacagtcttaacatcacatactaaaaatcgtttggtatgtgctttctttgtggagaattctatgtaacatggtaagagctggtagtaataataaaataaatattagtatgtctttcttttccccctaaaacctggaaaaagaaacaatctaatataaaattttagtataattatcttcattgcaagagacctgtaattgaagttttctgtgaaattcaataaatacagtctatctgagtgggaagtttgaacttatcagccagacaaaaagaaatgattattttaaagaaaatatgtgaaggtttttagcacttttaaggcttagaaacccttctaaaagatgattataggactttaattttagtatcatctttaaaaatgacaggttacaaggatgttattcatctcctccgtaatattgaagaatgaagagggaaagcaatccaaagttaccaattaaacctttggttacactaatctttcagaaaaatttatgtttgctgtacttgaaaatgttattaaattacatgcaatgagccaactacctaaatattctaattaagtgatctttttaaaatttgccttactttgcatcccagacatcacagacaccacattagcagtaatatgcctagtagctgcaatggaaactccccaagcttagcagccagaccagtcatttttctgggaccagtctcccgaaagcatacctaggaatgcctacatgcacgacctgtgtttccctgggctccttcagtttgtgtgtccaggagaatttcatgttctctgaggggattctagtaggcaatgctacaagagagtgctttatcttatgagtaataaaagcttttggtttcatttgctttagttattacttggtggtttttttaaaaagccactgtgggctccttcagtccaagttgggcactaagccctacctatactaccttagaattgtcttccagatatttacacaagcctcacatcatctcctcatcaaaccacttcctgatttttccaaacaccattaaccattatacccacttagaattctatgagttttccagtttttgttgctattgcctgtgtgaactgagggtaggcactgaagaagggggagaaggcacttgggagaggagaaggccattgagagaggagagagaatgagaaataaaaggaagcacacatattaaatacatcaagtttactcctgctatacagatctgtctctctgactgctaatgaactttctttactcatgtatcctcaagacctactaattagcagattctcatgagtgaataaattaatgtaaatgtgaatgcacatgacatatatattatatatgcatctggaaaaattaacatgcatatttaagggtgaataaatcagaaaacagggtacacaacgaatgatacctggattttctgtgcatggatgcatgaaagatgtagattttaaatagtttacttaggatatagtattgaattaggggaatatttttaaaccacttcattgaggtatgcttgatagacaaaaggctgtatataattaatgtctacatcttgatgagtttagggatacatatatacttgtgaaactgtcagtaccatcaacatattcatcacctcccaacgttttcttttgcctcattacaattttattgctttttgtacttgtttattggtaagaaccctttaacataagatctactctcttagatataaaagagagtattgttagctgtagatactatgctgtatagtagatacccagaacttacttatcttgcataactgaaactttgcacagtttaaccatcaccttcccctttccccttaacctcagctgctggaaaacaccattctaccttgctgctatgagtttggctgttttagactccacatataagtaagattatacagcacttatctttctgtgtctgacttatttcaccatatgttatgccctcctggtccgtccgtgttgtcacaaataacagaattttcttcctttttaatgctgtatagtatttcattgtatgtatataccacaatttccttatctgttcattcattggtggacatttaagttgtccccataactcggctatttatttatttatttatttatttatttatttatttatttatttatgttgagatggagtctcactctgttgcccaggctggagtgcaatggcatagtctcagctctctgcaacctctacctctcgggtttaagcgattttcctgcctcagtctcctgaaaaatacaaaaaaaaaaaaattagcctggcatggtggcatgttcctgtaatcccagtttggctattttaataatgctgcagtgaaggtgagagttcagatatctcttcaagatcctgatttcaagttatttggatatatatgtagtcattgtatttttaattttttattttgagttgattttttaattttaagttgatttgagttctgtatgctttaagataagggcccagtttcattcttttgtgtgtgaatatccagttttctccacatcatttttgaagagactttcctttccccattgtgtattcttggcactcttgttgaaaattagttgaccatgtatgtgtgggtttatttctggactctctattctgtttccttggtctgtgtgtctgtttctgtgccagtaccatgctgttttgattgctatttttgtaatagaatttcaaatcagaaagtgtgatacttccagctttgttcctcttatttaaaacttctttggctatcccgggtcttttgtggttctatatgaatttcagaattttaaattttatttctgtgaaaaatgctattggagttttgataggaatacattggctttgtagattgctttgggtagcatggacattataacaatgtgaagccttccaatccatgaacttaggatatctttccatttatttatatctactttaattaatttcattatgttttatagtttttagtgtacaaaaagaataaaagtattttattctttttgatgctattgtaaatggtattgttttctgaacttctttttcaaatagttcgccattagtgtatagaaatgcaactgatttttgtatgctgattttgtatcctgcaactttactcaattcctttactagttcctagatagggaagtattagcagcaatagtaaatagagccaaaatgtattatgacaaatacaatagaagtttatttttcatgtaactgcccaaagttaagtgtttctggttggcagacattttagagtctcaaactccttctaatctctctcccacccttcccctcttccctatgatcttgttaattctatccaaccagcagaataataagagactggcagtgccacatctgctttctaaaaaccctgaccactcatattccactttctgaaactcatgtagtctagctatgtgccaacaaggaagaggaaatagatttctgtgaaccattagcaatctcctccacagttagtgtactataactattttaattacttccaggaatttgtcttattaacaggtactatgactctattttcttcaatataacatgaaattaaatatgtgggtagaaaaatttacagccaacatagtagaatttatcattaattatccttgcctgtctaataagtttcactttcctagttaagtgaatttcttttgatctctggtcatgggagatattacagtggaaagaattacagaggttatcttcatagtttagaaagaacattccactggggaataaataaaggcaatttaacagaaagcatttgttttataatcaacttccataggaaattagaagcatagagtgcttaaatttatcattgtgaattacaactatatttatgtattatatttaaaatagtgccaattaaaaggtgagacaaatttaatttaatatttacaacttatctttaagtcccaatttaaatttcaaaccagtaattgttatttattctgaaagaaaatattgcttatgtgaaaatgaaagtgacatatgttggtatatatcatattctttgaacaaccaaaaaaaacggtagcttagctttcaggcctctctccttggtgttttattttccttcttggttttttcttttgttttttttttttttagacggagtctcacactgtcacccgggctggtgtgcagtggtgcgatgtcagctcactgcaacctccgcctcccaggttcaagcgattctcctgactaagcctcccaagtagctaagattacaagtgcctgctaccatgcccagctaatgtttttttttcttttgtagagactggttttcactatgttggccaggcgatccttcttgttttatactagtcactgtgggccaaaattttaaagactaacacttatgttatgttcttaaatctactacataataatttcctttgaagaaatacaatagcttaaattaatgcccttttgattgcactgaaaactccatatgttaatccaaatgcatcccactcgtgcatcccagtcctatttgctgaggatgactttaccagagttcagcaaatatttattgaggactaatgtgtaccaggctgtgttctagaagtggagggaatgaataatcaataattatgaagatgaataatgtgagattcaggtcctctaagggctcacattttgttttggtaagactagcaggcatttcgcagattgtgattggttcaattatacgttcagcaagagaactgaaacccagaaagttaagaacagcagcctggataagtaagacttgtgaagagccttgaaaatatactttcggtgcctcaaaaggaagggaatgtgtattccagaaagagaaagtcatgttggcaaaagcatggaggcagaagagtccagttcatgtgcagggaaggggcaggcagagcacagaatctatggaaggggtacaatgggagatgagatgagattgccttgaccatcttcttgagacattaatttatgtaaggagcacatacaaaccactcttgtaattcattctggttttattcatcaactctgatatattttttggtaaatctttttaaattaaaaaagcaatgcatatatggaaaatgtataaaatggaaaagcatattcaaaatacaataaaaactatctgtaatattaccaattaaagataactgctatcttattcatgagtaagatgcatatttacatgctggagtaatattttattcataattttgatcctacctcgtttacatgatatttatcgcaagcatttttccatgacattcagaattttccgaagcattttaagaagctgtatagcattccattttatgcacgtgctataatttatttaatcactgtctcatcactgtacatttagatcatttcctgtgctctagcagcttaatgctgagacagtatagataaaactagactttaaaatacttcatgttgttgactaaagcactgaagctactagaaggacagacttcgtaccaagcctttttatagtgttggaacctgcctctaagaagtagcaggatgatatgttctgccacagaaaactataagtagctgtggcagctctgttcgtatagagattgttttccttttaggtaccccatatcatgtctcctatcaccatataaatcttttaaaaaaaaggtttgtgtgtgaatgtgtagaaacaatgattgtaatggaaattagatgcaaaagatagacaaaatacctggcagttagcagccaaacaactgtcagttaccttccttttcctattccctttattacattaaataatcagaaaaatgcaagccaaaggttttttttaaagatacattactcaagtacacaattaagctgagtctgtaagatcaaatactcaggagtgaaaaccttttcctttgatctatcatttggggttgccttggcaataaaattggattgtacaactgatctgattgatcatgaaaaaataggttgttaaagtgaacacaaaatttaattagtctggaaaaagtttgattaagtgacctcatattgacagagccagacagtgccatcaggttgtgtggttaagaggttttaaagcaccatcaaatagcaaacctgtgtttaagaaacacatagcctgtttcatgtaattttaattggaaggagttactggcttgctcagttggtatatttttcccttcaattatctatgtgggagagatatgatgtttccttactggctaaaaaacttgtatcaagctaaagggtgtttcagcagagatggaagtggttgttataataaaatggacttaaagtagacagtctgtcaggcatatgacactcgctcaaagccagtagaagccatccatcagtgaattttctggttaagacccactcaaagctatatctgacaacttctcattcagatatatgaaaactgtagtattgcatttctttgtttattggcatcagtgagccagtttcactcaaagcagtatttcttgtgatgtaggtttgtcagttagcttgcaaataaatacagaatagctatttttgctgtcatcttaccattcctggcataccattcaaagctcatttttctgaataaccagtaagtgagctcatcaaaatgcataaagtcttttgcttcactatattaataattagaaagctcacagtaaactattatacaaagacaccataactctcttattcttactggatagttcaagaaaatcagattttttcttctggaaataatctttaagtagatcaagtattcaatctaatctttgctattagaaaatggctctggaaggcatagaaagtaagactttcctggctttaccttgattaagagcagtctacttaataatgcagagccaatagatgcttcacatccatattctctatcatatcacctgatttttttaaaactctgcttttgaagtagatatttgatcacaatgtagtaaataaatgaatgttttaagtaattttctagcatgtgtaggagtaaagctggaagtttctgttcagccatgttttactacagtggactaattttctttgaacttttactgaactgagctttaaagtgaggtgatgtctctttcctgaattcatctctttcttcatctgtagacctcataatatttaccttgttatctgagttatttatgatcattctgtatcttctttataagactatgaactcttgaatatatttccacagtgtctagcacatttttacacgatagacatttaataaatacttaaatgaatgaataaatactttttctcactttgtagcaccctttcttaaaaggatttcctcctctgaactcgaaaccaaaaaatgacctgagggactatttcaaatacttaacatgaataaaactcttgtaagtcttgtatcttacacattggttatgttgtgaaaggaatagaaactgcaaagatttttgaaaagtcttaaggagtttccagaattcttttattaaatgctttgttcaactcattcatgtatcagagagaatttcaattctatgttaaaccagaaatatttattttaaaatatatatcaaaaggccattgcaaatactccttaccattgttggcaaccctctgtttttgacactctttttttctttagttctgtggtttgacttgtgatcttcttcctacctccctactcacaatccctcctatagttccctttccagtcccctcagttttctccaaggactgcccttacctctttcttgtctctctgtaatctcaactttagtactttcatcaaattgggtctaattgtagtagcatcttgcagtatcaattctgattaggttaccctcatgtttccagccctgatatcttgtccaaagcttctgtctcattttctttatatcttcatatcattcatatcatacttcatatcattactatgtgaatcaccatcctatcatattattatactcaacatttctaaaatgagattcctaaatgtttttaaatatatattttatgtgtgtcaaagaaaaaagacacatagttaaaagataccaaacaacagagaagaatttggaatgaaaagaaatagtcacctgactcacttcctgctcactttccagcaccctttcttacaaggagttcctcatctaaactcaaaaccagaaaattacctgagggactattttctcataactcccaaagatggcatatgactagcaccataccagatatacaggacataagtttatccatgcttacgagggtgtgttagggtttaattctcttctgaaaccttagttgagataagctgctaggataaataacttaattatttcaatatgtttataccattcttggtttaattgatcaatttcagacattatcagtagaatgctgggtatgatagatgaagatttatctctgttataccatcacctgttcatactcatttaattctaatatagttatatcactagtttcagttcctctattggttaccttttcagacttcagcaatatatttttccaccttcatttcgcatcgtatcaactacaatggtttttttttattcctccctatgaaatgtaaagatgttggttctgccccttaccttcatctcccaatatcttctttttgtattatgaaggttaatatttaaatatctcatgctttacctatggactgtatataaaatttgaaaatccatagtgtttatatcattgtgaccagctaaatattgtttactagacagacaagtagtatattccttattataggaataaggagttttatacagaaattaagatgcacaaatgagggaggagttgggaaagtgaagatcctcgaggttgcagccagaggatttgcaaaacattcactcatcacttcagactgatgcactagaattggtagagaaaccagagctcttagaatcactgacactgattgctatgacttcccaggaataatggcttctgccttagttctctttggcaaatttagacattccactcattgttgaactctaacacaaagccatacacagggaaagggcttttgggaaatgtagtcttcagccttagcaatagaaagttgttgataacagcatatattccctacagctttatcccaagacacttccctcctaaaattctccatgaatgggaaataggatctgagcataagtatgacacaatctgacatatatttttaagggatcttctgactgctatgattcagaatgcactgtaggagggaaagatggaatcagggagatagtgatagtgaatggactggagtggtaagtatcaagctagttagaagtgattagtagattctagatatatttgaaagacattactaataggatttgctgatgattggataaaaggcatgagacaaaagcaagaaaaagaggaatgaatataaggacttttgcccaagtaactgatggtattgccattttctgagaacagggagacttcagaaggagaaattttgtatccaagtggaaatgatggtgataaattgaatatacaggtaggaactagagggagagaagtctagaataaaaatgtaaataagatactgtactattttcctaggactgctatagtaaagtaccacaaaaccacaaactgggtagcttaaaacaacaggaatttattatctcacagttctggaggtgtcagcagaggcgtgctcctgctgcagacactaggaaaattattcttccttgcatcttccagcttctggtggccccaggcattctttggctatggctacataactccagtgtacacctacataactccagatgaagaatgaagcattctttacttccccaactcctcccccatctgtgcagacttgatttctatataaaactccttattcccataatacttgtagtggcccaattttcctgactgaatgcagactgaaacaggaaagtctggagacctgaggatgtggtggagagttgatttacattcttcaccaggctttctctgtgtttcttttgtgttcttttcttacgaaaacaccagtcactggatttggggcccatcttaagtccagggtgattttatcttgagtttatcacctaatcatatcttcaaagaccctttctctaaataaggtcatattctgaggttccaactggacatggttttttaagggacactattcttctgcccactacagatagttttcaatgtactagtggcatttggatatttaaagcctttaaagccctggtactaaatgaaatcactaagaatttggtagctacaaaagaaaaggtctgagggtagatccccagggaattcaaactttcagagattgagaagataaggtctgcaaaaaaaaaaaaaagactaatatatagaggacattgaggtacaaggagaactaagagagaggggtgtatccttgcaaagtgaagaaagtattgtaaaaaggaaggagtgatgaactactgataggtttttctctgtctcaatttagtcctttattttactgcgctatatcatcagtaaaatatttttaaataatgcatggaacataaaacttctaaggaactacatggcctaatgggacattatgttatccttgttgttgtgaaatttgacaattgtgtatttagatgtaggtctttgtttcatttatttgtgaggcaacattgtgtatgggcaagggttagacctctgttatctaaaatatctgggcttagatcttggctttgcccctaaataattttgtaaaaaaatacttaaactttcattgcttaagttcacttccatttaaaatggggatagcagtaatatttcctacctcatagtactgcagtcagcattaagtgagtaaatataggtaaattacatagaacaatagctgccacatagccaacaacaggaattggctaacatatctttattcagtatgtttggggaccccggttgacctttcaatctgaagacaatagctttgagaaaagttctggacttattattattattaaagatatttttctcccattgatttttgtgtatgtgttcttggtatgaaatttctctttaatcagaagctgaagattttgggttggtgctctttgctttgtttgcttttgcttttttcatatttttcctctattttctatatgttttacttttggagagacaacttctacttgatcctccaagtcttaacattgcattttttaaagctccagttagtatatatttaattttcaagaactttttattcctctctggatatccttttgtaatcactgtggccctattttatagatgaaatattctctcaaatctatttgagaatgttaattagaaatatttttggttctgttctgtcaattatctctatttcttttttttttcttttttttttttttttgagatggagtctcactttgtctcccaggctggagtgcagtggcgtgatctcggctcactgcaagctctgcctcctgggttcacaccattctcctgcctcagcctcccgagtagctgggactacaggcagccaccaccacacctggctaattttttttctactttttttcagtagagatgggttttcactgtgttagccaggatggtctcgatctcctgacctcgtgatccacccacctcagcctcccaaagcgttgggattacaggtgtgagccaccgcgcccggccaattatctctatttctttcaggttcagtttttctgatactgtatcttggctattctcttaaatgttatagacttttcttgattatccattgctccttgatttcacattaatgtttagaagtgaatacacagaaaattgattttgagctttgatatgaggatgggctttttttttttttttttggcttgcagacttacattagtaagctaaaaaaagagccagtttttatacttcaagatatctaaagactgaaatgcaggggactttgattcaaacaatagcaaattctacactgctgctttagtttcccacagatatttatttcccttgcaggaaaaaaacaaacattcactctgccctttgagggtaactgcttgctttcagcaatctgctcatggtgggaggagatgagtaggttgattattcatcagtagacttttaattaactcagctacttccagctccatgtctcatctcagctctacatggtatttcaagactcttcaaactacccccattagccatattattaatcactaataattattagtaatcagccataccaaattatcacataaagactctaatctttggctccttttgttctatctctaccacttcacctgtattctattttccaagaaaatacaaaaatgtattatactttcccctatgctgctgtcatttttctttttgtctttgttggctttttatacttttctttgttcctctaacataatgtttatagggttggaagtaaaaaagaagagattttaaaatgttttcagtctttcattttaatcagaggtgttgatgtattctttttgtttaaaaatacatataattaaacaggtatataaaagtgtgtaaaattaacacattctcttcacctattgtactccatctaatatgatagtcttttggcaaaaacatttaaagtagaatgaggaagtatcattttactatcatgttatttttgtcttagtgtatgctttcagactggcactcctgccttcattcccctccaaccctagcagaactcaagtgtggcatagtgagtgttccacttacttacttgctgttataaacagactattcattcgtctattcattcagcatgtgtttatgaatctctaaccatgtgtctagttcttttctaagtgttagagatatggtgtaaaatataacaatttatggccatttgaaatttactcttagagataaacattaaattaatatttataaaaactattttcaaactactgtgatatgaaggaaattttggaggtgaaggaaatgcattatatcttggttatggtagtggctaaggtcaaaagccatgaaattattagtgattttcttcctatataaattttacctcaataaagtttatttaaaaaaagataaagtaataaaacatttaggaataagttcaggcaaaatatgcacaatacatacattcagaaatctgtaaaatattagagaaataggaaatatatcatatgtattgattaaaaggtacaataatataaagatttcaattctcccaaagtcgatatatagaatcaatgaaggcatcccccccgccaatttcttgtgtttgttttgttttgttttgttctgttttgttgtgttgtgttgctgagaagtccaccaactaataaatctgaaatttatttggaaggacaaaaagcccaaattaaaaatgcttttgaacaggggagaaaaacaggtaggaatttctcctgaattaaaattatattaattaagtcagtgtaatatttgtgcaagtttaggcaaaaagaaaaagcatagttatagatgctattacaaggatacaaaatacgaggagaatatggggggaaacagacaaatcattaagtaataggagatcaaatatagtctctggagtccaggaaagcttccccaaggaacattaattttagtatgggacagatagatgagaaatagttaactaactcaggtgagaggatgagaaaaagaacattttagtcaataggaaaaacatatgcagagactctgtgaagaagaaagaaataataaaatactaagactctagtaaccaaaagaaaaatcagattgtctcagttttctttccttttctggtatatctcccagacatggaatgtgaacttggtcaacctgacatcaacacaggggacatgagagggagttgtacattgaccaaagataagcatttaagaaaacatgcttctttatccttgtctccactttttcccgagttgaaatgtttataacctttttctttataaaacgtagtctcataagctggtgagatggcctctagtcttacccagtcctaccggcttgacacatagctgctcacctgttcttcccaaagtgcagcttccacatcactctcctattaataacctttcagtggctcttgattgttcacagaaaaaaaagacattctttcacctaaatccgtcttacaaaattgtattttcctctgtgtaatcaaatgatgaatgtgaacgtgtgttgtaaactctgaaggattattttggagatgggcatggaatgtgcacatattagatacctcttacgagccagttactgcttctcctgtgaggcctcgtatgttaacagcaaactatgaagagggaaagtattattcctagttcaaagagccaatgagctgcaattcactgactttaagatatacactgtgatattccaaagcataggctgattctgtttggccaagtgttgatcttgaaaggcagcctaccataagggaaaaaagaactagacttggagttgaaagggttctgttgtttttgctgtcaccaccttcttgtctatgacataaggataagaatatttcatatgactcttgtaaggattaatcaatatgatgaagagattatatctgtgcattttgaataccagtcattaacttcctaattatgaactataaactaatgaaaataattttctctaaatatgcaatgttgggtgcaacttgtgcagaggattttatggttttccatttttacttacatatgttaccatgttgtattttcaaaaaattcatgagaaaatcagtcttcttatatgaaattttagacaatattttatacccaaatcttacatagtcatttaaagtaatgtaatgcgtttgcattctcagcattcatgcctaaatgttgaaagcagacttcccagaagctcaacaagagacagagggaagtgaccttttgattaaaaaaaatgtttcagataatctagaaagcaaataacccacatgtgggtaatcaagagttcattgttttggggatctttaattgcctactgtttatcaatataatttaactacagtgcatgtaatgatgatatagatagaacaagtgcctatttttaaatgagaaatgatgtcatatttttattaatgataaatagtatgaaaaagagtactctatgtgactgtcattaaaaacagtagactcatccaaaaaaaagagatggatttcctttccttttttatccaatataagagcagaaactaatcagttttcttgagagtgttaaagtatagggtctattttaggtatggattattctagacatttgcacattttttattgttcttagttattttatagtagaaataactattactatgcatgagaaagagggtgtttatcactcaagtgtctcattctacaactgcagttaattttacaagaaataatttgtcattttctaaaatgaccctttaaatgctgctggcaaaagccattgtcagttgattgcctctgaagccagtgatctgtgtggtgttgtacagaacaaccagtcttgtgctaccatacctgaaagagacaaagaaaacaagacactgatgtatatgagcttgtttttttttttctattcatacattttcctttttttttttttttggtttttgttttgttttgttttgtttgcctgttggtttgtttttaatgattgcctcaaaacatgtgtgctttctaggaaatctaccctcagcagtgcctttcatttttattatctaagtcaatactgatccccagagtatgactgctattcatgactgttgttggatggctaaacatcttttggattttagattctctgtgcttttggacagcattttaatactattgctagctgactgttctaaatgtggttactgaaaatgttctaaggaactagttcctttctaagacagaatatgtaataaaattataaaactcatgaaatttactcttagttttttatataatgtacctacagagtaaaaagttaaggtccttatgattaagactaagtcatataagcttatacagcctatattaattttttgaatacttttatttagtttggaaaataatgcgttcaaactttgaagttcttatactgaataaaataataacatttttttccccaggtctgctattttctgtgtatctgactcagttacagactgtgaagttaggttttaactaacctaaagaaagtacccaagaaataaattatttgaactcttttttactgctttgtgttattacaaaatatgtgaaacacaatatgagcatacttcaaaatatgtgtgcatttatgttgtaattcatgttaatgtcctcatttgtatatagacaaaatatacttaattcataaattgtggatcagctttcaattctttatttactaagtatttactgagtgaataaggatatgcataccatcaaatcacttacagatgagactgttttattagatctttggctttaattagagtcatgagcgaaaaaaacatgccttctagtgggaagtttatactctgtcaattcaagcacattttcattgtctactgactaaccaaagtagaaaaatttgcataaacaaatcaaaattagtaggaacattaaagtgtaatatgaagttatatatattatctgactagttttttccttattctaaatgatagcaagtatataatcttgatctgtgacataggtatcttttataaattcagacgtattttagataaattaaggcattgcatttcacaaggaattactcagcaactccctttgaaagatgaataattaccctatattgtatattgctgttttcaaaacttcactgtttttgtcatattcatagaccatttatacccatatttacttaatattgtttctgtaatttttctcattttaaaattttaaagttttattactctactataagtctcagttgctacaaattgaactaattcagaaaaataaatatgtagccattaaaataaaatatctgcccattatcacctacataccatatcactggtggcagataaattgcatgtttggaaatactgttctatatgattgtaaattcagattttcataaatttaattttattaaaataaagcacaatttaaatagatgataaactaactgagggcagaaattgcatctgtgttgtttatccttgtttccccagcacttagttcttggtgcataaaatgcattcaataaatactgaatatgtaaattaatgcatgaaacttacacagatggtccctgacctaaaatagtttaacttaagagtttttttaatttatgataggttgctcagagtattaaatacaatttcaacttatgattttttgacttacaataggtttattggaaggtaaccccatcaaaagtgtaggaacagccatatttacctattcatcttctataatcctattacaaagtaataattaaataagataatgcccaaagtttatatgaaaatacattatgggcaggcacatgcttgtattcccagtcttcaaaacactaattaatataacacatagcatttctattaaactttatggagtatatttataaatcaaggaagtttaccataatgtaattaagaagaaatgagtatgaggcagtataggagtgggcccggtaaaggagtgacaagagagaaatgaagtgagaagtaacaattgaaatatatatctataccatagaaactgagataaccttattactatgtcaaggtaggaagaaaggactaatttgaaggctaaatataatgggaaagttgcttcagtggagaaagttcagttccatcaagagttacttccaaattaccagccctagtgaccaaattcttctaaaacgaatgactctaaccatcccccatatggctttcttccaataaaactcacttctaaagcttaaattccaacctgttttcttttgtccatgcacttaagaaatgacataatcaattctctacatcattgcggttagaagaaaagaccatataaagctgaaatgagcaaagcattctgaatctatttataatcagaggttcatcagttagggaagcccctgaagtacaaatagactatttcacaaaacttatgaggcctcagtaaatggatacaatccacatcagttatgtgtcagaagtcagtggttagccgatttggtcagtcacaattattttgacagaatgactgccgatagtaactgattctaaagaagaggcaccacagaggcagaatcattcatagttcagaaataatgctgaaatattacagcaatataaaatattttttgcctattacctaataatctaagaggatgctttgcatactattttgctgaagggacacttgacctatcaagaaataaatgagtgatagctcatttctctgatttttttttacttatgtatacatttattcattaatttatctctttcaacattgaacttctgaaaagaggacattttataagaaaatgaaaggaatatatgcttccaggaatttggagggggatgagactgaaataggaggaagtagattctgtcaactgaagtagtctgtctgaaggggaaaggtctctaaaaagcatcttgccttaccttcaacttgaaggatgtcattgtgcctggtcacagaagcagggaatatgattcaggtgtcagaggcatatcagaaagaaccatcctgccttggcaggttggaaccttcggctatggcatacggctatcaagatgggagtgggagacatgtggatatttttggcagctacaatggttcagcaccattggatcatatagcagagtctaagttaagccaaaagatcctgaaaaccaggagctaatgagaaggagacactttgtaaagcaacttcagggattgcttttcctcctgtgagcaaaggaaggtactcggatggtgttggatgttctcacgattcagtagacgaaacaagaagaatcaagggctttcaatatttaggaatagtaataagcctctggaggaaatatctgagacttaagatccatagctgtctttgtatagtagatccagcgtgatttacttctataaaggagcacacacctgaatgtcaggcactgtgaacttttaggtgactttggttaaatcccataatttccttctgcctccattttttttttcacatgttcaatgtactatctacatggcaggatttttttgagggttgaacgaagtagtatgtatgaaacacagtagaaagtgacataaataatatgtatacttgaacatgtgaagcatgttgatgcatgaatgctattgtcatctatattagagtgtcaactaaggttgatttctttctcatgccataagtccatcccaggtaagtaaggaatgtgtcccaggttgtctcctacaggaactcaggtaggtctttagagcctctggaaatggctagtcattgtgatagggaaagggcatatgtgaatcacacactgcatcttaaaggatctgcatagaggtgacacttatcactccttaactggcttaagtgacacttcacctatcacgtggccatacctaacttgaagggcctggagaatcataatcctagcttgtgtctagaagagctaaaatattggtgagcagcactaatgaccatcacatatggattctttccattttctacagtggaataccttttgcatcaaagaagccttctagatgtttctcctgttactaataacactacattctttctgtgtagctgttaacaaacaagtagactttcttaattttatattttcccagtttcaaggatttgctggcattaaaaattttagtagccttgtagcagaatattctagtttctttcaaagaagataaataattttataaaatccctctttttttgccagacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaaggtcagtacaaggagaagacctagaatttaagaacttctcttgaacttgaggaatatatcataagctataaatagaagacattgagccaatgttagtgtttttactatatgtgtatacaacagtgattggaaatgtgttaaaatctaactttttcttgctaattatggtatctaatgttatttttagataattaaagtttgtgacactaacccagttttctgtggattcttgcaactgttaaatggtgtttttagaatgaaaaaacatgtagtatcacataaattttttaaaacgaaagcatgcaagcatctgatccaaaaacaggtagcaaaaatacatgagaaaagcaagatagagggaaaatggggatagaggaaatgcaatgatgatgtggccaaggatgacatacacaatgcatgctactcagggctattcctaacataacacttgcctggcaaagtaagagatgtttagtgattgttgaatgttggatacataagatatggtccctgattccattaagttttcaatctaagaggagtagaaaattcaatcagattatattcaattagttaccattaattttgaattattttcaacagactgacaaatctgctcctctgtagcctctatttaaggggcatgatttttagaaaccaggcagacagagcaagcagagccccatgaataattgtcagggaaactacccgcactgaaagaatttgccatcagaagtcttggcataggaatgaaaaacaaaacacaacttgagaactcattgttttctccatttgcatttacaacttcatagagcctgagaggataatggggttaagatgacacagtcaatgaaagcttttgacaatctaacctaaagatacttgacacctaaatgataagatgttttttatccttgtgcctcaaaggattttcacaaagagacaagtgaaacagacttgggtgatggatgccaaggcttctagcctgttttgccggcagcagacaagctctggagcttgagcagagttttcatcaggatttccacctaggaatgggaatgctgttgccttactgggggctaaaacctggcatttgcatgttaccacttaaatatggtctaagggctttatcttgcactggtgaatgttccagagtgaacatttccagccctggagagaatgccaggaaccacagattatagtttcaagacagatcagacattggaactttgttcttccctgataagctactttgtttgtattttatagaatttaatggagatcatcttttaaaaaatttatgcacataaagaatgaatataagctgattataaataatgcaaatcatacagaagcatgtatatggattaaagctgagtatgcatcttcatttctcttcccccctttccccatcttttccactcatcctctaggggttacctatgtttaatttgggttagtatccttgcacacttttttctgtgcatctggatgtgagtagaaaaatacacatacctctgttgactgtgttacattaagtttgtaactaaactcactgtctttcaaatttatgatcacaaatctctagtgggttgtattagttatctattgatgcctaacaaattactctcaaaacttagcagctaaaaacagcaaacattgtctcacacttgctatgggtcagggatttgtgcacagcttagctgggtggctccggttcagggtcttcatgacactgcagtcaagttcttggccaggactgtgctcttcttatattgaaggcttgcctatggtggtagtggtaatggggggagtgggaatctgtttccaagatcattcatgtggctattggcagatctcatttccttaatacatgggccactcctcaaggcgtgggagcttgcttcccctaaagcaagcaatccaagagcagatgccgaatatcggagccatagtctttttataacctcatgtcagatgtgacattccatcacttctcacactttatatttgttagcatcaagtcaataagtacatcccacattcaagggaaggggattgcacaagggcttgaatactaagtggtgaggatcactggggccatctcagaagctacctactgcaagggccatcagcactgtccagcattcctacttcatttctttagttacgttcccttccaactttccaattaacagccatttcacaacttcttaagtctcctcagactttggatactgcttcctttctctttattctctgtcaatactgcttcctttctttttattctctgtcagtggcctgcctacttaactgagacacagaagtagtcaaaagagatctgcctcactttccaccacgacccgtactcgcctatttatttatttctatatatctgctcatttatttctatatacctgctgctttttctctctcctcttttattggaggaagtggccctgctcctatcaaaaatcaaactcatcattgtatcttgcatctcatcctctctcacctatttaaggattctgcccatataatattaattttctcttccatatagttaagtctttttcaactgcatcattcctatcagtgttcaaagagtcaggagtggcggccatctttgaaaacaaaacaaaagcaaacaaaaagtaacttcccttgacatcatctgattctacagacatatctcccaattttctgtcccctttagaacaaaattccttgaaaatattttcaatacttgttatctctgccttcttccttccagtgacactttagtctcactgctccagccaatgcttttctttcaagattactaacaatttccacttcgccaaattaactgatcagttactatctccttgatcagccactcagggatttgactcagttgatcattcctttctctcgaaacataattttcctcacttggcttcaggtaccccactctctcctggtttttctcctttctcctacaggccttttctttcactctcgcaaatgccccaggactcaggccttgtcagtcttttctatccattctcaatccctaagtcaaccagtttcatggcttaaaatgccgtctatgtatccctaattcagacctctgccctggctgcagattctacatctagtggcctactaggtagctcaacttggacttctaatagacaactcagacttaatacgactaaaacagaacttttcatttactttctaagtcctacaggtcccttaacatagttgcccagaactacatcttagagtcattgtttccttccttcttttcctcatatctcacattccatacattaacaaatctcacagtttcaactttcaaaatatattcccagtctgaccacccctcaccacctctgttaacatcttaatctaagccattactaccttttgcctgaaccactatagcagcttccaaactggtcttcctacttccacacccaattcccctagagtctttttttaataacattcagagtgattcttctagaactgaagttagatcatgttactcctctgttcacactcgtggagcctctccacctctctcaaagcaatatgcaaaccctgaccatggttgacaagggctcacatgatatgcatcctttgccttcttaccatttctaaaatatatgaaacagatttctttgcatgtactgtcactttatgtggaatgcccttcccctagatctttgcatggttcttctttcatttaattcaaatttcttctcaaatggtttctcctggactgctaatttaaaatagtctcccacctctgacactctattcacttaccctgcttcactttttttgatagaaattataaagtcacctgaaattatagtatgtatttatgtgtttgcttgcttattatctgctttagaatgtaagtttcaaaggtcatagtttgtgtttgcttgtcagctatcatatctccaatgcctagagcagtgtctggcacatagtagatgatacatttatttgtccaatgaaaagattgaggtaaataatagatagctaatctcttcattagaaatgcatcaggcacataacctatgttggaatgtagatattagtatgacatatactggatatgtatatgtagttaaaagtagatacataataatgatcaggataaaacataattaatgcattcacgagtgttcagcccagaaagtaacaaggataattaaactaaacatcaaaataacacattacaaataggaagacagcaaagtagaggattcatcttcataggaaaggcctttcaaggaaacccgcaaacataggagcagtgaaaaaccttatttaaaaaaacaaaaaacaacaaaaaaaaactcttctggaaagatgattctaccaataaaatttataaagattatcagaaaaacctactactctgtcagagtacaacatgctctgaaggattcttttttttttttttttttttttttttttttgagacggagtctcgctctgtcgcccaggctggagtgcagtgaggcgatctcggctcactgcaagcaagctccacctccccggttcacgccattctcctgcctcagcctcccgagtagctgggactacaggcgcccgccaccacgccgggctaattttttgtatttttagtagagacggggtttcaccgtgttagccagagatggtctcagtctcctgacctcgtgatccgtccgcctcggcctcccaaagtgctgggattacaggcatgagccagcgtgcccggcatgaaggagttttttaaaagaacacatctaagttatattttttaaaaaagataaaaataatacttctaaacaactctccatttactgcgatttccgtgatgtgtagaattgtaatattagtatttagaaggattcattttaagagtatgattatctcagagaaggtgctatttttctgttgctgggggaaagaaagtagacaaagccacaatggtagctttacaattactctgaagtgtaagactcatacttggaggcatgaataaataacttcactgtgtcattactttttaggttacagttgtgtgatctacaacatacatgtttataagctgcattcatacaaattgtttgctgttttgctcatccatttatctcagagatttagacatttcatcctgaagtaacaggccagagtcctattttccttatccatcccccatttccactgtgcctaaaattttgtctctgtctgagacacagtccagtatctttttccacataaatatatttatgcccacatgtcccattattgctttagtttctggacaatctttaagtttggtgaagttttttgaacttttgataccaaaaaaatgaagtttacatgatagtattttaaatattctgttcaagcccaacgctgtgattgagaaaagcatttgattttgagaaaaaatataaatgtcatgctgtgaaggaacaaagagaaattatttgctctttaacatcaaggaaggcttctcagagtacctagtatttgctttaggactttgctaagtatgatgagattattgccaagtcgagatagggaaaatgattgcaaacaagaggtagctctaaataccgtactacgaagtttgaacatgcgtatgaagggctctttttgagaaaggaggtgatgaaagtaatctgcatcaaacccacattttggcccaatcctattttctgagccccccacacacatatccaactacttactgaacagccctggtggaagcccagaggaagtgcaattcagccagtcctagactgaacacttctgccttcatccctccccattcttctgctccgcagcaaaatcttgctcttctttccataaataacgtcaaccatattttccacgccagaaatctatacatcgttcttgatctctctttctaatcttcaaagccaacaaatcactatgttgtgttaattctctctgttgtctctttctatgcgtccccattgctgcagtgtatagcaatgtccccactgagtccccaactcagtgtagcatggtacttaagaacacaggcttagagcatgattgcttcagttcccatctgggcctactggctgtgtggctgtgtcattttgggcaagttatgtaacagtattatgtctcaatttcctgatttataaagtgagaatcaaaatttaattatatcttcgagggttgttgtgaagattaaataaatcattataaggaaagtactcagagtctggtacattccaaccactatgagactctgcttttattgtatgatcatcttttgcctgaaccaaggaaacagttattaactggtctcctggctccaaattctaatccattcaaatctcttttccaaaatgaacccaaagggacctgtctaaaatgaaaatcagattgtgattttttttttgcatttctctaaaatgacattttattggctttatgaaaaagttcaaatttcttaacatgacctttacctgggccctgagtagctcttcagctacatgctgtttactctgctctctcactgaacattccagtcataccagcacttctgtttctccagcacatcttgatagctctagacgttgggccttcaagcacgctcttgcctcaaaaacactctagaccactctttacctactctttgcatggcaaaatattaatcatagtataattgccaaacctagagaatgtatagacaaaaaaagaaccaggaagagctaccagtgtgataggaagcaagtagggaaaatgtatcaaggagagggagtaagttgtgtcaaatgctctgctagaccaagttacatgacagctgacactgacaaatggatttagcaacattagttcttcaataatcgctcactaaaggagttatcaatatttttaaagttggaatttgtgtatgccatgataggtttttcaaagcagaatacacaccttgtatagatatttaatttgggaatcttgttataaccaaactatgtgtaaaaatgggttccaaaattctataccaccagttagttgggaaaagtttctgcattgtcagagccagtgtagataataagcagaaaaggcaagctgagttcaaactaactcaaactccttggatagcaagaggttgtagttagtccattatgatgcatctgcccacacatttttccaggtataacaagtacatgccaaccatcgttatgagcaactttttactctatttctttattatagatgtgctttatttaagtatacatattcgtcttgtgcctggatatctcttctttgtcccttgcagcaatcctgtggaatctttctgcctataagggggaaaaaagtattatctgataacacagcttttattttaaagtgtcaagcaaaataaaatgattgcaaaaattcggccattgccattcatggaataatgtccttatagtagaccataaaaaggctatgtagtaaggatgtctgtagagcttgttgtcaaagagaccaaataactatggtttgtttatgtttttctggcttattataattcttaattctagaaatatgtaatgggagacaaatatcaactcatcagatgtaccatatcattccaaatagaccaaatataaaactagctaataaaatttaatttttattacaaagagaaaaattttctctaatctgaaaaaatacacattaaccatagtacttaatttaaaaaatatatattctcatcctggctagcagttttctttctgatcatagtctacgataataagtaatattatccttaacaaatcaagcttaataaagctctgtaatcactttttcggctattgatccaatccattagttttgttgaagtgggaactaataaaaatcaaggcaaatagaaaaaaaatgtcctgtggcttactttcaggaatacatatatggcagaatttaagtatataagaaatttaaaattgccaagtttttactagtccaagtcttcagttaatgttgaagtccaaccatttgaaaaagatatttcctaaactttatttttaaaatcttcaaggagaatcagtatacagcgccctagttaaaagctatacactccatcttgtctctaacccacttctgccatgatttaattctttctttcttgacctttactcagaggcaactgatgaaatgggaaataactacttattgccactcataccatgtctctgaaatgtattttggcttgtgacctttaaattacgggggtaaataaaaatgaatcccatctcctcttatggacctgatctgtgggtcacgatatgtttgcttttcatctgtatgaaaacgctttaggctgtgatggccatgaaataggtgaggccaggtgaagtatgggcagttgccagttgagttagacaggggacaaaatgataatctgaaatggaaaagttaaaaaatagtggtttctttgtaagagagatggtaattgctgattattatttgcccttctgtggttgagagtcaaggtctaaggactgtatgaaaatgcctggaatgcaagggaagatcacctaggcagaacaatggaaagagcttcatggaggggggcaggtgcagccgcgagaataaggcttgatattgcataaaatgctgcagggatctcatgacatttcatctcccactaagaagggatttttctataatcaccagtttaacactggggatgatatccccattaaagtatcataggcacttttagaatttccactgctaaactgtttttgtttggtaaattgagtcatattcttactctcaaaaataaaaatgtttcataaagcctaatgttatttacagagatataaaagttgaaattctagccaaggttacctgattttttaaatcaaacatgataatattttcctgtgaaatccccagatcattaacattgctttagtcaacatttaatcacaaatgcaagccagtaagatgaaaattaatttacagttgaataccttatgtcaggagacaactggcctgattgcagttgtttgaaactgcacatattctaagcacattgagtgctgctttttcttgtctatagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcaggttggtataaatgaaaaactttaattaattttattcagttgtaatttgcatatgttttaagtgtgtatatggcttgatgagttttgacaatgtgtacatccacttacctaccatcacaattaatataacagaacacttccattatcccaaatgttgcctatgttctttcctagttagtcccacaaccttagatccaggcaaaaactgcatccagtccctattgattaaatttgtattttctagagcctcatataaatggagttttatagtatatactatattgtgtctgacttcattctctcaacattatgtttttgagattcaatcctattgtacctatatctctaatccatttctttttaataccgaataatatttcattgtatggatataccaatgtatttatctatccacatgttgataaaattttattactaaccatgctaattttttcctagtcacagtatcatgtttgaatgactgcataaataaagtcagaatgaacatgctgtgatccaagagtgaaaaatatttatttggtgtatatttcagttttagataggtattctgttatatgtacctagttataataaatgctcaaattattttcagatgaataatattatgtaccaagaacccaactgtcataaaagaaattgataacagtttatacaaaaacataggttttaaatactccagaaatttagtaatatatatatgttattaactatgaaatattaaaacacatgtcctcaaacaaaacaaaatttagttagtatgcaacttaccatactaatatacaaatatatacttacgtataaatgaagacatttatatacacagtggttattttatgctggtcatttctgaaaaaaaatattttctggtcatttgaggagtagtatgtggaaaggaaattgaaaatcctccagcttaggtaatttctttgtgttagctaaaaaaagaaatgctaaagaaaatttattatatcagataagcagtgtgaattatttcaacttccaagtcaccatctgaaatgtgtgtgcgtgtgtgtgtgtgcgtgttactgagaaatggaggtttttggtaactgctttttttctttttcatacagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttggtaaatttagctacatgaagtggaaagaaaatttaggcccagaatctaaatagagaagcaacctcgtcctccccatctgccaatacctagcaccaggccacagtgttgacagttataaacagtgagcctggttaggatgatgaggtgatagttacacgatcacaacccaagaaggaatattctgaggtagatgtggtacaaggtgttgaatagtctttcactgacagtaatgtatgtctctttcaggagtatctccatagctcaaaagaaaagactctcctagcttccccattcctatcctgtttaggctaacttaaagacaaatattgatagaacaatggcattcataaaaaaaatactcttttttccaagtagaacttttgttaacccatttctgtcagttatgtttagacttaaaaaacaaagcaactccgcctcccccaccaccgcaaccttctttttttttttttgagacggagtctcgctctgtcgcccaggctggagtgcagtggcaccatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagcaaccttctaaagattgttattttcaatgcttctgatgggcaccttgttttgcacataatatggatatgcaataaatacatattagaattgaatttctctatatatttataaaacttttactagaaacaataagtaagaagaaagtaatgacttgataaagtcttttttcagttgaacgaatttcttgtttctagtggtgtaaatgaaaaggaaaattggtctatgtgtctttatagcgaaaactttcacagaagatgctacttttaaagttatggccagtttctttctatttgtgtgaggttatttttaaggcaaagcttttttgttccttcctttttatactttcaacccaaaaatcaatggaaagagcaaggtcagtttctgtgcccgaaggctgctttcatctcccaaaccatgagattcagaattatgaagaaaataggaaacaggtgggaactacatttttaaaaagatccaattcacacaattttcctgtgtggaattaaaaaggaatgaaatcaattcctaggatttgtttctttttttttcaaagtctctacactgaaaaatatataaatgaacaaagaaaaaccatcatattgccttcatattttagtttattttcttgtaaatggacaaaacattctttatgcataaaggaattaataataggttagaaaaaatagcaaaagaatgaaaaagatatcacatgggcaaaaacgttaaattgaaacctctctcctttgtcatgggaaagataggggcatgcacattttattgttttaagatgagtgatttttgcttttgttttattggtgttatttaaatcctgaagattgtttgaaaatcaagctgcaatacagaattcatcattctgatagggcttttgtgttaatagattccctgaaagattcatgggctttgtagatctaagtttaaatatcaatcaaataattgagtattcagtaaacactgtgctcatctgctttttcctggcctccctccatttcctcctccctctccctctgcccttgcacatctgctttccttgtagcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaaggtaaactccattaaatttaaatagtgagcactttgccagctgcacccagggctcatagataataatgtgctctacctggacaataggaaggttttttttttttttcctgtttatttttcaaacataggtgggcggaatgccactcagctgttagttccagggctgtcatggacatccatctgatgtatattcaaggatagtgcatggactaaaaccagaatgatccgttatttatatcaccaacatagaaacaagctacttaaattgtcctagatatctaaccgtacacatcttttaaaaaagctgaaacaacaaacctcatgtttcttctttcatgataggagacaatattgttttattgatttttagctggttcttttacaaggtccgtaagatacataagtgaagtagatttattacattttccaaagtggaaatcaatatggcaaagatgggcatatttcttggtttgttgtggtcagttacattgagttgaaacatttaagatctgttttttaccatattttattcatacagttggagaaaaaccattacaaagctctttctccttattctcattggaaaatagagctctgtgccttttgcttcaatgagagcacaaatacaatgaatataggcagagcatatagagtttgtagattagtgacaatgttggaagcattctaatttgattattatttctacaaaaatttaattttgtggccattatgctttatagtcataattttgtaatcaacactaaaactaaataaataacctgaaggcttaacagtaacaactaaatagcagacgtgtcagatttttctcagcataacatagccagatatctgtaactgctctgatttttttaagtgagcatttccattttgtaatttttttcctacagagcaatttaattcagattcacttactacaaattcttaccagagtagattgaagtaacaggacaaagaaatataaaatgctttaagctttgagatgccatttttatctatttcaagctcaaatttctagttctttcaatcaatgcaatttgtcaatcaagcaaagctttttgagtgaacatttactgctgttttatgaaatgcattagcaaatttaaaagttactattactaaaagttactaataatgtatatgcgatgttcctttaatatacatttaatatgtgtatacttaatagtgcatatcttgaaacttagcactaatgactaacagggaaatactttctgtcatttaattaccaaatagagttgagtcctcttacacccttaatctttctgtgagattattcttctgagcaatagtgacaaaaatatatattgagtgatggacaaaaatgaaatatagcacagatggatatttccagtaagaaaaatgcatacagtaataggcaggaaaacaactcagactgttttctggggtaaagaatttgaatgaggccgggcacggtggctcacgcctgtaatcccagcattttgggaggctgaggtgggcggatcacaaggtcaggagatcgagaccatcctggctaacacggtgaaaccccgtctctactaaaaaatacaaaaaattagccaggcatggtggtgggtgcctgtagtcccagctactcaggaggctgaggtaggagaatggcgtgaacccgggaggtggagcttgcagtgagctgagattgtgccactgccctccagcctgggcaacagagcgagactccatctcagaaaaaaaaaaaaaaagtatttgaatgagtttgtcattcactaccttataaacaactactataatctctcagcttttgataggaatatattccagaaagtgtattttgatattaaagtcatttctttctgtcagataagtactgattcatagaagttactattaaatactattttctttatctcttgttattaaatatgagtcataaaaatatgctcagttttgtcaaatttatctcaagtactcatttttattacatttattttgtgttattttgaaaataaagtttatgcaaaacaagcttcaagtattgcattagaggtaagcattcttcacaatttagtgctttgaaagcactattttatttattatgtctccattctactcccctctgagttatttgtttctaattgataaatacacaccgtgtggggcattgtgctggtaccaggtgtataatgataagcaaaaccagacacagtcacccttggaaattattctctatcagcttattatctggcactctgttgttcaatatgctagtcagtagccacatgtggctatttaaattttaattaattaaaattaaataatatgaaaattttaatttattagttacactagccacatttcaactgcacaatagccacatgtggctactggctgtcatattagatagcacactgtgtaaggccattcttgcattgctataaagaaatacttgagcttgggtaatttacaaagaaaaggggtttaattggcttacagttctgcagggtctataggaaacagtaccatggtctgcttcggggaaggcatttcacatggcaagagtgggaacgagagagagagagagagagagagagagagagagagagagagagagagagaaagtagttggtgggtaggtaccagacatttgtaaatgttgcctttatctatcaaaaactacaaacttgaagttgtgccagtggacctctgttctaacattagaatagataactcgatctaaggaaaaaatacctataaataagcaatattataataaagcttttaatatatgatcaggactttgcagatcaatggaggaagaaaacattatttcacaaataatggaatgactaaataacaatttgagggaaataacacacagttataaaaattatgttacatatcaaaacaaattccacatggaaaaagtgttaaatattaaaataaattaaaataaagaaaatataattaaatatttatcaaaactctagaagggagatactttttaaaatttatcagtgataaaatatacctgaaagaaaagattagtgcttctatagatacataaaattagcaaaaaaaaaaaaaaagtcacaactacatactagaaaaacagcttcagcagatttggtttctttgttagattaaaaacataaacattaataagaaaagcacttactgctgggtgcagaggctcatacctataatcccaactgctcagaaggcccacttgagcctaggcgttcaaggctgcagtcagccatgatcatgccactgcactccaccttgggtgacaaagtaagaccttgcctctaaaacttttttggaaagcaattatttcccccataaataaatctgcaaaggataaataaacaactcactaaaaaagtacacctactaaaataaaagaggaaatcattgagcctttaaataattgaaccttaattgtaaactaaaattataaataattattttcacatactatagtaaaaaagtttctcctaataatttctaatgctgacagagatatactggaattattatttttgtgcactgttaatatcattaaaaaatacacaatgcaacacatactatccgcacccccatatacacacacaaatatattgttctctttaatcccaggtctgagaatctaacctaaagaaataatcaaagtataaaacaagctatatacatgccaatatccatctcaacattgtcatacagaattaaggaagaaacgaaaatatccaacaatagaacagttaaataagttatagtaactttgtatacaatgcaattatatgatgtgttatacttatataatatattctaattacatattagaagatcatatattattattcagctgttgaagtaatcacaatgcttataataaaaattaagataaaaatattatgcacgttgtgcacatgtaccctaaaacttaaagtataataaaaaaaagtactggtcatgataataatgaaaacaaacaaaaaatattatgtataattacatattcactttatttaactacaaaaatcttgaaaataaaggaaatggactctattaaaacatattgaaatatcaatagtaataggattaaaaaatataagtgtagctgaaaattaaaagttgactgtcttctaatcttgattttcaaaggttagcatgaagagtggcaaggacttctttaacaataaatatagccaaaaatagcagggtcttaaggaaacttattttactgtgtcactatataaaaataattactttttataatgagttttgatagtaggtgcttattattcctagtagtcagactgagtttcagtgagtcacttttattttcatttttatcaagttaatatttattatagtgaaattcacagttaagtatatagtttgatgagtttgataaatcaaaatacagaatatatccaacactccagagagtacctttggatcccctttcaggtaacacctactttcagtagacaaccttaattttatttctttgtaataaattcattttgcctgttataaaatttcatatgaattgaattacacagcttgtactcatttatatcttctgttgaattgaccattttgttgttatgtaatgtccctccttatctctagcaaggcttcttgacttgaaattaattttgtctaatatttatttagccacatagtatattgttttgttcatctacttccaatctgtcaacggttttatatttaaagtgcatttttaatagaaaatgtattgttcttatttttcacctagtgtgaaaatctgtcttttattaaagtgttttgtttatttacatttaatgtaatttgtgacactgatggatttaggactaccattttgtcatttgttttctatttgtcctatctatattttatacacctgtttatccattcctgccttctttttctttaataacatttttattttatctaaattgttctattggattttaaactataacttttcatattattattgtatttgttgtcctacggattataatatatatcattaacttattatattataattaggtatagtattatactactcatataaaatataagaactttgcaacattatgattttatccccatagcttttgtgctaaaacagtaatatattttacaactctgttcactataaatcctacagttccatgttattatttttgctttaataagttttatgtcttttgaagaaattaagaaaagaaaaatggtatattttatatttattcacatatagtaatagctcctttttccacaagggatatacgttccaagactccaagtggatgcctgaaaccacaatatactgaaccttattaaacactatatatactatgttttttctatacatacctacaataaaatttaatttataagttggcacagtaagagattgacaacaataactaataataaaatataattataataatatactgtaataaaaattatgtgaatgtgatctctgtctctctctctatctctctctgtcaaaatgttttatcatacattttactcacttgtttgggccatggttgaccacaggtaactgaaactgtggaaagataaactgcagataaggaaagactaccgtatttaccatttctggtactcttcatttcttcttacatattggagtctccatctggttacattcccttcagcttgaataacactccttagcattttccttattgcaggtgtgctagtaacaagttctttcaactcttatttatctgaaagtgtctttatatttgaagaatattttcactggacatagaattcaggattgacagatttgtttccagaactttaaaggtgatattctattattttctagtttccattgtttctgatacagtgatcatttgtttttttattcccttgtatgcagtatttcttttttcccctactttttcctttcatgattctctatctttgtttttagtagtttgactatgatgcacttaggtctaattttttttttttttggtctttattttctttggtgtttgctgggctttttggatatctaagttgatgtcatttcaccaaacttgagaaaagttgagccatcgttttttcacatattttgtctgccacatttttttctctcatagttttctgagactccaattaaacattcgcttagatggtttaattatcctaaaggtcactaaagttctatttttatttcaatatttttgtctttgttttatggattggataatttctattgctttgtcttcaaatttactggctttttcttctgccatctctaatctgctattaggttcatccagtgaatcttttcatttcagatattgcatttttcagttccagaatttccacttaatttttagtagtttaatttctctgccaagttttaccatttattcattcattatgactgtatcttttaacatttttgagcatatttatgatagatactttccagtctttgctaattacaacatctggatcatcttcgagtcattttccattcactgctttttctcttcattaggagccacattttcctgtttttcttcacgtctattaatttttataatatattggatatgatggatgatatgttttatagatcataggttccattggcttcttgtgaagactgtttttgttctagcaggttgtaaattattagccaataacctagcacttattagaggttggctttacaccagttagggggggtctgtttcaaatttacctttagttttagcatgaatctcttaatctgtaggtattgttttacacctaatcatggcccttttaggccttcaatggaaagcttggattatttggtttttccttttatgtttggttgacacatagtggttgcacatatttatgggggtacagagtgttgatacatatgtacagtatgcaatgatcagggtaattagggtattttttacctcaagcatttattactttgtggtgggaacattcaaaatcctttcttctagatttctgaacatatacaataaattattattaattatatttatcctacagtgttatagaacactagaacttattcctcctatctagctgtgtaattttgtatactttaaccaacatcttcctatcctcctctcccctatactcctcctagcttctgatcaccataattcttcttctataagatgaattttttagctccaacatataagagagaacatgtagtatgtatctttctgcacctggcttatttcacataatgtcctccaagtctcatccatgttgttgaaaatgacaagatttcattcttcttatgtctggatggtattccattgtggatatatgccacattttctttgttcattcatctgttgatagacatttaggttgattacatatcttggtgattgtgaaaaatactgcatgggggttcagatatatcttcaatatactgattttttttttcctttcagtaaaaacccagtagtgagattgctggatcatatgttagatctattttagttttttgagaaactttcatactgttttttataatggctctactaatttacagtcccaccaacagtgcacaagggttcctgtttctctgcatcctcaccagcatttgtaatttgttcctttttaataaaagctgttctaactggagtgagatgatagctcattgtggttttgacctgcgtttccctgatgattagtgatgttgagcatttttaatatatgtgttggtcatttgtatgacttcttttcagcaatatctgttcaaatcctttgcccatttttaattggattacttgcagtgttttgctgttatttgagttccctgtacattctgggtatgaatctcttgtcagatgaatagtttgcaaatattttcttccattctgcaagttgtctcttcattctgttgatttttttctttgctgtgcagaagctttttagtttgatatagtctcatttatctatttttgtttttgttgcctgtgcttttgtggtctcactcataaaatatttgcctagacctgtgtcctgaagcatttgtcttatgttttcttctagtagttttatagttgcaggtattaatactacatgtaaatctttaatccatttttagttgattttttataggtggtgagagatagaagtctaaggaaaacttaaactgtttatcaatcctttatatcttagaaggacacagatctgacgcactgcttcagtgagcagcatctgaaagctcttctcatatctttcaaccttcaaactgtggctctcttgatttgctctttagaatctcttctgcaactcaaagatcagccaaggatttaaaaggagtttgtttactgattcacttcttcttttatagatatttccccctcaatttccagccactctgacaactcccaagctgtcctctgacacctcagtgagattgtggctttctgctttccttatagttatctcaagctgcacagactggggagtgccctaagggggaataccaagtgaaaacaacactcacacagtacattttccttctttcaaagattgaaactgctgtagtgtctgcctgacactctctattgctttcaattgttatttttgtattttgttcagactttatagttgttatctataggagggttagtcttatataagaaactatgctatcagtaaaactggaacccaagtaggatgctttattagttgtccatgcttccctaattaaggagctgccattgatatggtttgtagaatcctgttatagcagaacatatccaatatggaataagcaacacactcctggaagattttagaaaacaaagaaacccttcctaagacatacttatgggtgcaatattaatggtttcttccccatagggttctaatgctaattgcacatactcagtgatggaaagctccagaaattccctaattatatttctgctccaaagccatataatttgaggagctgatattcccaggaactggtacacccatcactttgttgggccaatgaattaagaaagattgtgtgacctggttatggtcagaaaacctgtgcctctgagccggcacctcagagtggcctttgtcagacaggagaggcaaagatggttccagcctggggcatcttggagattctagggcacagctgagttctacaagtctcaatcgaacagttctgtctctaggaatatgttaggggctggagatatgatgacaaaactttaaaatgccactaggggtctaagaaatggttgagtctgtcactgccagaatatgaactcagcttaataataagttagaaaagatgcaaataagttaaactgataatattcttcttggatatatactggctttttcctcatcagtgtgctttagcaaaggctagactatcaaaatcttttcaggtttccttttatagaaacaaagacactttcagtttttatcatattaaagtataatgcatttcaatcatcaaaagccaattttctgagagaaactatataatggaggatgtattttagagtcaggctagcctgagttttaatcctagctctaccatttactagctgtgtgattttggacatgatatttaagctttctgatcttcagtttctgaatctaaaacgtgtgactattaataggaatccaactgggaatgctgtgcggttgaaattagataatgtattttaaatgcctggcaaagtgtctgacacagagtacacacttaaggaatggagggatattatcatcatcacggttttaaaaacgatattaacattatctatgagttagctggttgagaaaagtaagagtgcagggaatcaaaagaataggatagaaggtttttcttctttgtacaacactatattgttttgataccttatatcaaaaactaattatgcatatctggcccttccctgcctatttatcctatttcatcaccacagttttcttccctaactgaaaattcttacccaaagctttttttcagtttcttaactacacaaaactctcctctgtgcgtttggccaccttttcatgcagtctccaggtctcggtttaaatatcacctcacagaacagtctaccctggacattgactaagtagctagtcttttattaatctcacacaaccacctagtgtatttccttttgtcttagtcagttcaggctgctgtaacagaataccatagactgggtggcttaaacaacgacaattcattccccacaattttggaggctgagaaattcatttctcacattccaagatccagaccctggcagatctggtatctccaaggacacacttcctgtttgcagatggccatttctcattgtatcacatggtagatagagagagaggacgcatgtgttctcatctttttgtaagggcactgatcccattcatgagtgctctaccctcattcactaattacctctcaaaggctttacctcctaataccatcacactggggattaggatttcaacatgtgggttttaagaggatgcaaacatttagttcatagcacctttctagcacttttcacaatttttgattatatgtttgcatggtacttactagttttctccctagataaactgcaaaccctgctctgtgaggttagtgaccatgtctgctttatttattaatatacttagtgcttacatagacttagtacatattttgcaaataaatgaaagaacaaatgtgatacagaggatgccaatgagtaaataaagccagtttatgacttcccacaaatacaatgggcataataattgagtctgcaatagtagagtcatgaaaagtgattgggccattgaatttttaggaatgcagaaataaattatacagttttgtttgtaagtaccaatcaataaatgtgatcatttactaatggcttaaaaattcatactgtttttctttctactttttttaaatctagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 36407 - DNA, 29368 bp, Homo sapiens
gggcggggcgcaggagccccggggcggaggagccggggaggcgggaggcgggaggcgggaggtgttggggccgttgaagcggcctccctcccgcccccagccgcccggtctggccccagccctgtcccgacccccggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggtgagagggatggcgtcccggtcccgctgcccgtgtcagaagcgggttcccaaatcccgccgttaagcgcacggctcccggctcctcacctggattcatcctgggtggatcccgcaccttggccagggatcagttccctggggattccccaccctgctgtccctgggcgatccccttcctccaaggatgggagctcctgcctcacccgggtctcccctcgcgatctgcggacctcagatggattcccggccccgggactccaagcctgtcctccttcccggggatccctttgctcctggggctcaccctcccgacccccatacaggctgggctctggctctctctgggaacccgaaccccagccccgggcaccgcccccgagtcctccgacctggctttggcctccatccctttacctccagggtgggggtctcccggggcgcgcggaacggggtggcgccctgcggagagatttgtcgtaaagcggggtgctaggcattttgggtgctttgtgaacggccctagcaacagggaaactgaggcacgctccgccagcttagccctgcctggccgtgtaggggccttgctggttctccagctgaacgtcccagggcggtgctatttttgggctctgcgaaggggcatgttagctttcgggtggcgagacctgctgtggaggcgccggtgttaggaaacgaggaggaggaaccgtggaggcgccaccggaaggctggccgactgctcattcactgtagagctggtggaaatgccgggctggggggcgccgtggccttactcccctctggggctccaccgtctaacaatggatggaggttagcccatgactctgagaggaactccgggcttttcttttctgtttaagtgggtgaaagttcacctctccagggcatatggtaactgcatccctttgtgtgaattcccggaccttcaccaccagcatgtttgctgggggtgcagtgacaggggaaattttaagaaatgcatgaaatcttccaagaaggttgttgagtttttagacactaccttttatttcagaattttaaagtacacattttttttttctttccaatctccatgccctcactgccctctcacccatctcattcctcccccagtcccaaagggtaaaggaggcaacaaatgcacagaagagttgccatggtctgggccaccaggaaggggatcagcttgaagacttggattgacttctgaatatattgcttatcagtcagggtgttgaatgcttggcactgttcccccagtggaacttcataccggtgtgtctaagggcaaaatggaaccgtagtgttctgactttagaacctgatgtcagaaatgaagaccggaggggcttttagagagaatgtaacatgcactccagtcatgatcagtgaagccctgtgcatgcggtttgatttggttttacttctctacacgtctgtgctcttcctgttttcagagaacagtggcaatattctgtgaaattgccccttccttgtttgattaagagtttgtcattcttacctatacctttggatcctctaaaaagaaaaaaaacaaacaaaccctgttcaattatttgttgcacaaacgttaaaactgttaaaacaacaacaacaacaacttcatttaggatgctaccctctcagcttattgaactgactttttaattatttttgctggacactgatctctccattccttattagcacagttgtaatgtgatttttgcgctattattcacttaaaaactaaaaatacaggtattttcttttggtgtggcatagactgtaattttcttgggggcttgtgtgtttctcaatggatatttaacagtttctttcttgatgacatctagatctaccctgattttctttgaagatttgtgtgatctcataatttcttggttttctatcataagctaggttggaaacatagttctaagcatcaattttaacttggaaataaagcctataaacaaaaagtaatgtaatgagaatgtcctgatttttgtggttcacacattaaaatgctgagagtagtactattctgcatcttttaatgctgtgttcatgatatatctttctgagcattcccaggtaggtaaattgcaaaggaactggagggagagacacactgtctttgaagggagacatgcttcctccctcctgatagatttattgggactggatggaggagcatgaggagggtttatgcaatgatggcttcttaacaaacttaggatgtgaaaaatttcactggaacacagaggcatattttatcttcctcattttatgtttcacacttgagtatccccaagatacctacacacacatagacaaacacaaagtcatcctctccccttcatagcatctctgattgatggcaataactgctaatatttattgagtgccatttatctatgccaggcactggctgggcacttgtatattactcatcctcaactataactctggaagacataaatgttatacccatttaatagaagagtaaataggtttagagaatgaaagggaacttgcccatagtcacacagctaggaaggggtagacccaagagttcaacttcatgtctgtctctcaaccagtcatgctgctagctcacctctttctctctcttaactctctgcccacaccacatctgtgtgtgggcacacagatcttataggcataagatccacagagctctactgtatcttcttgttggtgtgtactcatttcaacagtcttgcaaccaaaaatccaaggaaaaagaagcccttttcctcagccccaacctcatgatcatgcagctagcttcaaaactggatatgtgggaaagcattttaatctacagtattagaagtcttacagggctacctattgtcttttttcccatgttcttaaagcactaaatcataggcatggggtagtctccttatatatgccatcttcctttatttaataattaagtcaagattggcactattgacagtagacacttttcctgaacaaatatgctcagtcataaaggggagctaatagtaagaggggtccacttatacgttgcaacataaatgatgttgaaggggcccttggaatatccgttgtcttggattttaagtgtttttgtgtgtgtgtgagattcggggttctcttggttccaaggctgcctgtttctcttacttacagaacctgctgtgtccacagtaaaactaattgactatgggatatctttgttaagacaaaatagttcagcagtagctggaatgtctttctattcattcaacaattattaagctctagcaataagctgggcattgtacttcagtttggtaatggaaaggtgaacaagacagccttcatggaattcacactacagtgggaaaagatgaaataaaaaataagctaaaacaaatcaaagtcttaccaattgtgacatagggctctggttggatggggagggttgaaatgatacttcagttaggatagtctggaaaacctctcttgaggaggtgacatctgagctgagctgaaaggatgagaagagagctgagcattctggagaatatcctagacagaagtaaacagcaagtacacatgcccagaggcagacacaaccttgatgtgtttaaggagcagaaaggaggtggtatagccagaggatggagagagagaaagatgccaccctgagactggaggggtagtgaggcccagaccactcagggcttgtgggcctctgaacactgtgttacagtgctatcgtaagcactttgggaagccagaggcagactttaagctgggattggggtgtgtgatgtgatctgggttttttgttgttgtttgtttttgagacagggtcttgttctgtcacccagactggagtgcagtggtgccatcacaactcactgttgcagccttgacctccgaggctcaagcagtccttctacctcagtcagaagtagctggggctacaggcatacactaccacacctggctaatttttacatttttttttgtgtgtagagatgggatctcactataccgcctaggctggtcttaaactcttgggctcaagcaacctcccgcctcagctccccaaaagtgctgggattacaggtgtgagccaccatgcccagcccctcatctgtttctaatggaaaactgtagctgctatgtaaagaagagagtctgtactgggtcaagcaggaagactagttaagagactttgtatttgtacagacctgagatgttaggtctttatttaaggtaggagacgcggagctgggattacaggtgcacaccaccacaccaggctaatttttgtatttttgtagagatggagtttctctatgttggccaggctggtcttgaactcctgacctcaagtgatgaggtggacttatttgaaatatattttgaaggtagtgttgatggtacttgcactcggagaatgaggaacacttgtgggatttgatctactgagatcagcctctgagatctgctggtgggttgcagatctactcagtgggcacagtgctttaggttgaatttaaagtgtgttagtgtgctaaggagtgttcccaggtctctgatctgttctttccctccatggttttgaaattctgtcatggcatgggagaggggtatgggggaaggaggaggtgataagaacgttgggcaagggggaaggcaggagagttttgaaagagaaagtgaaggaatgagtaaaaaaactctgcctaactagtagctttattaagtgcagctcccactcccaggactgaatcaccttccttcaaaccctctagagcttgttggttactcaagcattgagtaaccattagggccactccgctttaaatagagatgtcttccataaatggatgctgttttccataaccagcacttgaacctttcccattcttttttcggggaagagatgaaggccagagtgtgggagttgatttacattttacatctgcttttccatttaggttttaggagtgatttcttcaggaggctgtggaggaggcttgattgcaccctggcaggttagagagaaatgggaaaattgtattgtactttcccagcagaacaattatgctgtctatcctactgagccccagatttagagaattgcttccaggatagttacccttatctttccctattgcccgtgtcttaccctgtgcatcaggatagagtgccttaagtcaccatgggtgggatatttttctgtataactttctacttttattttttaatgtgaattattccaggtgatcagggactaagctgtcacaaacatggccatccagtttatttgtttttaggagaaaatgtgaaagtctatccctgttgctgggtaatggcttgactatttttagattgggctgccagagatataaattgctattttagtctgcagcctggtggtgggtagacaaatcctacttactgcaccctacacagagcacattcaatttcatctaactacagccatcttggggccttgctctttagccttgaaaattcctaatagggtatgctacttatagctctgttgttatgtctcaggacaatgatgtggtatatcctccaattcttgggacacttttaaagcattcttcccaagagtgtaattattttcttttttgctaataagagctgtatagcaacactcttgtctcttaggaaattagtaaaattatttaaaatattatcaggggagaaaagatgatgcttaataatagttaactatatttgagaatagcttggataaattttgaagctactaactgtatatttctctttaacagttggttttcaaaccatctggtagattatactcagtaagtacatattttgtacactagttaaatatcttaacccatcagtgggccaagtgaaatatcttcactgtcccaaattcattccccagtggattttccacctgaactatctgtattgtgttaatagtggctgccactttatttttatttatttgatctaacgataacaggctcttcctaactcagggaaagagtattggctggtcttttattaataaacttggcactctctaaaatggcttggtcatgcgttttagccaatttttggcaacttggttctaccatttggttcagccctgtaccattttttattttgtgtatgaataaggtaatgagtagttagaactcattagtggcacaaaataccaacccccaacccccattcacacttctttaaactagcttgagcaaaaggattatttattgtgcaaagcctgttgacgtcttacagactcttaagcacaggagtgcagtggacctctgcaacctgaatgctgttgaaatttttttttttttttacgtccgtctgtttctgtgcatctacctctttcttcttttattcagacagctgcttttttctctcctgagaaaaaaaggattaattagactaatccagagtccctcatgaaacctgttgtgggtatgggttgggtttttggtggggagggcatcctcactcagcatactgaaatggaagaatgctatcctctctttaggttctgtggtattcatgcttttctctgtactactgatggtcacaaagttagcctaaagggaagtgcggaatatgggcatatgtctatatatgtaacagattttgatatttagatacgtacacacatttgtgtgtatatatgaattttatagccaaaagaatcaggtagtagtcatgtgtttggtttttgaagcagactttttgatttcaggaagaacaaaggtgaaaacatacctccggttttaagttgcctagaggtagccaggtgtcatttatttaagctgtctggtaatacaatatagggaaactagtgggacaggcctgttaatcatgggatgtagggtttaaagatgtgcctatataaagctttataaattttaagagagaaaatagaaactttgtttttcaaatgtagtgtatcccttttcactaaatgacaataaaatttagaaaaattcgttttttttttctagttgtaccgtgtgtgtgtgtgtgtgtgtgtgtgtgtgtgtgtgtgtgtgtgaatggaggaggagggttccagttgaaggggtggatatggtttctctttgcttttggttgtagaagtttgcttttggttatggaaggtttttcttttgaataaactgaaagaaggcttaatctaataaactagggtatttgcttaaggatcattgctattggctcagtttactcctctttagtggctttggctttattaccgcaactgggtatttccaccagtcacttctttgcgtagaatagaccacatacccactggtgggtttcctcattgttcttcacacactttgagtttttcttacatgtgttctttttgtttttacaggttcatgaaccatcgagctccagccaatggccgctacaagccaacttgctatgaacatgctgctaactgttacacacacgcagtgagtacaagttttccaccattgccatcctttccacggggctttggtgggaggaaggggtagttatctctagtaacctcagcacaattagttggatttacccatctgtgaccttatctaccaggaaatcagttctgggtcgtgtcaccagaaactatgtaagcatgtagaatgctttgtgtgttctaacctacagtcagctctgtcctggattcgctttctccaacaagatattctttaaaggaataataatagtatgtaccctagttatagaaaaaccaaagacacctatttatgaagactgtcacccctagaatgaaatgaatcgccttttcaagacaatcaactgtgttcatttggcaaagagagttcacagtttgttgaaaaagatgctttttaaaattaagtgatcctctgaaatggggaggggagccatagcctcccactcctacagtggccattgcttcccagaggagatgttattccatattggtgaagaaaaagccgatgtgatccctaaattttttgttaatttttttctgctttgtaaaagcaaaacatgcttattataagaaactttaaaaatactgaaaaatatataagaaaaacaaaactaaccagaaataaactgttaacacttcggtgcatttctttgtgtgtgtgtttgtgtgtatgtgtgtgtgtatatgtgtgtctctgtgttgggggtgtttgtgaatatgtatgtattttcagttttcctgttaatgtgacattaatggcatttcttatgtcattataaattttttactttacctgtggtttcattattcccttgcatttagtgacattgagggaaaaatagtggctgggatacagtctgaaaacaagaaatagagaaaagaccagtttgcttctttaacaatgagtgtttggaacaggctagtttaactgtggtagtcactgttggtacaatacaatggttcagatattgaaacacacagcttacctttaggaataatatttactcggatgaacctgaataaaccttaacttgtctcttctgagtgtgtcacaggttaaggaacacttgtgtaaacttaagtaaagggagacctgacaaaacccccatattaatttttttagaacagaaaatataatcttattaaaccgtatcttgaatttttggatttcagggaccagtaatatttctaacacagacaaaacacccctattgtcatcatttcattgaagagaagatactttaacatgaaaagtagtaaggacatgatctcaagataaagggcattcctttaaatgaaatacattttgttttatgaaaaactttattgtacttaaatgtacttaaatcctctgaaataggaaggcgagccatagactctcacccctacagtggccattgcttcccggaggagatgcaattgtatttaatgttctaattttgcttgggccaacgaaaacttcagcatctgaaaaactcatgccagtctcatctaggggatttaatagtctgttgcaaggtgacaaatgtaggtttggggagaaaaaagataagcaaattgctaacatttgtattctttgtcaagtatgcttactctaatatctaataaagtagtttattctcctgggagcttctgtcattgtaagatgtttactagtcatagtcatacacatatgactagacattaaagtttgtgaccatgtggactatgaaatatgatgcagaaagcaaatctctctaaaattctcaagattttttgaataggtgggccttggaaatggtttgctcttgcttacttaaaaggctctgttaaaaatgaagtgaccccaaaactcttacattctgcagtagctctcaaattggtggaatgtacagatccaaactgaaaatcagggtatataacttcaacaactgactttttgtatgtgtgtgttgctatgtacattataatacctattacttgatttgttcaattatcctgtcctgaaatattgagatttcaattgcaataggacagatattttaaaatgaggacctccctgaaaaatctgagtatatgcttggctgttttttgaaatggggtctcactctgcctcccaggttggagttcagtggtacaatcatggctcactgtagcctcaacctttcaggcccaagcagtcttcccacctcagcctgccaaatagctgggactacaggtgtttgccaccatgcctggcgaattttttaaatttttgtagatacagagtcttgctgtgttgcccaggctggtctggaactccagggctcaagcgattctcctgcctcagcctcccaaagtgctgggattacagtcatgagctaccacaccctgcctgcttggcatttgaatattttaagtaattactctaaatcagattataaagtagaatgaaacatgtccttatttaatgaaattaggataaaaaaaaaaaaccatctgttttgcaacagctgaatgatgttgcatccttgatggcttaattgtatccccactggttggcacaattcctggaccctgagtggtattacctgctttccagtgtagcagctaacttcatctggctctcgttatgattatccaggagagacaaatacttgctctaagattattttactaaaattgttcctggtaaagctctgtatttttagtaaaagactcaattccataaaagccagaatattccattcaccattctttatctttccctcagttcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggtacagtggatgacatgctgtttcaacagatccaaatagttgactcaacgtgtttggtacccttccaagctggcatgctttagtcaagtagggcaaagagtagacatttttctgccttgtagactagaatactatcccattattcaggacttgttctttggactggatgaagttttaggactcctccccagcaggcatctaagaaggtaggcctttgctcagtaaccccaaacaaaacctaactgattccccaggacttaccacttaaaaacctgagagctattttccagtactatcaagcacactaaggatatgatgagagcagcagctatggggtagtgacaaagcacactgagcttggagtcagcaggcaggctttgaggcccagccctgctctttaattttgggtaaatcacttgaccttgtggagcctcagtatctgtatcactaaaatgagaataataatacctgagtcacacagtcagtgtgataggtgaatgagataaggtacttgaaaataacttgaaaattacaaaagaccctatgagtgtgtgaggtatgaaggtatacttatagtttgcgtttaccattttgcaaagtttagctttcagaattaagtcttgtgtatattattcaaacagagttcacgtattttgctattaatagtcaagcactttcaaaacaatactatagctcttggcctgccaatgagaagaacgtaaacgctttcctcctctgagtgaaggattgattttggagcaccacaccatttaggtgggaatggtttgcttgtgaaatggattctgcacaaccctaaagggcaaaacttcttttcaaaaaaggaagtttcagagcagactatgagcaatttaaagaaatactcgaatatgccttttggttttaaagaacgtccaaaaaaaactcaaactattcaaacaatctgatatttaaaatatatgctccttttacaagcaggatttgagatttatgagatgattactggtttcctcacatgcagaatcctagagttttagagctgggaggatctttagaaatcatctaattcaaatcacttcatttttatttgggggaactgaggctcagagaagtggcctgacttgtctgagtcagtgaaactggcaaaatctgattattccaagacctctgactccaagtcctagtttttttcaccatatcttttacaatattgcatatagcttgcagtctgctaccttttcctgtaaggtgacagtttcctgggcttaaaataaaaccacagcattgaatcacaagggcactttgggacacactcacaagagaaccacaaaagtgcctgtcctggctccttaggacacactgtcgcagcgcccagaggccagtttagatgcaaagtactatattaccttcttggcacaatttagtgcttgtggttgtttcagcaaacttggcttcgatgtctagattttggatcaataaaaagttgtaggtacctacttcagtattctgggtctccctgccagaggtgtaatagaaactagattctctttaactttgaatagcattgctagaatcatatgccatgtgtagatttttgctcctcattaaaatttctaaatatcaaaaaagccttatttaagtaaaagtgagaagggaatttgcatttattatgtggtaggtgctcctgtgtgctaggcactatgctagatacatggcctacattatctcatttaatgttcacacatactccatgagaaagatcttatttccactttacctatgaggtaagtgagagtcagagaggtcggtggcagattttggataagattccaggtctgttgtctacctactctaacagcgtatgacaatctagaaaacagaattagaaaggcccaaaaccttgctagaaatcacagtcatccaaggagttttaaaaacttattctccttcctccaccctctatctcacctcctagcacttcagaatcttctgaactggaggccatcactgtattttgtaagctccccaggggatgatatgcagtcaagtttgaaaagcattgacgtaatgtttgcttctttagacctatggcataaagtatcatctatgggtatgctatagcttctgatgactagtagactgaaacccattctttctcacaaatgtatttttcattcctttaaaactttttttttatttttaatttttgtggatacacggtaggtatatatatttatggaatacatttttgttttttttgagacagactatcactctgttgcccagactgtagtgcagtggtgcgatctcagctcactgccacctccgcctcctgggttcaagtgattcttgtgcttcagccatccgagtagcttggactacaggcgtgcgccaccacacctggctaatttttgtatttttagtagagacagtgtttcactgtgttggccaggctggtctcaaattcctgacctcaagtgatccacctgcctcagcctcccaaagtgctgtgattattgctgtgagccaccatgcccaggctttatggggtatgttttttcacttactcacacaagtctttattatttgctttggtcaatgttacgtgtagggggaggaaagtctaatactagcgttccctcaaattatagttatacctacttggacactgaaaatagattcaagatgatattacaaatttgtacttttaaattacctcagtaaagggcaaattccatctaatccattttatgaatagacctcagtgaaccaaactctttgtacatatacctctgacttttcagttttggaaggaggaacttgcttagaaatacaggtggctatgcttttgtagtaaatgtgccattttttgtttttgttactgtttttcctaagttagtttctgaatttcctttattactatttactgtccacaccaggatatttgaagtaaaaactgtaaataccttctaaaaagacacaaagaatgtgatttcagctcagggagtgtttactgaacatcaggactttgccctgcactgataggagctggggcaggttgcggggaggtggtctgccctccaggaacttcatttttctgttagaggggatccaaaagaaatggaaaacatcagaaaaagacagattttgtttgtttgctttaaccacttcaggctttctaactatcatggggccctgtccctatgtcttatatatgctgagagaatctattgtatgtgcaacctaaaaaataacagaaagcttttactcgtgacttcataacattaacagcaacaaaaatctgtgtaaccttggaagaacaagtgtaaaggccatgagaactagaacaagaatggaaattgcaacatagtggagtgataacccgtacttcccatctgaacactttctgacaaatttacttttttttccccctcgctaggacagtggagcattgttttcacatgtgtgatagaatggttatctatttcttcattgctgcttcttatgctccatggtaagatacagtcttcctattttcgaaggtagtgattttatgattagaattcctcactcctcctttcctttctccctcttgtccccaccctcagccctcatgtgtacaccaccttccctcctcctgaacacatacatgcatgcatttttttccccatttgatgtacttgggtcagattgcatatttgaaggggagaatattgctgctgtttataatatctgggtattggattgttcaagaagtgctatgaacttgtgtgcagatagcttgctcactcttgaaatctgtaacctttgctctccatattgtttccctatacctctgctattgttcagaacactagaaaattgaattattcaagtggaaatgctgtaaatatgtatgaggaaagcaagcttatttatttatttatttatttatttatttatttatttatttatttattttgagatggagtctcacaatctcggctcactgcaacctctgcctcccgagtttaagagattctcctgcctcagcctcctgagtaactgggattacaggcacgtgctaccatgcctggctaatttttgtatttttagtagagacggggtttcaccatgttggccaggctggtcaggaactcctgacctcaagtgatctgcccaccttgatctcccaaagtgctgggattacaggcgtgagccaccgtgcccggcctatttttttattttttgagacagggtctcactctgtctcccaggctggaatgcagtggcgtgatctcagctcactacaatctctgcctcctgggttcaagtgattctcacacctcattctcccaagtagctgggactacagacatgtgccaccacacccagctaatttttgtatttttggggggagacgggatttcactgtgttggccatgcagctcactgcaacctccacctctcagattcaagtgattctcccacctctttctcccaagtagctgggactacaggcgtgtgccaccacaccgagctaatttttgtattttttggtggagatagggtttcaccatgttgtcgataccaggttggtatcgaactccgaccccaagtgatctgcccgcctctgcctcccaaagtgttgggattacagtcatgagccaccatgcttggccatttttgtttgtttgtttgtttgtttgttttgagacagagtctcactatgttgcccaggctggagtacagtggcagtggcccgtggtctcagctcatgcaacctccacctcccaggttcaagcgattctcctgcctcagcctctcgagtagctgggattataggtgcctgccaccacatctggcttctttgtttgttggttttttgagacagagtctcactctgtcaccaagcctggggtacagaggtgtgatctcagctcactgcaacctctgcctcccagtttcaagtgattctcctgtctcagcctttgagtagctggggctacaggcatgtgccaccatgcctggctagtttttctatttttagtagagacgaggtttcgccatgttacccaggctggtctcaaactcctgacctcaagtgatctgcccacctcagcctcccaaagtgctgggattacaggcgtgagccaccgcacccagcctgtttttgaaacttaagccatttgtcttcaattcacctcaagtgcagtagctactatatagcaagtgtgtttatcatttcttttgctgagtaagagaaccatttaaaatacctagtatcctgttcattgcctttgatctttctgcctttttggtgctgatcaaatataatcttttgttgctttgaaactcttaattaaagaaacattagctttcttctacaagacataatccagttttaaaaactcagaagcttatattttgcaatcatctattgtagtcattagaaacagtatgcctctagattctgactaatgcagcatcaatgattcaaaagaaacctgattatctgaaggagtaaaaagtaagtgctatctttgcccagcatctgactaaattataggtcggcttcatgttggaagaagaacactgaaaggcttttatgaatggacattaaatgcccagaacaatgcttatttcagtaggaacctacagggtgttccaaacaggattccttacttagttattttaaattctttaatttaaaataagtaaatgaataaaattaatttaaatgtgagctgaggagttaaatatcatagtaggcaatttgtttacctgtagttttagatatgtaggctgtactttttccatttggaaatgtgacttttgtagttatagataatcaggacaacatttgtttcttcctcatttattctttttttttttttttttctttgagacggagttttgctcttgttgcccaggctggactggactgcaatggcgcgatcttggctcaccgcaacctctgcctcctgggttcaagagattctcctgcgtcagccttccaagtagctgggattacaggcacgtgccaccatgcccagctaatttttttgtatttttagtagagatggggtttcaccatgttagtcaggctggtctccaacccctgacctcaggtgatccacccatgtcagcttcctaaagtgctgggattacaggtgtgagccaccacacctggcctcatttattttatttattttttttgagacagagtcttgttctgtcacccaggctggagtgcagtggtgcgatctcagctcactgcaacctctacctcctgggttcaagcgattctcctgcctcagcctccctagtagctggaattacaggtgcccaccaccatgcccagctaacttttgtatttttagtagagactgggttccaccatgttggccaggctggtcttgaactcctgacctgaagtgatctgcctgccttggcctcccaaagttctgggattacaggtgtgagccactgttcctgaacttctcatgtattcttaatatgaaattagtacaaatgaatttgcagcattttaaaattcaaacctcacaacagtccatggttaaattctaccaaaatgtcttccataatacatgttaggaataattcttctcatactctctcttggcagagagactgataatggagacacacttggtttgtgtattaggtatccactgtgggtatctgatcctgcgtcaaaattttgttccaggttcttctcattaaggtttgtaagtaatctgctcccaaatacatggtcagaaattaaagggcaagcagttttgacctcattctgcctaatagggtaagttaggcgtcataagagtgctgggactcccttcaacttgtctgcttttagctggttctatttttaaaccatgttgaaactaattcttttttttttttaggtggagtcttgctctgtcgcccagactggagtgcagtggtgcaatctcagctcactgcaacctctgcctcccgggctcaagcaattctcctgcctcagcctcccgagcaacttggattacaggcacatgccaccacacctggctaatttttgtatttttagtagagatggggtttcaccatgttggccaggctgatcttgaactcctgacctcaagtgatccgtctgcctcggcctcccaaagtgctgggattacagatgtgagccaccactcccggcctaattctgagtcttaaaggtcgactgacaaatttgtttttgagttgcttaattttacctaaattgcccaaatgcctgcttgatgtgttgagtgtgttttcttcctgctcttatcctaagactttctcagttttcaatgacacaggttctatgaattcccttcatttatcacttctgttctttgttgtcacgtttacatttttaggttaaatcttcgtgaacttggacccctggcatctcatatgcgttggtttatctggctcatggcagctggaggaaccatttatgtatttctctaccatgaaaagtaagagaaaataatttacatttgatagttttaaaattgactgcctaaatattatctgcactgcaatacaatttacttttatttgtacttcaaaacagtagaaatacatatatagaatatgttatttttaataaatcttcaaaaccatttggtattcattattagtggaaagattgctgtggaaaaacaagagtggtacaggtttggtataatgtagttgaggggacatggtaaccagcccctttggagtccatcagacttcatttctatagcatgaggcaaattggccttattctctgtgattcagtcatcacgtgagaaaaccagccacttgtcaaggtgtctatgaagattggagagaatagatattaagtgctcagtacaatatacctaaataagggcctagagggtattccaaaaagggtatcttgagaaaaaggatgttgggaaggacattggaactcttaatatcctatccctagggcacagctttttagccagttattcatagctgatagtcctaattattgagccatataaaaacaaaagctaattgaaatttagtatctttgctctagaggagaccttcaaggtcccctattccaacttcatgattaaaaagtcagaacatttaggatatgcatcaaattagtgactcatctggaaattaggacccaaacatccaagttctgattccattgctctttttattaccctgtatgtttgaatttgagaaacacacaaccaggaaatctttgtcattgggtttatttacagttcattaaattctgtatctattgtgcttggcagaatggctctcagaattgaacataatttgtgtttatcagaaaatactaaattgttttcccctttcagaagaagaaaatggtagttttcactaacttctttttgtctctgaaattcacttaaatacctttttgaccataattagcaatgctgagtagtgttatatattatagcatatttaagtccaagggaatggtttgcttcttggactcaaatctcttatttatatccttggataaaataggaagtcaagaaaggcaactatcttttctccttttcccggccttctggtgtaaacaaaacccataaacccattcttcccctatctgattatttcatggtaggctttgagtataaaacacgatgaatgaggtatgagtcacccttggccattcagtttggcagacattagggagtacctaaattgtatcaggtactgttctaggatttacagatcaaaacataattaatcttggttcctgcctttgaggagcttatcgtctggtttgattaggctgaaatgtaatttgaatttcaatacaatgtatttcttagggtttttagatcttttgtagtctaacgtgatgagccttaaaattacagtttgtgcaggtgcaaaataaagagacaaacaaaattacacgtcctttccttagggcttgctgttcctttttgctgataaactaggctccaggctgcatctccattcatcttcagaatttcacttctagctctggattggaatggtaatgaaagcagacactctaggatcagaagaggaaatattttacaaggtggagtgggttaaacgataactacttttggcagaaaacattttcttttttttttcttttctttttttttttttttttgagactgagtctcgctctgtcacccagactggatggagtgcagtggtgcgatctcggctcactgcaagccccgcctcccgggttcacgccattcgggttcacgccattctcctgcctcatctccccgagtagctgggactacaggcgctcgccacgcccagctaattttttgtatttttagtagggacgggtttcaccgtgttaatcaggatggtctcgatctcctgacctcgtgatccgcccgcctcggcttcccaaagtgctgggattacaggcatgagccaccgtgcccggccggcagaaaacattttctaggtggcatgtgggatttgatgccttttcaaccctgagagaaatgctagttccttgttactcagctactgtgttttagttagaggcctagtggttgcctactgagaaataaagttttatttgaatagttaagagtttacatttctttctcaaaagtaaaaaggaaaggctggtatgtaaattgttaggtgttatagaaatttataagttaaattaactgcatttttgttcctgcagatataaggtggttgaactctttttctatctcacaatgggattctctccagccttggtggtgacatcaatggtaagacatggcttcagaattttagttattttcttttaagctgctggaacttaacatgattatggatatgatatgtagcttttctttataaagttatgtccattaaatagaggctcaaaagaaaaagaacttataaataatgaagtgtttagcttggcatggtggcatgtgcctgtggtcccagctacatgggaggctgaggcaggaggattgcttgagcccaggaggttgaggctgtggtgagctgtgttcatgccctacagcctgaggaacagagcgagaccctgtctcaaaaaaataataaaaataatgaagtgtgccagcaactcgtaagcttgcactaggtaccgtgtacagtttgggaaagctataaattcaggtatgtttctgtctttatggtactttcctgaatcagaaccagaataggttcagagaggtatttttcaaatccctttactcttacttttcctttcccttgcttttaagtcgtaagtcaagcactttttttgtttgtttgttctgttttctaaggcaagcacttttttttttcttttactttgcttgaaaatatcttttggggattttcgtgggtaaagtgtaacattacctgtaataggcagttgcatgtatatatttgaattccctttcaaattgaattactgttgagaagtctgtgtgtgtctgtctttttgaaatgaaaatatattattacgacttcatggttccatccacctggttaccagccctttagcttatatattgcagtatcttaggctctaggcactatattaactaaggaggtcccaaggtgtttcgtttgaacccttctgagcctacattgttcagaagaactgtacttaggatttcactcctaatctcataggcacattgtaagaacctttttttttttttcttttttttgagacaaagtcttgctctgttgcccagctggagtgcagtagagcgatcttggctcactgcaacctccgcctcctgagttcaagtgattctcccacctcagcctcctaagtagctgagattacagatgcgggctgcaacccttggctaattttttgtatttttagtagagatggggtttcaccaagttggctagtctgttcttgaactcctgagctcaggtgatccacctgcctcggcctcccaaagtgctgagattatatgcgtaagccatcacgcctggctgtaagaacataattctgtgatagtttttttcctggtcacaaaaacacctataaaaggtttaaaagtttcaaatctggttctgttttttcaggggatgtcttcatgagaatataacaaaatatatttctttgagatacgaggtttatgatggctttaataattacctagcacccaaaatacatatagatggtaaaagcaacagggaatggtaaggaggaggagttaaaggacagaaatgagaaaatcagccttgaaggccatatagttagaaggcatttcaggacaccccaagcaatataagcaaggtttgtgcagcttaatagagtagaatttcaagcaaattccctctgggtatcataagagcaggtttatccagtaattttactagcctaaatttgaaattgacatttccataagtggtacaatagcaggtgactaatgtttgtgataatcaagcaggatgatcccccacactgccttcatagaacttagagtcaagcaggcaaatgcagttcctattaaagaaaaagagatcatgaaatttgataaaatatttgatgggggaaagttcaggctgctatgcgaacatgacagaagtaccagaggaagtgatatttcagctgatttggaaaaacatgtagaagctgagagatggtaggggtgaggcaagtgttacaggtagagaatacagcatgaaggaagcccagagaagggggaagcaccagcatctttggagaaatgaaaatagctcattgtttgtaacataaaatacatgtaccagcttgagttatgtacatatgcatggtgggggcaggtatgcaggtagcacaagtcttgtaataaagctggagagctagacaagagtccagatcacaaaggacctcaaaagccactaacacagtaacagaatgaatgaaaatgcgaatctttggttctggccagaatcatgggtctcagacttacccttctgccataaagaactgtaaaactagaaaaagaataaaggcaactgtttttttggctctgaacccaaacagtacaggactgtgatccttgaaggaagagaaaccaagaaaatgagctttgaattcaccccagtagtttccctggagacactttccaaacagcaacaaaaggaggtaaagcccagagaacagcagcctgggtggaggaaacagaaattacagttcaggttactgacatggctgcagtttgtggggcagggtatggaagaggaggaagccgctcagggaggatgcttcagaaatccatgaagcagtttccgtgagtcgttgtccagatatcaagctgaatgttgtacgggccaaaactctgcaagctccagttgcaaataactcttagaaggctggaagataaatggaaattccggacagttcccagtgctgaaagacattgaagttccaaccaagcagagttcagagatggtgctggacatcccaggcactcagctgaccctgccaaggccacagcttaggagtagagctactctatccctagagggagggctactctagaactgccataacaaggcccagacaaaccttgaaaggataaaattgatcctccagtaaataaaccgcctaacagaacaaaactcaacaatttttaaaggaatacaacagaatctttactgtaacaacttagcatgtaccataagtaaatattatcagaaataaatcaataataatgtaataaaataaataataaatatataataaatattaccagatgggcaagaaactggaaagtgacacatacctaagggaaaacagatcaatagacacagatcaaaagacgggagagatactgagattcacacacagggagtttaaaacagatgaggaatctcagaaaatacctggagactatgaagaagaatccacatggagattctagatccgaaaactgtgatgtcttaagaaaaaaaaattattggagggatttaataacagattggatattgcagaagcaaagttcagtgaacttgaagccaggtctgtagaaactatacaaactgaagcatgagagaaaagagtgatttaaaaatgaacaaaagaagaaagaaattggggcagttttttgttttgggttttctgttttacagtttttcttttcttttttttttttttttttgaagaaataatagttacaacttttccaaatttgatgaaaaatatcaacctagagatccacaaagcacgaggaggcctgagcagtataaacacaaagaaaactacactaagacacattaaagtcaaattactaaaaaacaaaggcaaagacaagaccttaaaatcagccagagagagaaaaaagagcaaggagagaagatgaccactgacattttatcagaattcatgggagcaggaatacaatgtaatggcacatttaaaatgctgaaagggtccgggtgctgtggctcacgcatgtaatcccagcacgttggaggctgaggcgggtggatcatgtgaagtcaggagttcaagaccagcctggccaacatggtgaaaccctgtctctactaaaaatacaaaaattagctgaatgtgatggcagaactcctgtaatcccagctactcgagaggctgaggctgaggcaggaaaatcgcctgaacccaagaggtggaggttgtaggaggttgtagtgagctgaggtcgggccactgcactccagcctaggcaacaacatgagactccatctcaaaaataaataaaataaaataaataaataaataaaatgcggaaaggaaaaaacaaaaaaaccctgtcaacttcaagttgaagttagcacagtttagtaatattaatgtcaaaaatttaaccagggaggccaaggcaggcagatcacttgaggtcaggagttcgagaccagcctagccgacatggcaaaacccgtctctactaaaaatacaaaaattagctgggcgtggtggtgggcacctgtagtcccagctacttgggaggctgaggcaggagaatcactggaacacgggaggcagaggttacagtgagccaagatcgtgccactgcactccagcctgggcaacggagcaagatgctgtctctaaataaataaataaataaaccaggattgctagaaatgatgaatttgtatgtaaatacatggctgtttttcatttcttaatttcttcacaagataacatgggggtttctaacatgtagaagtaaagtacatggtaacaatggatggggtggagaaatagaagcacattgttttaagggtcttaaccttgtatagggggtataataataaaggtacattgtgatgagctaaggatgcacactgtaatccgtagaataaccaccactggccaggcgcggtggctcacgcctgtaatcccagcactttgggaggccgaggtgggtggatcacgaggtcaggagttcgagaccagcctgaccgacatgatgaaaccccatctctactaaaaatacaaaaattagccaggtgtggtggcacacgcctgtaatcccatctacttgggaggctgaggcaggagaatccacttgaacctgggaggcggagtttgcagtgagctgagatcatgcactgcactccagcctgggcaacagaacaagactccatctcagaaaaaaaaaagaataaccaccaccaccaccaacaacaacaaaagcaaaataaatgttatagttaagtagtcaagagaaaagataaaatggaatcccaaagttattcaatttagtctaaagcaggtgggaaaattggaaaacggaaacaaaggatggatgaaaccaaatagaaaacagagagcaagacgggaggcttcaatacaaccatatcagtaattaggtacctcatatataataacaattacatcacaatggactgaacactccaactaaaaggcagagattgtcagactggataaaaaagttttctcatctgtataatggagataatagtacctaatttagggtcgttgtgaagattaaatgaataaatatatgaagtgcttcaaacagtgcctggcacatagttacaataatgataatgataatgaaaaaaaaattctgttttgatacagaattaactatgttctaggtctttgaaagttgaggtaaatgtggtatcttgaggatactagttaacagaatgcatgtcaaaactaacctgcgtacttggtttggtgtcttgcttgttttggcagaaaggaaaaaaaaggatattttgtaacagtgactggccatgtgattttgttcaggccacttcactgctctggccttagtctcctcacctctgcaataagggggttgtgttagatgagtgactcttactatttgggagtccctgtgcccctttgcgaatctgatgagagccttacccctatcctagaagagggctcctaatacacacacaaatacttttgtataatgtgtattcattgctgtataaccttgaggaattaataacgtgtggtattttgtctttgtttttactttttaaataaaaataaatctagctgaagtcctttcttaccaaggttaggaagaaatccaatgtcagtccatttggattggctccttccccatcttttgatcccacacaaaacatgggggcttctgtgaactttgaaaaaggactgaagctcacagctggccctagatcctcacacctggtccttagctcatgatggtctattgttgccttgcttttagccgagggccttggggcccattctaatcaggtgcctgagttagagcttccctttactcttgcggggcacacaaggctgctgcccagtgcccaggcctctaggacacccacacacctatccccttccaaggccctgccgtgatctgccttaggtttccattcactctgcagaacctgtctcctttctattcctagtcctcagaaatccaggggactaacttgtttcttcatcagcttctaagcattgcctctattctctctcctcattcatacaagccattttaatcttgtagatgggccttggtctttgaaaaccaagaacagcctaaaaaattctcccttctgccctaagacacacaagaatattaacttattgctaagctaagcaatggccaggctcgaatacaaaaaggcctggagacatctagaaggctaggaaatatcttgtactatgtgatctgtgatttcagaggtcacttctagttacggttttcctgtgtcagccttaaggaatctataagctcacataagcaggggaagtctcaaagcagcaatcagtgtagaacagtgtttgagaaggacaaagggaagtaaataccctgcctgagatgtaaattataaatagagtggcttgggcctgccttagtagggaaggaagcatttaaaggggaagatgagaacagaggattgcactttattaaaatgaactcccatgtctggctatgattgcagtttgcttaaatatgctgtaaatgagcagaatgttctgctttttcatttgggacctgtaatgtgattgcttgctcaactcaagagtgtcagtccaaagggcaatccaggtcgatgtataagagactttttttatgtttggttcatgtttacagatcaggattgtgttcacacagcttcttcattgtctagaaaatcaagagccttagagagaattacagttatctgtagcttgccatgcagagtaacatcaaaccctttttatttttttttctctgttgacagaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgtttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgttcca

SEQ ID NO: 36408 - DNA, 163487 bp, Homo sapiens
aatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagaggtgcggcctggcaccgcccgggcacctcccgcctccgccgcggcggccccgacccctgtcccgactcccccgaccaaccccgttccctgccggttctactgcggcctcctccgtcccctgtcgggtcccccgcggccccctcccgtcccctgccgccgcccccgacccctgccccagccgacgcggccgcccccgtcccctggcgggtcccccgcggtctcccccgtccgctgcccggtctcctggggccgcccctgcctcctgcccggtccctgtcctgtgcgtcgggcccttcccaagatgcagagtgcgccactgcagacccgaggtcgcggccaccggctcctgggctaggccctttttctcgcctcaagagccgccaggtggagggtctccagggtgcttgtttggggaaagcggaaacagactgcctgggcgctgttaaaatgtcagcagccaaggaagaagcagcgacctggcgtctgctcgggccaggtgacctttatggcggcgccttctgtccctggtcgcttttccaccgaatgtccgaaactgtagtgactgatggccagggaatggcttagttatctgagggaatcttgtcttgtctgtgaaaaagggaaacgggtgcaaatgggaattcagacaggccaggagaggaaggaagggaaggattgaggtgaagatgattgtcctcttaggggaagaccacactggacgtcggctcctggggcacttccttgattccgctgtactcctcagcgggacgggagaggcggaggttccaggagggagccttccagagtcggtgcagggttgacagaagacgtttgttttgcttttcctgaactttcgatcgccagcttatttggtcttcttgatgttatagggtcgataaagacaggagtggagtgatatcagacaccgagcttcagcaagctctctccaacggtgagtgggccagtgggaactgggtctccggaccaagaagccgcgagcctgccctgttcacagtggataactttctgaagttgtttttccaaggacaaaggaatcattaggacaaattgttattactgcttcgtagtggagatgcttctggtttattttgtggctaccgctgttactgcttggagtgcctcaccgagccagctaacaactgcgtgcgtgagcacagggaaaggcttcttgagaaatgaaaactagattgtaggtttaggaggggaataggaagcttagctctgtacagccgaaagccttttggtaagttggaggtccttgaatttcctgggtgactgcatcttggtgacttctctgaatagaccttcgagggcactggggggtgattgttggagggcttggggagctcaggcagcccttgtatgggaatgtggctgttacaggaactgcagaaactgggactgggttcctggggaaaggattgggggtgttggaggcgctggccaggggattatggggaggtgttcttatcagtgtgcgaatactgggcgttcaggcagcgggaaatccgggtccttgcgtgttgtgagctccctggaattacgttcttgccagtttcagctcagttgatccccctcccctccgctatcattggacacattttacttcattgaaacctgactgccactttttctgtaatccctcaggggcagtcatcttttctgattctgtgtatagtttgcttttccagatccgtgccatttaagctagaaaaggggtcagttttgagatgttgtgaaaatgttgaaaggcttcttgttattagtgggaagtatctgaagttgccagagactgaactggggcgcggggagcactacggctgctagacactgcctcactgcgctgtgggtgggggggtgctggattcagccttactgcctaatgatttgtgaggatttgtgttttcagagtaacatttttaccttatattacgacatcagttcctaatatgtggcgtgtgggccacagatgctggtgtattatttcacatgcatttctatagattgttttcagggaattcagaaatgctgttatctctacactagtgattgtgctttcttggtttttctcttttcattattcttaaatcctcgttttttttttttttatttgcatctcagttcgtttttactcgggaagtgcaagacgtggctactagaaagagatgtcaagagaacccggaatccagtaggctacaatttggcaaatctcagcttaaaacttcctaaatgttgaccacagtggatgcaaatggctctgtgcatcacctgttaaatatggtcagatgaccatccaggttcaagtggtttgtcaccagggtgatacaagccacacggagtgccctcctcagaggccatgtttcagagacatttattttgagtggttttccaatgagtgatgcaagatttatgatccattttaacagcctgctttttatgcatttgctctaatttttagattttaggtttagttttaggttttctgttaaacttgctcaaataggagtggtggtcaaatactggaccgcattagtatggtagcctgcccaccttggcaggctccactggagtgctttggggcctgcctggattccagtcctggctctaccagttttgtgtcctcgccgttactgggagggagtattgaggaaatgcatgcgaggtgtttccgtgattcctggcacggagcaagtgctcagtaattgtcagctgtgagtattagtagtagctaatacactggtactattcttggctaacaagccagctcaaagctttgatggttttccattacctgatgatggtgatgatggtttccacttactcaacactcacacgctgggctaggcacttaacccaaatccaaggtcagcattattgtttgggggtgggggagacacctcctgctctgacttgtgtgtttgggttcctgtattttcaccagagggagttagtcctgccccagttcagctggtcctcaaagtgtatatagctctttaaccatcagcaagtgtctatcagaacataatcttgatttcagctgctactaaatatctaccaggagactgcttgagagaattgcctgatgggtgctgagtccaccattcctgagatactttgaaatcagtggcttaacccaagctgtgtatcgggaccctctcaccgtggtcccaatggagtcacttttcttaggcgcccccctttaccttgggctctgagcttcctctgcctttcatctctgtgggatgaagccccaccgcccttcaggatgcaaagccctcttctctaatgtgagtgcagggccaggtgcagtggctcacgcctgacctcccaacactttgggaggccgaggcagggggatcccttgagcccaggagtttgagaccagcctgggcgacactgtgagaccctgttgcctgaattgccctgggagatttcctcagcttgtgctgggggcatgtggccccatgaagcccgtagtcactgttcaccctgagagacgctggctttcgggctcacacacctgctgcggggcagccccaggaaatggccaccccatttctcctggagctgcgcgtgttctcagaaactgtggtggccgttctgttttgtttgcatcttataaacgtttacctgatgacattttcctcttcaatttagctgctagaaaatttaaagtcaggttggtggctcaccagtaatgagagtttagagtagaagtaaactttatgacatagtcttagactcttcactttcttctcaaccaatatgattcacatttactttattttgctgtaccgtgagtgtctctgtgtttcctgaattccttctggaataaggcaggttgttagtaagcacaggtttctggtccatctcacagcctcaggcagtgggcattgctgtcggtgctccctttccgggttacctgtggtagctctcaagttgcagggctgcgatttgaagcctgatttagtacaccgtgtttctgttgtgttctgtggtggtttgctcctcacatgtgagcattcaccgtggccctgtgtttttccaccacacctctgcctggtggcatcctactggatgtctcagccgagccactctgttctgaagatgcccttgtcctccacccctttgctttgggctctaagcttcttctgcctttcatctctgtaggatgaagccccacccgcccttcaggatgccagccttggcaacattgtgagaccctgtttctacaaaaagtaaatgagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgcgctgctcctgccattggatcatcgcagcatttttcttttctctgatatgcacctttttcctcatcgtgggggctcacgttttcatagttccctctcactactaggttgtgagctgcgtgaaggaaggttcatagttgtgttgtatgtacaggcacacaaaatttgtccttggataaacacatatcctcttccttcttctctctgaatttctttattttaagaaaaaaattagagatggagtctcactgtcttgctcaggctggtctcaaactcctaggctcaagtgatcctcctgcctcagcctatactaatatgaattcctatactaatatgattgaaattagtttgatttctataataattgtgctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccacactgagaaggtatttgtggcccatacactgattccttcatgagacttgtttgcacaggagagctgctaaaaattactgctctcagggaggtctgtggtgaacaggtatgaagaagaagactgttctctgcccttctttttgcaataaaatgttccaaactatcttgagtttgatcccttttcgggtgtttggggtttttttaacattcacatatttcttggaattataagaaattaactttgtgcttctgaagtaggtttgccttaatataacactgatgtatttgtaaggggcatttttaaagctgtactttaaaaaataataattcttacattcgtttgaaggtttttttatgtgtgtttttgagacagaggcttgctctatcgcccaggctggagtgcagtggcacgctcttggctcactacaacctccgcatctggggttcaagcgattctcctgcctcagcctcctgagtagctgggactacaggtgcccaccaccacgcccagctaattttttgtattttttttttttttttttttttgaggcagagtctctgtcgcctaggctggagtgcggtggcactatcttggctcactgcaagctccgcctcctgggttcatgccattctcctgcctcagcctcccgagtagctgggactacaggcacccgccaccatgcctggctaattttttgtctttttagtagagacggggtttcaccgtgtcagccaggatggtctcgatcttatgacctcatgatccacccgcctcagcctcccaaagtgctgggattacaggcgtgagccaccacgcccagcaattttttgtatttttagtacagacagggtttcaccatgttagctaggatggtcttgatctcctgacctcttgatctgcccacctcagcctcccaaagtgctgggattacgggcgtgagccagggggccaacatggtgaaaccctatctctactaaaaatacaaaattagccgggaatggtggtgcgcgcctataatcccagctactcgggaggctgaggcgtgagaatcacttgaacctgggaggcagaggttgcagtgagctgagatagcgccactgcactccagcctggggggcagtgagactccatctcaaaaaaaaaaaaaaaaaagaatagaataacccttgtttaggtgttaacaaaatccaggccagacaaatctaaactttaatctcatacccagttcctagatgagtcccttctccagctcaggttccgcctaagcctcagggttccttacttggtgggcaccacctgctcccttccccacctttgtcctctttttcctctgctggctcctccggggttgggtgtgttcagaggcagagacaggctaaaggtctttggcttttaggttctgttggtgggtgagttccagatatagctttctcttgtaggatatttcatttatttatctattaaaaatatttatttagaacacaccattcatgtgccagaccctgtccaggcactggggatagggtgataaatgagatcaacaaaaatacctgcccacattaagctcctgttctagggaagacagaaagaaaatacacgtgtccttagtatattagaagattccaagtactgtagagaaaaataaagcaggctggactcggtggctcatgcttgtaatcccagcactttgggaggctgaggtgggaggattacttgagctcaggaatttgagaccagcctgggcaacatggcagatcctgtctctcccaaaaaaaaaaaaaaaatttagctgggtatggtggcgtgcatctgtagtcccagccactggggaggctgaggagggagaattgcttcagcctaggaggtgaaggttgcagtaaaccgagatcgtgccattgcactccagcctgggtgacagagccagaccctgtctcaaataaaacaaaaggaaagaaagaaaatgaaaaaaagaaagagatggggcaagcaggggagagggctggggacacaggggagggtgctggggatgcaggggagggtgctggggacacaggagggtgctggggatgcgggggagggtgctggggacacgggaggggctggggacatgggaggggctagggatgcaagctttcctgagttcccacagttctctgcccctctcctgtctcacggggtgtgggccacctgtggcttgcggttgtttcgcgccaagctaatatcttgttcttcccaacagagaggcccgttgaggcttctctgtcctccatggggaacagcattggcctaaacctgcagacaccattgcaaagggaagtcagctcaggcaaacccgctggtgaagaagaattccagtgtggggacacagagactgacatttcttgccatgggtgatttaattttgggcctcagtttttcattcccccctaagagtatgacgcagccgcatccttgccagggccggagggagggtggatggacttataggtgttgcttgtggctgggtgacttgcttctgccaacgagattttcacagacacggcacaagcagaagcctggaatgtgtggcactgccaggcctgccctcttaggctcttgattttccccacgagatatgcgtgccccagggaacggcggctctggctgtggaatgagaggcgtgtggagcaggcatggttcccaccctcagcctagagtcaaggccagactagatcagcctaagcccagccacgccacgggtgcagcagtgaagagcaaatgccaactgtccatgacagtgactttcaaaggggcgtgtcatgtgcctcatcccagcaacagggaaggcatttctctatcagtcagttggtaaatgattattgacaatgtgtgggaaggtggagttatttgagtagatttggcctctattctcatggagcttcctttctagaggggaaggcagatgatggatgaataaatataaatgattctaataggttggtgcagcagtcattaaaagtaatggcaaaaaaaaaaaaaaaaaaaaaaacgaggagccggtgctgcagttcattaatagtaatggcaaaaactgcgatgacttgtgcgccaacctaacccagtaatcacgggtgtgcaaaatgtggcgatgggcaagttccgagtgctaggagagcatctagcttcccggagtcaggagacgggggttggcaacctaaccaaggttaagtccaagggaggggggtgggcagggagcgatatttcagtggagactccaaggacgaatggtatttagagagtaaaccccgatagagagggtttgtgtctggcacagagaagagcctgtgcaaaagccagcggggcgagaggacaccatgtgttcatccacctgaggggcgaccagcaggctggagctcagcgggttgagaggaggatgcagagcccgggaaaggcaccctaggcagagggcacagcagggcaaaggcctggagtcaggcctgagcctgtgtggtttgaggaacggatagaggcctgtccggcaggaagggaacagcacaggggagagaccttaggccagagcagagggcagggctgtgctgggcactgtgggctgtggatggtgctggcatttaagaggggagaccatagaccagggcagagggcagggctgtgccgggcactgtgggctgtggatggtgctggaatttaagaggggagaccatagaccgaagtagagggcagggctgtgctgggcactgtgggctgtggatgggagctggcatttaagaggggagaccataagccagggcagaggggtggggagggctgggccaggcaccagagtggagaccacaggccagggcagagggcagggctgtgagggcactgtaggctgtggatgggagctggcatttaagaggggagtccatagaccagggcagagggcagggctgtgagggcactgtaggctgtggatgggagctggcatttaagaggggagtccatagaccagggcagagggcagggccgtgctgggcactttgggctgtggatgggagctggcatttaagaggggagaccatagaccagggtagagggcagggccgtgctgggcactttgggctgtggatgggagctggcatttatgctcaagtgatgggaatatgttaaaagattttaaggaggggagtaacagttgggattaatgtgtattctgggaatctcaacaaagtaaattcatagttcgaattttcataagacttctgcacaggcagagagaaataagatcgcatctacagctgtgtggtgattttctttaaaaatactactaagtttttaaacgtgatttcaaatggtgtgtttctgtttcacattggacataagtagattgcaaggctaatggaaagtagaaaagttaactcatgaacataaaagagacatcgatttgaaaacaaaacatttattcatttacttctgctgcagttttcttgactgctgaatttcgtaagaagggattggtcagggagggtcttggggctgaagacctggagaggagctggtgctatcgctgttcaaatctgaaggtggtggagatggagccttggggaggagccggtgctgccttttaagtctatgagagtcgttgagctggaggtccagggaagagctggtgctgccactgatgtcttaggttgtggagctgaagacagtgaaggagctggtttggctgttctgtgagggtcgtggagctggagatccaggtgggagaggtgttctagtttgagggtcatgcagatggagatctgtgaggagctgatgttattttaattggtgggtcgtagagctggagaccagggaggaactggtgtggttctagtttgagggttgtggagctggagacacagggaggagctgaggttctagtttgatggttgtgcagctgaagactcggggaggggctgaggttctagtttgagggccctacagctggagatccggagaggagctgatgttttagattgagggtcgtgcagctggagaaccagacaggagctgatgttatagattgagcattgtgcagctgaagactcggggatgagctgatgttgttcgctttgagggtctttcagctgaagactcggggaggagctgatgttctagattgagggtcatgcagctaaagacttggggaggagctgatcttctagtttgagggtcatgcagctgaagactcggggaggagctgatattctagtttgagggccctgcagctggagatacagataggagctgatgttgtagtttgagggtcttgcagttgaagattcagggaggaactgctcatgtagtttgagggtcatggaactggaaacccagagaggagctgatcttatagattgagggttctgcagctgaagactcggggagcagctgaggttctaacttgaggaacctacagctggagacctggagaggagctgatgttctaatttaagggtggtgcagcggaaaaatcgggggggggggagctgatgttgttcgcgttgagggtctttcagctggagactcggggaggagctgatgttctagattgagggtcatggagttggaggcctggagaggagctgatgttgtagtttgagcatcttgccagctgcaaacccggagagaagctgatgtagtttgagggtcttgcagctgcagacccagagaggaactgatgttctagattgaggatcatgcagctgaagactctgggaggagctgatgttctaacttgagggtcatgcagctgaagactcggggaggagctgatgttctagtttgagggtcttgcagctgcagacctggagaggagctgatgttctagattgagggtcgcacagctgaagacttggggagtagctgatgttgtttgcattgagtctttcagttggagactcagggaggagctgatgttctagatttagggtcatggaactggagacctggagagaagctgatgttctagtttgagggtcttgctgctgcagacccggagaggagctgatgttctagtttgaggatcttgcagctgcagacgtggagaagagctgatcttctagtttgagggtcgtgcagctgaagtctcggggatgagctgaggttctagtttgagggtcgtgcagcagaagactcggggaggagctgaggttctagtttgagggtcgtgcacctggagaactggacaggagctgatgttctagattgagcatcgtacagctgaagacttggggaggagcttatgttgttcactttgagggtctttcagctggagactcaggcaggagctgatgttctagtttgaggatctcgtagctgcagaatcagagaggagctgatgttctagattgaggatcttgtagctacagacccatagaggagctgatgatctagattcagggtcatgcagctgaagactcggggaggagctgatgttgtagtttgagggtcatgcagctgaagacttggtgaggagcttatgttgttcactttgagggtctttcagctggagactcaggcaggagctgatgttctagattgaggatcatggaggtgaaaacccggagaggagctgatgttctagtttgaatgtcttgcagctgcagacccagagaggagctgatgttctagtttgaggatcttgtagctgcagacccagagaggagctgatgttctagattgaggatcttgtagctacagacccgtagaggagctgatgttctagattgagggtcatgcagctgaagactcggggaggagctgatgttctagtttgagggtcgtgcagctgaagactcgggaaggagctgatgttctagattgagggtcatgcagctgaagactcggagaggagctgatgttctagtttgagggttgtgcagctgaagcctcagggaggagctgatgttctagtttgagggccctacagctggagaactggagaggagctgatgttctagtttgagtgtcttgcagctgcagacccatagaaaagctaatgttcagtttgaaggtcttgcagctgcagacccggagaggagctgatgttctagattttgagggtcctgcagctgaagactcggggaggagctgatgttctagtttgagggtcatgcagctgaagagccagggaggagctgatgttctagcttgagggacctacagctgaagacttggagagaagctgatgttctagtttaagggtgttgcagctgaagactcggggtggagcttatgttgtttgcattgaaagtctttcagctggatgttcagggaggagctgatgttctagattgagggtcttggagctggagacctagagaggagctgatgttctaatttgagtatcttgcagctgcaggcctggagaggagctgatgtagtttgaaggtcttgcagctgcagaccgggagaggagctgatgttctggattgaggatcttgcagctgaagactcggggaggagctgatgttctaagttgagggtcttgcaactgaagacttgaggaggagctgatgttctagcttgagggtcgttcagctgaagactcggggaggagctgttctggtttgagggtcgcgtagctgaatactccaggaggagctgatgttccaatttgagggtcatgcagctggagatctggcaggagctgatgttccagtttgagggccgggtagctgatgtaacagtttgaaggtcatgcaactggagacctgtgcgggggagaagatgttccagtttgagggccatgcagtttgagacccagcgggaagctgatgttccggtatgagggccatgaagctagagacctggttgggaggtgatgttccaggttgaggaccgtgcagctggagaccgggcgggagctgatgttccagtttgaggtccatgcagctggagacccaggagggagctgatgttccagtttcagggccgtgcagctggagacaccgcggggagctcatgttccagtttgagggccggggagctgatgtaccagtttgagggccatacaactggagacccgggggggagaagatattccagtttcagggccgtgcagctggagaccccgcgggaagctgatgttccagtctgagggtcttgcagctggagacccggggaggaatatcaaactcgaacatctgctccccacagtgtctccagctgcacagctctcaaactggaacatcggttcccatccgggtctccagctgcacagccctcaaactgcaacatcggctacccccgagtctccagctgcaagaccctcagactggaacatcagctccccaccaggtctccagctgcacagcccttaacctggaacagtttgaacctggtgggggagctgatgttgcaattggagggccgtgcagctggagacccagaggggagcagacgttctagttttagggccgtgaagctgtagactcaggaggaagctgatgttccagtttgagagctgtgcagctggagacccgggggggaactgatgctgcagtttgagggccatgcagctggatacccggctgggagctgatgttgcagtttgagggctgtgcgcctggagccctggggcggagctgatattccagtttgagggccgtgcagctggagacctgatgggagccgatgttccagtttgagggccatgcagctggagacccggcggggagctcatattccagtttgcaggccgtgcagctggagacctggtggggagctgatgttccagtttgagggccgtgcaactggagacccggcagggagctgatgttccagtttgagggccctgcagctggagacccatggggatctgatgttccagtttcaggttggtgcagctggcgacccgggtgggagctgatgttctagtttgagggccgtgcagctggcgacccgggggcgggctgatgttccagtttgaaggccgtgcatttggaaaccctggggtgagctgaatttccagtttgagagatgtgcagatggagacccagtgggggagctgatgttccagtttgagggcccagaagctgatgttccagtttgagggcccaggagctgatgttccagtttaaggctgtgcagctggagacccaggggtgagctgatgttctactttgagggctgtgcagcttgagacccggcgggtagctgatgttccagtttgagggccgtgcagctggagacccaggtgggagctgttgttctagttttagggccatgcagctggagacccggggagtggggggagctgatggtgcagtttgagggccatgcagctgaggacccaggggggagctgatgttctcctttgagtgctgtgcagctggagacccggggggagttgatgttccgtttgagggccgtgcagctggagacccaggtgggagctgatgttccggtttgagggtggtgcagctggcgacctgggcgggagctgatgttctagtttgaggactgtgcagctggagacccagcggggagctgatgttgcagtttgagggccatgcagctggagacccatgggggagctgatgttgttttgagagccgtgcagctggagatccgggggtgagctgatgttcccgtttgagggctgtgcagctggaggcctagcgaggagctaatgttcctgtttgaggtccttgcagctggagacctggggaggagctgatgttcttgtttgagggccttccagccggagacccggggatgtgctgatgttcccatttgagagctgtgcagctggagacccgtgggggagctgatgttccctttagaggaccgtgccactggagagcctgcggggatctgatgttccagtttcagggccatgcatcttgagactcggggaggtactgatgttcccgttggagagccgtgcagctggagacctggggaggagctgatgttcccgtttgagggccgtgcaggtggagacctggggaggagctgatgttgttctagtttgtgtgttgtgcagctgcagatccagggatgagatggtcctgcggttcaaatatgagggtcccggagctggagtctatgtgaggagccaatgctgcctctgatgtcttaggttgtggagctggaaactcgcggaggagtcggtattagtgtttctagttgagggttgtggatctggagatacagtggggagcagtgttctagtttgtgggtcgtggagctggagacccagggaggagctggtgtgtttctagttgagggtcatggagctggagacccacggaggagctggtatgttctagttgagggtcgtggagctggagatctggggaagagctggtgctgcggttcaagtctgagggtctcagagctggagcgcccgggaggagtaggtactgccactgatgtcttaggttttggagctggagacctgtggacaagccaggctggtgttctagtttgaggttcctggagctggaatcctggtcaggagccagtgatgctgtttaagtctgaagttcgtggagctaaacacggagccgatgttagggaagtagagagagagagtttcaggacgccacttgaaactgtacatgtagctgaatcccaagcaagttaagcctgggagcttctcagtcctcgggatcaatgcattcctttttctcttacacagtttggatttgttttctgtctaatgagacagaaagaccctgattaataccctcaggaattgaaaagcttaaaaaaaactaaatgatattggtataataataatagaaattaagctatgattatcctgacagacaaaatcacacaccacacacaatatacatcttttcaatcagttagtcaaataaaatataaattgaaaaatagacccatgcaaagctataaaaagttactttttttcttcatgttcaaaaatatttaattcacttcaaaatgtcatacaaattatggtggtttctatgcacccctaaagcttcagtcatttagctcaggtacatattaaagtaatatattaattcttccagtacaatggtgtttcataccattgacacttgcatactctagaataatttggaaagacgtgtaatattcgcaatgttcagaaaagcaagcaaaagttcaaggaacctgcttggttctgagatggcctcatatcagcttcataaacattcattctacaaaatagtaagctaacatttgaacacaatttccaaaaataaagaatattttctcataaataatgaagtctgtttctcaggcacctcagaagtatacaaaagaatttgagtttgaacagatctcttggaatgtgtttaacctggtatttcaacagacttaagatttctagggtttcacaaaggccagattttatttcagttactcagaagagaaagaaaatgtcttctgaaagaggtgaactcaatcactaccaatagaaaaagtatccactgtattcatctcttatggaaacagaaaaatataacatttccccccttaaaataatatatatattatatatatatatatatatacacatatgtatatataacttaaagttccattgtacgtagccggacaataaaatctggaaaccagcatgaaaccctgttattcacatgttaaaatgttgaaactatgaccaaaatgtgaaaactgctagagctatcagaaagagacaagacaaaaaccttctttcatatgtataaactaaatgtgataatctcaaaaaacttttcaaaattatgattaccttccagtttaaaaactttaatcctaaattaaaaaaaaaaaatctatacacaaaccactgatttgcccagaccaaaagaaagaaagaaagaaagatcagcggtaaggtaaacaggacccagaggagctgatattcacagttcttacgtgtacaactcttccaggaattatccataaagtactttattgttttacaacctgcttttcttgtaaaactaaacgtggacttttttacataaaagttttatacggcgttaaaaccagaactgtatgtaaaatactgcatctaaatgtttctaaatagtcttgttccattggttcatcggtgacttctgtggcttcgtcatcattttccatggatgattctgaaagaatctctccagttttactggaattagatcctactaattcttctgtttcacggcagtcagaagaaccactactttcagggccttcgttttcattaccttcggaatgtagtaaatctttctcagcttgagacacatcagattcctccatttgattattttcctcaaaagtctcttcattcacagttgaggcatcatcagattatttttcttgattttttctttccgggatcatttctcttgatgtcataaaagactctaaaaataagcaaatgttgttgtacttaaattttattttcagaatacctccacagttaagtttcatgaattctgatgttctataattcaaatcacattccctgaaattcagcaacaactacatacaggtgggagaaaagcccaatgtcggcattacaaggagttctattatgtacaattctttcacgaaagcaatgaatacaagaatttgaggatcttcttactcctcccttttacagatggtctctcaataccttcttcttcctcttcatcctcttctgtacgcgctgccgggtacaacggctttctttgtctttatcctgagatgaaggtgatgcttctgtttcttctaccataaccgaagaaatttcgctgcaagtcgcttgaatggctgtttctctgacttcgccttttttgtcaaacatgagtctttttacctcatgcccctcagcttccacagcatcttcatctggatgtttatttttcaaagggctcactgagcaaacttctgattcagatgtcgaagagtcactgtgatttttctcttcattttgctgcaaatttacctctttgctgtctgtgctgtcaggcgacccatttgttgtcatgggggctgacaaagaaacctttggtcgattacgtggtctgggtgtcccaggcccatttacattagacctctcaggatagcttggtgaatttccaggaaacataacaccattcattcgatttaaactattggaattgtttttctctgaagaaggataaacacagctaacaaccatcacatccttttctactcctctgagaaatttgtctgttcctgtatagtttctccttggatctgttaacaattcacatagtcgctgaatagtaaaagggatactgttaaatccagtgacaattctcagtattctttccttcatttcatcaaagggaatatattcgacattagggttgggaggacctcttggctcaggagctgaagttctgaaatcatccatcactttctccagtttgaaaataaaatagcctttaaattgggaccactgaatctgtttctccagtcttggctatatgacaaagaaactgatccaggacaggacaaacttcctttttcccctcttctcaaaatctttcagcgcctcctggagactctcaacgtccatggcttcctggagtccctcacagcctccgcctccctccgcaggtctcttggggaccggaatgcctccccccaccccccgacgtcctcccactccctcgcacacactcccgcatgcaggccaagttgggtggggggaacgaagggagccaggggaagcatgtgagagagtgagaccaacagagcgagcatctccccaagccactaccaccaaccctccaacatggcgcctggcacgtcaccctaaaaagttatttcttggagaagcaatggatgacagagattaatctgagagttactattagtggagaaacttagaacttaccatttttcctgtgaggtttcggcgctgatactgctattctgtgagttctggcaattgagtccgttcacacagcctggtgatgcagcaggtgtcacagaaggaccctgtcccagctggtcctgctccactgctatgatggtgtggcctctgatctctgaccgtgtcttgaggggagaccaggcccttgatcacaagcgtatccatggtgaggttccgtggatggaagctcatgaatgttccttcctgatgttcatctgccaccttgctattgaatgcatcttgtttataactgccttctaagtattgaatagaaataaagcatttgtacaggatgggtaaggtataaagaatattgacacattggacacagaggacctccaccaagtttagggagtagaatctcaagaaacataactgtggatgctccctggaggccctgcctgagtcccgggtcccttcccttctcctgcagagggaatcagttcctgctttagtctttattattcccacacttttcttcatagtacgtttctttcaccacgtatctgcacatccctaaaaaatatgccatttagtttttgaactttctgttttctttttgaggcagggtcttgctctgttgcctcggctgtagttttgaactttgatgtaaggaagttctcctgcgtggctgctcctgccctgcatggctctgagcatctgctctgtctatttctgtcctccattctctccctgagacccacccacactgacatggttcattttcattgctgcgtgatctcccgtctccattctctgcctgagacccacccacactgacatggttcattttcattgctgcgtgatctcccatctccattctctccctgagacccacccacactgacatggctcattttcattgctgcgtgatctcccgtctccattctctccctgagacccacccacactgacgtggctccttttcattactgcgtgatctcccgtctccattctctccctgagacccacccacactgacatggctcattttcattgctgcgtgatctcccgtctccattctctccctgagacccacccacactgacatggttcattttcattgctgcgtgatctcccatcgtctgaggggagcatgggaaatgtcttccatcttcctgtggatgagtgtttggccaggttggggccctgaggactgtgttttgttgggaacgttcttgggcgtttcttttgtacacaagtgcaagttgcttctggtcagtagctttcaagttttaaaatttcatcccaggtaagaaatgtaactttcctcataacccacaacatactctttcatatacaagcataacaaaaatagacttcacaaccgttcttagcagggcgtggtgttcctgcttctctccattctccccaacactggcatggattgggttgttggtggtgggatttttgcccatctggtgggtgtcacgtgatatctcccactgttaggctgagcccctcttcatgttttcattagccattcctccacatttcctcttctgtggagggccagttcagctcttttccccagtttctgttaagttgtttgaatttttgcacttttcttttattattcctattgttatgtttttgagacagagtctcactctgttgcccaggctggaatgcagtggtgtgatctcagctcactgcaacctccaccttctgggttcaagtgattctcctgcctcagcctcccaagtagctgggattacaggcgcccgccaccacccctggctaatttttgtatttttactagagatggggtttcaccatgttgtccagactggtctgaaactcctgacctcaggtgattctcccacctcagcctcccaaagtgctgggattacaggcatgagccaccatgcctggcctgcctttttctttttcaaaaggactctttatacctgttcattccggtgactatctgtatggcaaagatgggtttgaatccaccaggataaatgtgcaggatctcctctctggtgggagaagagacagagagggatagaagggtatggagaacagagccgagaggaggccgagtcaggcaggggtggcaggctgctgtgaggacttggctccgtctctgagtcgggtggggattagcagaggatttaaacagaggaaccatgggatctcccttatgcatttctgccatggttggctcagctgaacgcacctcttgaacaagacttggccttggacacctagaggcccttggttgagggtttacctcctggcgtggccactgacacatccacgtttggctcccacacagctgggcggccccaagacctgctctgcctgggcttctcattggtggcatttctcaagtttgtcccctctcaagtctgcaccatccggaaaaccaaacacctctctctcctacatggaaacccccatcagcacctccccctgactcacagggcatcccgtcaacatcacagtcccgactttcccatatggacaagcccacaggaccccctgatggaccaggacagcgccagcactaagacatgccctgaaactcacaggaagacctgatcaagaagacgggaacagcacagggcactgggagctgcaaacacccacgatactgtcagagatggagaaaggtatgacaggaagagcagatcaagaagacgggaacagcacgaggcactgggagctgcaaacgcctgcgataatgtcagagatggagaaaggtatgacaggaagagcagatcaagaagacgggaacagcacgaggcactgggagctgcaaacgcccgcgatactgtcagagatggagaaaggtatgacaggaagagcagatcaagaagacgggaacagcacgaggcactgggagctgcaaacgcccgcgatactgtcagagacggagaaaggtatgacaggaagagcagatcaagaagacgggaacagcacgaggcactgggagctgcaaacgcccgcgatactgtcagagacggagaaaggtatgacaggaagagcagatcaagaagacgggaacagcacgaggcactgggagctgcaaacgcccgcgatactgtcagagacggagaaaggtatgacaggaagagcagatcaagaagacgggaacagcacgaggcactgggagctgcaaacgcccgcgatactgtcagagacggagaaaggtatgacaggaagagcagatcaagaagacgggaacagcacgaggcactgggagctgcaaacgcccgcgatactgtcagagacggagaaaggtatgacaggaagagcagatcaagaagacgggaacagcacgaggcactgggagctgcaaacgcccgcgatactgtcagagacggagaaaggtatggccatggctgacacaaaatgttactcaacatttatcacaggcctaaatggagaacataacgctataaaacccttagataaaaacacaggaaaatttgtatggcctggggttgggcgaaaagttcttagacatgacaccaaaagcatgattcataaaagattgacaaattaaattgtcataaatttaaaattataatgctataaagcaatataaaaatctaaagagaatgaaacacaaaccatggtctagaaataaacatttgtgaatcacacgtctcacaacgtactggcacgcaggatatgtgaagaaccatcaaaacttaaccataagaaagtaaaagccccagtattaaagagagggcagatattggaacagaggcctcatcaaagaaggtataaggagggcatattgcccgagaaagaggctcaacgtcgtagagatgctggagaaatgccagtcaacagtacctctgcaaatctattaaaatggctaaaaacagacaaaaaccacaggccgacccaggttctagtgatgatgcagaggaactgggaccctcataagctgcagtgggaatgggaggggtcccgccatgctggaaagtggtccgggagtttcttacgaagttaagcacatccttaccctgtcatccagcaaccccgctcctgaaacgtcccccaagagaaaacttaaacgtgcatgcacaaacctgcacacaagtgtttaggcctcattcctcattgccaataactggaagaaaacaaaatgtccatcggcaggaggaggcgggaaccaacgcggatgcttccacacagggggcaccaaccagcagtggaaggatgcacccaaatgccccaggtctcccaggccacatgcccagtgaaggaagctagtttcggtgcgcacaggccgagggatgccgccacgtgacatcttggagaagacagtgctaccgtgttggggagcagggcagtggtttcgaggggctacgggtggaggggcgaatggaggagctctctggggcggtggcgtgagcacctgcacctcactgtgggctgctgcggctgaggggctgtacagcaaacactagcttcagtacacgcagactgaaggaggaaggctgccacaagtcaaagacagagggtgtcacctccatgaaacaaaaacatattaaaaaaaactcttaaaataaaaaaaccacaaaaagtatttcataagcgtattggactttgagttgacatcatctacctgggagcatggaactgaaaccacaggcttggcaatcccagagggagagagtggagggtttagacctccattgaagggctcagtacctggctataggaaataacatttaaaaagcggcagggtggaaataatttctgctgatgaggttgcatttctccagataaccggcagagtaaattaaagcaatatagtaaaacaatgcacatattgatggaatctcaggatcacaaggttgtggtgaaggaaatttgaagatgtccaggaaagaaagacaaatgagatgaatcttgcagctgcccttcaagggggcatgggccgggtggccatgattctccgtgatgttgcaggaattctggctgggtcctcaggagccttttttttcttgtccacattcaccttcggtgggtggtccctggtggtcatgaccgcactcagggcccggggcctgctgaggctgctctccctgttcccggaatgcaggggtttgttccagatcccgctgctctccacacagaaagccaatcactaagacgatagttactgccaatgaagaaggcatgcatcagaagctacaggccaggagatgggaggtcagcttcaaatccatcttcctgactgactatatagcagggaagaagtgtgactgtgtgtaaggaaaacaggaattagggagagtgaggaagaggagttggtcaggaggaggcaggtggctggtcaggcactcatgatgggtgaggggtttggcgtcttactgtccagatggcgtgatctggtgagtctctcttccttcacactacctgggaggcctgatggtcagtttcctaagaaaggaactcaaataagacaaatgtcactttctcaagttttaagaccaaaaggatccatttctatgttattcagagaaaccatgaacatcaattctctgggacaatcaggccagttcaacaccagatctgatcggccacgacacctgctgctcgaccctcagataaggcccagaatccagtgtcctctcccccaccccagcctggccccacacccacacctccccacttcaccctgggcctctgctctctcgccacagaggggtcagggagctgttcacgccccacgtgcacctgggcacgtggcatatttcagatgcacctggtgtcactgtttgcacagacctaagtgggaagagatccaaatgctcgttcactgcaggtggatgaggacatcccagcaagtccctcagtggagtcagccagtgcaaggcgagtgagggacccccagagacatgaatgggtctcagatagtgtgtgagtggatgaagcagcaaaaacacacgctgctaattaattgatttatgtcgagctcaaagtagtccacatcaaaaagactgtttggggctgcaggaattcagtggataattgcaggcaaggcaagggaaggtggaccagaaaggtgaggaggacgctcccttcgagggtggagagagtaagactggcattgcacatgggtgggggggcccgtcgaggcccctctttgcttctgagagtctgttttcatcgacagtcttctactaaatgtacatagcagcttttcagggcaagggtcaccgggattcgtctttatgcctccccagcccgggagccaccacctccaccagacccatccacacagttgaatctcatctcaagttctctggtgcccgaccccccacgcacaccgtgctggtctgggcatctcacctgcatccgcacaagtgcctcaggagggtggagtgtctggtgctcggcgctggaggctcagcccacactgtgccgggcagtcgcaggcctcccagatgaatgaagcatgaatgaatcccgatcctgttatcacagcttctccccacgcatcccaggcagaatgttgtgcaaaaaccacaccaggattcgtacatgccagaggactgaacttctgcgtgttgcagataattcatcttcctgaatcactgtggatctaccatgtggttaaccacggaataaacatgggggagagcgtaagcgctgtcctagcagaaacttatgcttcttccgttacccttaaaaagtaaagggtacggatttcataattgtgtttctcttgtaaatgagactctcatggaaaaatcagccatgtaggcgatagatttgtatacctttagattaaaatgtcacttcgattatttcaagtgtaaaagtgtttcagcttttttgaggtataattgctacacaaagagctgcacacatttcatgtgtgcactttggtgagacttgacctgagcaaacacccatgaaaccatcaccaaatcaaagcaatcgaggaattccacacttgctgggggcttccttgcacctgtgcccgtggtgagaacacagcacgagatcttccctctcagccaatcgcaaacggcccacaagaaaatgacaccaggcctcctggtgaacacacaccctgtgatttaattgttgatctttttaacctggggctcacattcttcattcagaatatggcaaagactttagaagtcatccaaagtatcagtaatttgaagtcctttaatacaaaaagtatagaatatgaccttttgtcacatagcaatagggaaatgaaaaaagaaaatcgacttatgttctttaatggctaggaaaatattcttaaaaagagatctcaagcacaggtgaatctaacaaatgacaaatttatttctttacatagataaatataaggttagatccacgtaaataaatgaagccattaagggtagagtcccacagaccacagcgtccagctctgctatcgatatcagggagtaatttccaggcacacagaactgacccagcatccagctctgctcatgatttcaggggtaattcccaggcacgggtcgagctggagaagctgggggcccccatagccccactgtccttcctgcctcatggggtctctgaggggtgcctggaacatttcctcttgggctttgaagatcatttcacttaaacacattttccaggtgccatggacctgagcccagaaacttcacggtaccaggaccacccgagacagtggctccccaggagtgagcaccaggcactgtcaggggttctctccccagcacatttacaaggacatgatgggttcttcttcctgcagagcaatcccagtgggaagaaggaggggacgggaggcctggcaaactctcctccccagctccgttccaagctctgtggggctccggcaggccccatgtcatgtgcagatgagggattagggttcctcccggcctcgctgctctcaggccctcaagggctcctctcaccacccccgtgcagccagcggaccctgcccccacccagctgctccccccagctgctcccactcagctgctcccactcagctgctcccactcagctgctcccactcagctgctcccacccagctgctcccacccagctgctccccccagctgctcacccccaactgctcccccccagctgctcccccccagctgctcccccagctgctcccccctagctgctcccccccagctgctcccccgcagctgctccccccagctgctcccccagctgctcccactcagctgttctcacccagctgctctcacccagctgttccccccagctgctccccctcagctactcccacccagctgctccccactagctgctccccccagctactcccacccagctgctccccactagctgctcctccccagctgctcccccccagccgctccccccagctgctccccccagctgctcccccccagctgttctcacccagctgctcccccccagctgctcccccccagctgctcccccccagctgctctcacccagctgctcccccccaactgctccccccagctgttctcacccagttgctccccacaagctgttccccccagctgctccccccagctgttccccctccgctgctcccccccagctgttcccccccagctgttctcaggtttctcatccttcctggatgacgccctacctggggcacccgttcctgtggcatccccagtcctgcactgcagcactcaaaccccgtcacctccctggcgagaccatgctggaaccgtgatcagcccatcggtttcatccattatcctcctagcccaatttctgtgctgatctctcgttcccaaaacatcttggaattataagaaattaacttttttcaagtctctgtgcttctgaagctgtacttttaagaaataattcttacgttcttttgaaggttttttttttttctttaagacagagtctcactttgtcgcccaggctggagtccagtggtgcaatctcagctcactgcaagctccacctcccgggttcacgccattctcctgcctcagccccccgagtagctgggactacaggcacacgccgccatgcctggctaattttttgtatttttagtagagatggggtttcaccatattagccaggatggtctcgatctcctcacctggtgatccgcccgccttggcctcccaaagtgctgggattacaggcgccagccaccgcgcccagctggtatttttttttttatttttttatcaaatacagttgaggctctcttggagatcacatattaaagagaactgagaaaaatcagacctcagaagcagtacagtgccctgtaaagtacatgtccagtcccatcactgtccttctctcacatgggcccagggatgtgggtgatggtatttattgcccctggtgatggagcagatttgatctgcctatgtgggaaggggttaactcagcgggtgtggattgctcaaaccctgcacgttcccaggaggggcccttggctggctcctgggagctgagctcctgcagtgttctgactgatgagagagacttgagccatgttgcactactttgcctgggtagttgaccaacaaggtgatggatggcaaacacctgctttcgctgtgggtggctggaacttccctgactgacccccaggttcaggagagcctccctggtccgcaccacggcactagctgtcccagcttcttgctggaggaatccggcgcaccctgtgtgactccgctgggagggactctggaagcgcctggcttccctggcagccctttcccttggctggtttactctgtaccctttcaagttggagggtggtctcagggacccccatgcagtctttcgtgctttcaccagaaactcaccttggcagggcttcaggggaaggcttgggatttggtgacaagtgactccatggccttgggcaaagcacagcatctacttaggttttcaggcggttgcccaggtatgtctagcacctaatgtaaccgaggcgtgaaatgcctgtgcgccacggtgcttcagctcgttacgggccgttaggccttgtggtggttctctcttggtttctgtggagaagccagaccccgctgtggttggcaaggaaggcgagtggagacatcaggagtgtccatccctcagcggccctttctagtggggtggctgcctctctcatccttgattaatcccgggacaacctctgctctcctgggcaatccttagaatactccagaagaccccagtatggccgtccggttcctcctgggccccagctctcaggaatgcaccatcacggcacactccatgcgtgcccgtccagatggcacctgagcctccctgtgcctgcgctgcggcgttaacatctcgcttgtgttttaacctgtgttgctttggtttaaaacttgtttgaccgtgttatttgctgagatggcccagagaagcttctgcttatgatcaggacacgtcacagtgcagccttcacttgaggacttaggtctcatccagctccacacagtcaatccagggccacggacgcagaagacagaggagaagaagctcatggcatgaagacagaggattgattgcccaggaggcttccaggggctttggctcctggggcttctgtcagcgctgggtcagagcaggtcacccttgtgtgcagacactaggttgccgcacacagcggtgaagaacgggggagaccagatggaattgggtgaggcagggatgctccttggtgtttagagttttcctctttctttgccttgtgggttttctgtagcctatctttgctttttgtaacactagttttcagtaattccgacctttctgaatacctctatatacatatacctgtctactctcctttcagatacttgtaaagcctacagaaaggtaatcctgcagattatcactctattcagcttaacagatgctcgtcgagtgctgctgtgtgtgtatgcctcaggttcaggtgcacctgcctttgtggggagagcacagcttccctgcataactgctggagggtgggtcgtcgagtgctgctgtgtgtgtgggcctcaggttcaggtgcacctgcctttgtggggagagcacagcttccctgcataactgctggagggtgggtcgtggagtgctgctctgtgtgtatgcctcgggttcaggtgcacctgcctttgtgggaagagcacagcttctctgcataactgctggagggtgggtcgtccagtgctgctgtgtgtgtatgcctcaggttcaggtgcacctgcctttgtgggaagagcacagcttccctgcataactgctggagggcgggtcatcgagtgctgctgtgtgtgtatgcctcgggttcaggtgcacctgcctttgtgggaagagcacagcttccctgcataactgctggagggcggatcattgagtgctgctctgtgtgtgtgtgtgtgtgtgtgtgtgtgtgtgtgtgtgccttgggttcaggtgcacctgcctttgtgggaatagcacagcttccctgcataactgctggagggcgggtcgtggagtgctgctgtgtgtgtgtgtgtgtgtgtatgcctcgggttcaggtgcacctgcctttgtggtaagagcacagcttccctgcataactgctggagggcgggtcatcgagtgctgctgtgtgtgtgggcctcaggttcaggtgcacctgcctttgtgggaagggcacagcttccctgcataactgctggagggtgggtcgtggagtgctgctctgtgtgtatgcctcaggttcaggtgcacctgcctttgtggggagagcacagcttccctgcataactgctggagggcgggtcatggagtgctgctgctgtgtgtgtgtgtgtgtgtgtgtatgcctcgggttcaggtgcacctgccttagtggggagagcacagcttccctgcataactgctggagggcgggtcatcgagtgctgctctgtgtgtatgccatgggttcaggtgcacctgcctttgtgggaagagcacagcttccccgcataactgctggagggtgggtcatcgagtgctgctgtgtgtgtgggccacgggttcaggtgcacctgcctttgtggggagagcacagcttccctgcataactgctggagggtgggtcatcgagtgctgtgtgtgtgggccacaggttcaggtgcacctgcctttgtggggagagcacagcttccctgcataactgctggagggcggatcattgagtgctgctctgtgtgtatgcctcaggttcaggtgcacctgcctttgtgggaagagcacagcttccctgcataactgctggagggcgggatcttcccaaggggaagttgggaggtgctcaggcggagcaaatggatttaacttctgggctgggagaatgtggtacccccgtggaagtctccctgaggaaggaaaggaaggagctggagggagggtgtgtgtgtcttaggaggggacgcacttcaggtgagagcgggcatggcactaggaggagccccatgagcccagagtggtggcacgtagaggcctaagggaccatgccagcagaccccaccgcccgtgctccaccaggagcctgacattgttctctgagatcagggggctgtctctgtgtactgcccaggactgtggcatttttgtgcataaaaaaaaaaaaaaactgtgtgtctaacacagacggggtatgaggagagccactggtctctcctgaccttaaaaatatttttttagttcatttttagtgagtatggaaattactgaaggtacaaatcactctgaagataggttcttgtgtgcgaaggtcatcagtgaatcttcattctcagagttgataaatggttgtgagcgctcaagggtatcagattcaacgatgagtctgaggatagtacagctttcctattcagtttcaaggaaaatcatataaagcccagaccgtaatttgtcaggaatgtttgaagtgtggtgtgatggatgtcttcaccgtgctttaggatgattactgagggagaacggaaggaaggggtctggtacttgcacctttcagtagaattagtgtgaatgccacagcgaccaagctatgttcaggtgtctgcaggcagtggtggccttgatgatggattttctgaaatgggaattcgtgaagtcctctaacaaaactaagtgcgaacttctcaacttagctggtgactgcatccttgaaaaattctgtgtgtaaaatgatacagaaccatttcttggttatctgttaaataagagtgcatgtccagccgcgatgactgtggacggccttggaggtctgggaggccacgaaggactcccacacacagcagggtgtgaacccaccaggcagtgctttggccccctcccaggagtcatggcagccgacacgtcacctggagtgtctagaaaaccactaccttagagcccccactgcttttcctggtgcctccaggtatagatcacaaactcagtgtcccagaaagattttccttttactttaactcctgttgttgtttgttttcaggcacgtggactccctttaatccagtgactgtcaggtcgatcatatgtaagtatcggcagacggaccaacctgggctgctttgtatccgacccgcttgggtacccgcttgtgtttcctttgtctgtgggtccgtatcactttgctcccttctggaattccacttagatgagcgtcggccctttcatccctctccctccgtctctgtaccttttcacatctctccgtgtatgtttgctctattcttgattctgtttatttttaatgtacggtgtaacctgtcctttcagtttctaattctaaagatgacatatatttaaaatttctaaattattagttactttcacatcttatctgggtgtttttgatagacattgcttatttatttttgtgattccattctttattcaaatatttcatatgatagtcttcagttttaagaacatgcttttttgaaaagcgctagatatttgtgacatggagctccttgactgtgtttgaagtccttgggagggtggtctacagccagatatttttcctgctcaagcccacacagagtgaccaacttccttgatgcttctgtaatttttgtttgttttgtgggttcatgtgtagccttaatgtgagggtctgcatcatttctttgggtccagggtctccccagctgtataggcagctgggtttttgtttgtttcttttaagagacagggtgtccctgtgctgcccaggcctggtctggaattcctgggctcacgcaatcctcctgcctcagcctcccaaaaagtggggattacaggtgtgcacccccatgcccagacggtagccggggtgtgagctgaggctccaggcgcaggcaggtgttcaggagagtcgtgctgtgtctccatcccccgtagccaggtgggagctgcagctccaggggcaggcaggcctgggaggcaggtgttcaggagagtcatgtttccatccctacccgacttgatttctggaaggttccctttgctgggaggtgcagcccccttcagacctctttaatatggaatcccaggttcagttctgcctcacagggaccatggcattgtgtctcgaggtttcccagagcggcctggggctcattccctcgcctcccatccatgcacgtgttttagtcttgtgaggattccctgagttccttgcggagcctgtgtgtggtgaggtgtctgagtcctagtgtgggtgtagctgggggcttttccagatgactgtgccctgctggtcgtgcatatgttgctacgtcacactgatggagggagagaaaacttggaagtgtagtagtggcagggctcagcctttagtgctagaaaaggtgttgatacatggggagctacctccccaccggagaggaatggcctgggagccactcctctgcggagcccttaccctggggtgcagctcacccagcatccttccctgctggtgtgtggtgcgcagtgggtcctgcacgcaacagcatcgtccacacacactgcacacatcgtggaatggtcgtatgaaaaacagcccctggtccacacaccacacacgtcgtggaacggtgcacgtcgtggaacggttgtgtgaaaaacagccactggttgcacacagggttgtggactgttgggaagaaacatcgatgctgtttctcacatgatttttcatcctgtggattttcatttaattgtaacatatttctgatcaaaccaggagtagtcttattgcagtcctgtattaacctctgttcttgaaaagagaccacgtgatttatcattttctctgcagcagtaattcacactgaatttttctatgttttttagccatattgcaactacatataaaggtagttatagattcttttgtatttggacctggagttagactgaaagcaaataggacataggcgagggtctgtttctaattaaagcaggttttcctgacagggctgttccaagactccaccagtgctgtgggccctggagagtcagagggtcagctctgggaattagattcgcgttctaggccgagacccaggagccaggggagctggggccacttaccttccccgtgcctcggaagctgagtgtgaagctctgctcttctttctgtcgtggctgcggctggatttcctcacacatcccattgcacggcctgcctcacagctgcaagtgcaccttctcctgggacttagggggtcagggctgggggacaatcccccacacccccacccagggcgaaggtgacaagactttaagggatttcaccccattcacagacaggcatgcattgcccagtccctggttagtggtcagcagtggggccccgccaggctctgagggctgaggtctggtgggaagcctcaagtgagtttgctgcaactgatcttttgctgcttgaccgttcctctctgtctcagccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggtaactcactcactctggcttgtgtagcgtgtttcattttggaaccttggagccgttgaagttctttaaaccttgttggacttaactgattgtctaaccaggctacgtaaagtttttgttgacgtcatgcaggttcatatttgatattgctcatgtcggaaggcgatcctcgacatggatacgtttattcaggtttttatccaaaatgagataagggctatgcaagccgttcatcttttctgaagtggaatgatgtcgtgagcaaaactgagaatgtggcttttgaaatcatttaaaagtggatccatgaaaataccgtggggcagggcagcttatatttcatgatagatcaaagcacgttgaaaaggcaacagtcacctaagaaacagctgtcagtcaccaggtccaaaccgtgcgcctcagaaggggcgttaggcagaacgcgtgcccattctcaggtgtgctcggcgtgtgtgtgctcggcgtgtgtgtgctcggcgtgtgtgtgcacacgtgtgccgtgcgcctcagaaggggcgttaggcagaacgcgtgcccattctcaggtgtgctcggcgtgtgtgtgctcggcgtgtgtgtgcacacgtgtgccgtgcgcctcagaaggggcgttaggcagaacgcgtgcccattctcaggtgcgctcagcgtgtgtgtgcttgacgcgtgtgcacacacacatgtgacggtgtgccgtgggtctaggagtgttcacagtgcctgtccagagtgcgtccatagggcctgtccacggggcttcccgtgctgctctcagggctgagaggaagcaggggttttatttacagaggaacaacgggcatgtttggggccagcctgaggctgttggtggctgcaccgagattctaatccatgcggatctcatctggcccctgttgtgaagccgcttccgtgatttgcttaaaaggctccttagaaacagtgaggaaaattcgattctacttgagtacctccgagatccctggagtctcacttatctaagcacgtcgcctctcctcgtgtttcctcccagcatgcactttgtggctgcctttctttctcttttctttctcaccttacgagcttgtccacagggccgggggtggacactgggtctcctcaagaagcagttctgagctgaccagctgcgagccaggatttgggctggatggctctgaattggtacttggaatgcagctgaccttgctgtgcccttgggtgggggaactggagggaacgctggccggctcctcttccctggggcaggtacggaagggctgggagggaaggatgccaccctccacagagagtggtcctgggggccagggaggccagtgctgccgattgcggccagggccacgtggacttcaggaccggcctgaagttatttttagataagcgacctctggcgccacggacatcttttcctaaccttgtcaggccctggagctccctttgtccatgccagtgaccatcggtcctcagaatgtgcagtggaagttgctgtggacagtgctccctggtctctgaggccctcttcgtcctggtctggccaaggacttcccagaaaactgtgcttagctgtggcgggaggcacggccggtcacgcagccttcctcccgccctggagtgggcaggcctgcttgtgttgtgcagcggcagaacccttcctgacttccaggtttttcctggggtgcggcatcccatcgcagcattttctctggttaccctcacgagtttcctcctgcgtttggttcttgatctccagggccatctcccacgtcttccttggaaaggggcattgtcatcctttttgtattttgatgattttgaaagatttcccatagtaactgttaggaagttggcctcagaagcaaaaattcttcttttgtcttggcccctgtgaacaagtgttctgctctcagatgaagcagggaggctgcactggagcttggtggccagcaggagggaatcaccagggtggtgaagcctgcgagatttctccccgggtgtctctgatggggccacatggtggatttcataatccaccgattcgtttttttaagcctttattgttaacatcaactgtgtgccatgctcagagacctgaagtgaaaaggtgaggaaggcgtgctcacattccagcactcaccacccggcaccgggacagctgactcagcacgtgccgtttaggttgctgtaaacagccggtgagattctcccctctggtgggcagtgcgtgtctgacaaaggcagtcgggcggagaacagttcctccgctgtggtcctttgccactgtaccaggcccccaagagctggggggagccccagggagcctcagcctgttgagtgggggcagctggtttgtcctccgaggtggaagaggtgatttctgaggaggtcatgctccgcttggctcgttcacagcatttcagagagtccgaaagaggagaaagaccttggcaaggggtgtgtcaggggtgggcccagggacgctggtggcctcatgtggactgactttcatgaacagaaactcagaaacagttgcttctggattttggcttctcagataaacattctttttgtagttcgtttgttcatccctcattttgctgtctgactttgcctttcttttcccttcactattactgatgaccaaggaaactggaagttaattccagaggcagtggggttgctcctgttgtctgtgcagactggagttcctctgcctctgtcagcatctcctctgtccttccccagccttggcaggagaccagtaatgacctctgtccccgtgcaccccagtgatggccgccgtccccgtgcaccccagtgatggccgccgtccccgtgcacaccagtgagggccgccgtccccgtgcacaccagtgagggccgccgtccccgtgcaccccagtgagggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcaccccagtgatggccgccgtccccgtgcacaccagtgatggccgccgtgcccgtgcaccccagtgatggccgccgtccccgtgcacaccagtgatggcctctgtcccccatgcactcccagacaggcaatgtccctgtgggcctgtcccaggctctgttctcagcaggctgggctcagccctggtgcagggagtgaggaggtgggagtagtagggaccagaaaaagtggcagctgttgacaactctgccatctctttctgaatgtaatgggaggtcctgtcttttcagcttgcaaggaaggagggtccgaggcaactccgctgttgcacatttagggacccctgaacttaaatgacagaatgccctgaccactctggaaggcactgtgttcatgtttgtgtgcttgactcttgatccgtaaaatggctgtttgtgcaggtcattaactgtgagattcagagagtaggtgcacacgtccctgcagagattccagcaggactgaaaaccagtagaaatatatcagcacctggatcttgcctcctgagtcagtaaggatatgccacagtcacgaaggcagtgggatttcgagggagggaagggaaggcggcaggcggggcatgccctccggggtgcccgaacacacctgctgcatccacatgtcttcagagccctctccctgtgggaggcctttttcaggacagccttggtgaactggaaacggaatcccagcccttggtggccctgcagtgacttggacctttccgaggtcaccctgccactgcgtgcccttcagtccctcctggcaggtgggggcacatcccccagccactcccatttcctgacattgtcactttgtataactggaagccttctgtgaaattttagttttcaaagcattatctggtgatgggcaacccagggcagcgaatcattcagaattttcttatctaggctaataaacataataaaatcaataaggactttgaaagtaactccactgggttcaggaaactgagtgtggccgccctgtggggtggtgtttggtgagtgcttcccggaggtgagtagttaattcacaggagtgactaatggcagcgtcccactcactcctccttccggggtcatggtctcaaggggtcactccatgcactggggatgtcagctcattacagaatgatatattcgggaagtgtctcagttctgagtgcctttgagggaatttgcacttccgttcccacacagccttgcattgtgtgtgttagaggctgtgggccttgggcaggaggggtgagtgttggcacatacctcccgtctctcccagccttctctgactctgactttccctcttgaaggctaccggctctctgaccagttccacgacatcctcattcgaaagtttgacaggcagggacgggggcagattgccttcgacgacttcatccagggctgcatcgtcctgcaggtgacggaatggcttcacgtgggtttgtggtggtggtgggaggggcttgcttgccagcgtgatgcacctgaccttcaatctaaggagctgggcatgtgtagaattagtttttggagcttataaaagtgagtctcatctttggagaagtagccggttagtgaagtgtggacaaacatgttttcctccccttggaaatggcacagagcagcccatctgcaagacgtggtttttcagtatccggtgggttatttacatgtatgttctggtgttgtggttttttttgttttttgttttgttttgttttgttttgagaccgagtctcgctctgtcacccagacgggagtgcagtggcacgatcccggctcactcccacctctgcgtcccgggtttaagcaattctcctgcctcagcctccccagtagctgggattacaggtgacacccagctaatttttgtatttttagtagagacgggattttgccatgttggccaggctgatctcaaactcctgacctcaagtaatccgcccaccttagcctcccaaagtgctaggattacagacatgagccaccatgcctggccaactatggtgtatttttacaaaaacttttattctgagaaaatgggcacgttttctgttgtggtcatcactgtgtcctgccgtctgtgtgtgaggtcagctgtggagcctgtggtcgctcaggccgccctcagtggggtctccgagctcttcccgtgcactccagtgtctgcaggagctggtaatgcaccctgacctgcaaggcaagctccttggtggtgtctctcctgctgggctctctttgagacccacgggagatggagagcagggctcaggggacccgcctgggagctccacacagacctctgctgctgtttgcaggtggtgatccaggtctctacccaggttcctcaaggtcctgtcttgttggccttggaattcagtgagagataggaacagcatggggtttttagaaataatgtggaaatttggaaaacgttcccaaattgtttattctgtataataattaagatgctagatctgtaaaagtgagtttcctctgatttggcatggatgcatcagtccctgttcttcagggatttgttggagaaccaggtctgtgaacatggaagcttcaaaactctacggttggggaccctttcctgcccctgcctctcggggttcctgccaggttggatgacatttttacaatgttctctgaacactttcaaaaaagtgtaggctgggcctggtgtcgcatgcctgtagtcccagctactcaggaggctgaggcaggagaatcacttgaacccgggaggtggaggtttcagtgagccgagatcacaccactgcactccagcctgggtgacagagccagaccctgtcttaaaaaagaaagaaaagaaaaagggaaaagatgccgtgtaaaatctcgttctgtgtctgaattgccgtagggctcagatcttcatttgaggttctgtgtctgaattgccgtagggctcagatcttcatttgaggttatgttctataagttaacgttgatcttgtgtgagctttcggtagctggagtaacacaggcggcctcacagcgacctctccagcgccttccaaggcacatctgcagccagcgtagctcctcctgggagatgcctcctcaaggccctgctccagaccacgtggggagggcctgacagccaattcccaggctgtccccacccttggagagtgaccctaaacgctagacagatggggaatgggaaagaaaagaaagctgcagacctcaagttaaaattccctcaaaaacgtttttatttatctgctttttctgaaaggataaaggctttttgaaaattattttctaacaaataacatgaacacttctagaaaccctagaaaaacacaaagtattcaaaatagaaagaaaaattacccattactctttaagccagcattatccattgcggtgcttttggagttgggtgaggccgtagcctctgccaagtcaaggagcccggtggtggctgtggcattcctgcagggttgtttttttttctttgagatggagtctcactcttgtcaccccagctggaatgtggtggtgtaaacagctcactgcagccttgaccctgaggctcaagcgatccttctgccttggcctcctgagtagctgggatcccaggcgagagtcaccacaccctgtccatgttcctgcaggtcttgatgtgcgaggacgctgtgtcttccctgccacattttcttcttctttcttgagacagacccttgctccatcacccaggccagagtgtggtggtgcgaacacggctcactgcagcctcgaccctcaggctcaagcgatcctcacgcctcggacccccaaagtgctgggatcacaggcgagagtcaccatgctggcctgaatcttcagggtattttacggttgaagtgtcacttacttaaccatccctgtttcaggagtgtaggtggtcaccctgtctctgccgctgacctggcctggaccctcggctgtgagagggaggggtgggctgggctggaggaacctgaagccctcgtgatgtcacaagcccatctggctgggcatcccctgcgctgcacatgccccaggtggcccccacagcagaggcgagccactggagggtggagggcttccacgggacggtcttcagggggagaaggaagggcccaggcccccaggagactcaggagaccagagcctggggtcaggggctcagccaggggctcagccagggctggatgtccggagccagccccgcagccctgtgttcttcgttcttcgcactcccaccgtccgtgtgaacagctccagccccacctgcgcctccctgtgctgggctccatcagggagcccagaagacgtgtgtgcttctgaaattgggtccctacatgcctttgtcccagtgcaccttgctccttccatttactatcgagatttaaatgcctgttttctccccagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgtggtctgccttcagcttttcaaatcaaataggtccaagaaccaggccccgtgccctggtcctccagacagtcagtgtcagatgttctggcttgcctgggacctcccagggtaccgggcaccttctggaacattgtccagcccagcgtgcacagctctgcttgtgaaaatccagagggactgtctcaccctctgttcaggaggttaaatttcataagactgctccttttggatgaagaaatccaatttggtatagcaggttgtgcatttccatcattaatgatttagccatgctgtgccctgcagtctctgcacgtggcctgcagcgtttgtccacccagcgcatcctgctcacctcggtccactgccagcgctgcccggtccgcctccctgcctcactgtgcagcgccggccctcctgggttgacactcccgaggcccagcctcattctccagacgcttcccttccacagtgatgcgtctggttttggggctgcagcctctggtctcagaaagcctgctccttccacccagttgtgcacgacttttctctgttcgttttggtctcttgggatctgttcaaacctctgctcggtgtgttgaggggtgaggggcagggagcatggtttcctggaaaaagcccccagtctcttaagctgggcaggtgtgctgtggggggtggggactggggctgcttctgtgctccagatgagacctcccccactgcccaactgcacttggcctggggccctctggatacgaatccctctggagcaggcactccaggctccctggggatgggagggggagggatgtgggcttgggggtctggctgctccctcatgacctcagtcatggggatcccagggcagtctctgaggatccccagcaatccacgccgggtgcctccctagaccttgacacccccatgactctgcagcagatgaccccaagttctactccatgaggtcaacttccttgtccaggccgcaagctcccaattccatgaggccttcctcacccaggcctccacggccaggcgcccagcgacttctccctcgcctcatgggcacctggactcagtgtccagtagctgcacccaccccaccctgggagctgccctcactcctccttcagccttaggcctgtgaggtctctgtgcttggggtgagggcagctgctgcggccaccctgcagccctcccagccacgtctccaggcccttgcccgtgctgtcccctgtgcagtgggcaacccccaccccacacctgcagcttctctggcctctggattcctacctgggtcagggaagcctgctactctggaggagctgtcagccctggtgagacacctgcccccagcacatgtctccatggatgatacgggccaacagttgataccaaggccgatgtgctcatcctgtggatcagctgccggggaaggaatgttgtgtgtggcggttagctccatactcctagaaagcaggcgaaggccaggtgagacggagactttcatagagaaaaggtcagattgtggatgattttccttccttccttttcacagcaatgagaggttcctctgatggagataaagtgtgtttctcaggtctctggtatgctcaggtgtggcaggttcacaggtgtgaggtacactcaggtgtgtggtgcaggtaccctcaggtactctgcacgtggctgccatgggggctcctgtttgcaggcagctcggggaggctgccttggagaggggcctccatgaagactcacaagaacaaaagccgctgaaaattccagagcagaagttcttcagcagagggtgaggagggcggtggggccgctgcaccacacgcttggaggaccagcaggggtagagcgctggacaaacgcatgtcaggccggcctgctggcaaaggaacccctggatgcagagagcctgttgggctggtgggctgtggctgttgggagggacatttccccggggagctcccagccatcagaagtcaagggagggaggcggtgaggagcctctcgaagcagaaggtgtggaggggggactcccctgctctcctggccggagtcactgatacaaaactgggggtccctggagggcagtgagctcacgagttgtggtggattccttgtggagggggtgccaacccgcagggaagcagggctgccgtgccccctgcccagccacactgccagcacagaccccatcctcaggcgcctgcagggaggccacccacgccttcctgggtgagggaagcccctgagctaaacctcactgcactctgaggccccaagggccaggcagctgcacacagcctgggccacgtgggggcagtgcggctgcaccacggagctctcgggagctgctgactgaccgggaggacctgcccgacacagccatgggatttatagccgcagagagaagactacagagagacgggccttcgccctttcagctctcccttgtcaggcaggctgtgccctgtgacccttcagagcctgggtttgggggtggagggggtggacagctgaccaggtgcctggcgcaggcccagtgtggtgaggctgggtcgcggaggccaggccaggccagcggccacgaccacccaccagggaccctcagcgtcacgaccccggtcccaagacccaagacagcaggacatgggggcacagccatctctgggggcctctccttccccccgctctgggtcctcagtcatcagtgcagacatggaggtgcaggtgcacgccgtacaccctcacctggggcccctggcccatgcctccccaccctccctaccctgatctccccccacaaccctacacctccccggacaaccctgcacctcccccaacagccaccctgcacctccccgccacaaccctgcacctcccccaacaacccttcaactcccctctcaccttgcacctgcccctcaccctgcacctccccccatcctgtacctccccccttcaccctccacctactcccaaccctgcatctccccccaaccctgcacctccccacatccttcacctccctcctcacctggcacctccccccatcctttccctcccccaatccttcacctcccccctcccttcatctcccccctcaccctccacctcccccccgcaccctgcacctcccacccttaccctgcacctctccccatcttttacctccctcccaccctgcatctccccccaaccctgcacctccccccatcctttatttccccccaccctgcatctccccccaaccctgcacctccccccatcctttacctccccccaccctgcatctccccccaaccctgcacctcccccaatccttcacctcccccctcaccctccacctccccccctcaccctgcggcaagcagagagctgactccagcacagtgaacttggaatgatggaatgcaccctggaagcagctctgacgggcgccaccgtgactgtgcccagcagggagctcccttgtggtttttaacaaaagacaaaattccccaggtccttctctgtgctacaggagaaactggtgtgggagagggaacccaggcgtgaccagggagaaactggtgtgggagagagagggaacccaggcgtgaccagggctgcccaagcggctccctgtgaggcatcaacgctggagacacagcagtcatggggaacccggggaacccgggaaacccagccgccatcagagagccagagagccgcaggcgcctgtgcggggtcctggcctggcccgaggggtcagcacacccctgtctgcctctgaggtcagggccctgggggctcctgacctggcctgcctgtgggaggcaaaggtgtggccaggagaggacaggagggggcagtcacagtcaccactcctggaggcccatgaagagcagctttgcccccacacttctgtgaagccaacttgggcctgtttgggaggggcctggcgctgcagccggccgtgggcacctgccatgtggcggtccactggaggccaagtccagctcatatggctctggggacccaccgcaccagactccagtgtgggggtacccggagctgggggtgggtcctcggaggcttccagtcctgccccagctgccatccctgccaggtgttagcgcctctggttcagagtcccgagaggaccagtggcccaggagaaaggggtgtgtctccagctgctgggagtgtgggtgggagccagagggttcaatgacactggggacagcaagtccggactggagggaggagacctcctgaacagggtccccagcacagaggcagaaaggagactctgtgactgggggtgtcagctgcatctggaccttcgtggtggggagggaggcacgcccaatagcccgtctgaacgggaggtggctcagggatcccccattgtgctggtggggtgcccagagactccaggactccacgtggggctctgcctgctaaaccctgagactttaggggcagtggctcccacggcagggtcatcctttttctgcacagtcccactggctgccccaggtcctgcagagacctgagactttggggacaagcacaggggacaggtgggcgtggatggcctgtgccggtcaagggcagtgggaaggaaggaggagcagtttccttctgtacccaggaaatagagtaacaaagtgtctcattccagttggttctggtgggacagggtaggtggaagggaacccgtgcttgccctgagacatgggggtgctgtcttcccatgcagggggactgcggctcaccaccatcacattctacccacaggttcttattttaacagatcacaaaggtactatgtgcttcttgcaaaaatttacaggaattgtagacttttcaaaaagtaaaaagaaattaaagttcacctgttacctcagagttatccagctacacattttctgtgcataattcactttacaaaaattggatcaagataaaactaatgatttttaaaaatacagcaatatagttgcacattgttccatatcaaaaaataaatgtgtgcacccagggctcctggctgtctcagtggcatagtggctcatgcctgtaatcccaacactttggcaagccgaggtgggtggatcacctgaggtcaggagttcgagaccagcctggccaagatggcaaaaccactatctacttaaaaaaaaaaaaaaattagccaggtgtggtggcgcgcgactgtaatcccagctacttgggaggctgaggcacgagaatcgcttgagccctggaggcagaggctgcagtgaactgagatcgcaccactgctctcaggcctgggtgacaaagcaagactctgtcccaaaaaagcccatttactcagctcacatttttgagcctctgctattcgacaggaaccagaggtgagcagagccgacttggtgacccctggggacagagcggcagaactcagcaattctgggctgccctgcaggagctacacccggggaggggcggtggccacttgggggcagggtgggcttctcagctgcgcccaccccaccttgggagctgtgtctggaaaagagacttttcctgagccgacagcagacagcgagtgcaaaggccccaaggcccgcacgccttattcagagaacagcaggaggcgcggggcgggttgggggcgtcagggagacggggtttgactgagaacctgggggcgccagtgacagcctcggccgcgttgctgaaaaccgaccttgcgggatgaagagggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagctcaggatccaaaagcatcttaatattctctataattcgccaaaaaccatgactccttttacattttcgaaacgacctcatggggcaggcgagggggcacacgctctcctcactttacctgttcgggtctacaccgcccggctctagggccggcagctcagcacagccggccgcgagcgctggggaggggacgggggcgcagggagaaccgggggaccctgggcgcacacagaccccagggggaacgcagggcctggaggggctcagcgcgcgacccccgcctcggggcacggagactccgggggatcactgggacgcgaagggcgcagggcggaccccaggggaaccggatggcgtctccggttcgccagggcagctggggcagccggacccgagacagccggacccgcgggcgccctctgccgcctcccggccctggatgctgcggggcggggcgggcggctcgcgtgccggggtggggcagtccctggagccgccgcgggttcccgggatgcgagcgccggcacccgccgccacagctcctggccagggcgcgctgccccgcgggtgtgcctgagcctccgcgccccgcaggccctgggtaagtgtcctgggcgcccccgcaggcccccgccgcgtgccgcccgcggtggagacgggatgcgctcccgggtgtggggctgagggacgggcgccggcgtcgggaccctcctcacgccgcatcctcgcgtcgccaggcccggcggccccgggacggggcggacactctggggtgcggctggctggtctcacttaaaactcggacctcggagggaagccgcggcgcgtccacggttcgtggtcctcagcgtcccctcgagagtgttctgagccttcactccccgggcgttccgtgcgggccgcgctccctggggctgggcgggtgcgggcggcggagcggggccccgctgtcgggccgagggcgccaggtccggggggcctcacccccgggaaaggcccatgttcaggcttggtttcagtagcacccagtagcgctgaagtcttattttgagcggccagaattcccagaccggatgccctgagagagcgatgtggcgcctggagtccacgctgggaccccttctggggaggggtcgccatgggcgcgtgacaggcaggggccaccctctgacctcttctgcgaggccggaggtcagagaccttgtgcagaagcgtcccacgggcctgtcccacgggcctgtccggctgtggcctccgggatggcaagggcaggcggggaggggcttcctccctgggcctcctgtgcgcgcgcacaggctctcgtctgcggggttcttgcagaagggtgggcgtgtgcgcgcgttctccaaacgccacccccacggggcctcacagccgccccggcctggcaaccgtcacccattttacgaacgaggacatcaaggtaggtcgctcatccagcctctcagagcaagtgactggcggcgtttggactcgggccgagtgtgccatacccatcccgcacaaagccggggctcgatgcggccccagagtcgctgaaaagccacgagtaacaagaactggagaacgtaggatgctgacccggcggacgccgccgcctggggagccgcttcgacgggggggacgccaccgcctggggaacggcttttattttcgttttcttacttatctgtattctctaaaatgaacagacacgagttttaccacgggagaaaggttcttagaaaaattcagatttctcagaggagtgctgtcagctcacagcctggtggggttgggaggccccagatggccctggccgacccctctgtcccgtgtgggacctgcccgtgagcagcacccaggagtctgtcgaggccccacccgtggtccccggctgagcccctggctgcagtgggtagggtcctcccctgtcccccaattacctatgaggcagcttcgacctgtgtcccaggcagagaagaacgctgccgtcaggaggccggggacagctgagtcttgcctcacaggggcatttctgtggggagtttggtccagtccaaaggaggctccatctgttgaggtgagttcatgagtattttgtaaaatggaacaacctattgtaatagcatccctcctcctgtatttaggctaggtatggcaagaactgagacacacttccctgccaccccctcgcatctctgccagtagggccaggaagttcagatatgctcaggtgaccacctgaactccgcgaggcttttctctaaagtattatcagcaactgtttctcaaactactttatcttgatccttgtgccaaattatttatttcctgcaactgtgaggcccctccttcatgtggcctggtgttcccgggagcaggccttgtgatcagagggagacggcttgtggcttaacagggtcttcccacctcgttcacccgtgctgggtgctgagacgccgggggagggggaggcagctgtggttccagccgtcgtcatttgcaatgcagttggagagatgccgccgggtggccctgaccagtgttaagtggttaatacgacacagaagcgggaaagcgccatgtggtctggggtgatcaggcattgaaggagactcaacggagctccttgcggaggagagtcggctcacagacaggcaggaatgaacaggccgatctgctaggggctgatgactcgggtaggaaagacttggcggccctgaaacaccttgcctagctcgctcttccttccctccttccttcctaccttcctttctttttttctctttctttctttctttctctctctctctctgtctctctttctctctctctctctttctttccttttctttcgagacagagtcttgttctgtcacccaggctggagtgcaatggcgctttcttggctcactgcaacctctgcctcccaggttcaagcaattctcctgcctcagcctcccaagtagctgggactacaggtgtgagccaccacacttggctaatttttgtatttttggtagagacagggtttcactgtctctactaaatgttggccaggctggtctcgaactcctgacgtcatgctctccccacctcggcctcccaaagtgctgggattacagacatgagccaccacgcccagccgcctagctgtttcaatgcgatgagttatagccaaaggtgcttccacttggaattttttttttaataaaaatatattcatttatataaaaaaattaaaaaaaaaaagaactgaggcacaagcaaaacctgaaactgggccaggtgtggtggctcacacctataatcccagcaccttgggaggctgaggcgggtggatcacctgaggtcgggagttcgagaccagcctgaccaacatggagaaatcctgtctttacttaaaaaaatacaaaaattagccgggtgtggtggcctatgcctgtaatcccagctactcgagaggctgaggcaggagaattgcttgaacctgggaggtggaggttgtggtgagccaaagtcacaccattgcactccagcctgggcaacaagagtgaaactccgtctcaaaaaaacaaaaacaaaaaacgaaaaacccaaaactggttattcagggggcactggctgtggggagggggtaggcaggccagctccttggatttcctcggggcccctcccccacaccgcccacagggaatatttatctgcttctggtgatttttaccagaacccttgattttagaaccgttccacagcactgagctggagacacctgggagaacgtggctttgcccaggcgttgcagggcgagtagtcactggtatgtgaggctgaggagggcaacgaggcttccgtctcaattccggctactcggaagggagtttgggattttggggacaagaaggatctgcactagccccacctctgacaacatcccctgccccgcttcatcttcccagctgtcccaccaccccccgacccgctcttgccctgtggctctgcactcatttggggacgagggttggtcaggctggtggtgcctgggctcagggtcttctggggctggtgtaggtcaccctatcccctttaccttccttgacctcaaggggtggtcgagtgggtttgctctatgcccggcccaccttggggtgctgggaaccgtctctggcctgttctccccaccagactggggccaggcttgggtgcggcttgggagtttcctgtttgagtcgaaaggccttgcagttctgatgggatgtccttgcaggctggcctccagccaccaagtgcccaacctggtttctgggagaagtgcactgggccagacacgtgaccatgatggagacgaggctgggcatcccacagcacctcggggggagggctggacccttccgaagcatccgtcccaccctccgcaccacctccacccacccaccggcatctgtccctgctccaatctgccatttgctttctttcttaacattccacatattttgcttatatttatttgtaaatttgtgtcctatgtgttacatggtgtttgttttttgtttcttgttttctttcttttctttttttgagatggagtccagctcttgttgcccaggctggagtgcagtggcgtgatcttggcttacttctacctccacctcctgggttcaagcgattctcctgccttagcctcccgagtagctgggattacaggcaccagccaccacgcctggctaatttttgtatttttagtagagacggggtttcgccatgttggccaggctggtcttgaactcctgacctcaggcgattcccctgcctcagcctccctaagtgctgggattacaggcgtgagccactgcggccggcctctttgtattttctcgttgaggcaaaatgcacataacatcaaactaaccatttaaaagtgaacagttcaggggcatttagtacattgacgaagttgtgcagccactgcctctctctagctccaaaacctcttcatcgcctccggcagtgctcacccaccaggcagtcactccccagtccctgctcccaggtcctggccaccacgaacctttttatctgagtttgcctactcaggatatatcatgcaatggggtcagtgtgtgtccttctgtgtccagcttctttcacgcatcacagcgtttttagggtccatccatgtggcagcacgtgccagggcttccttccttttcatggctgaataatatttcatcttatgaagataccacattctgtttactgatccctcagctgatggacatttaggttgtttacattttttggctactgtgaattatgatgggcatttgtatgcaggtttctgttagaacaaatgcttttacttctgttaggtgtgtacctaggagtggagttactggatcatatagtgattctgtgtttaactttttgaggaaacaccacacttttccacagcaggtgcaccattttacattttcaccagcaatgcaccagaaacagttccaatttctccatagccccactgacccttgttatgttccattaaaaaaaatgatagctggcccggcgcatggttcacgcctgtaatccctgcactttgggaggctgaggcaggcggatcacttgaggtcgggagttcgagaccagcctgaccaatatggtgaaaccccatctctaccaaaaatacaaaaattagccaggcgtggtggcacgcgcctgtagtcccagctactcaggaggctgaggcaggagaatctcttgaacccaggaggtggaggttgcagtgagctgagattgagccattgcactccagccatggcaacagagcgagactctgtctcaacaacaacggcaacagcaacaagaagccatcctagtcgtataaatggtattgaattatggatttttgtttacttgcatttccctaatgatttacagggctgagcatgttttcatgcgttgaacattgtgtatcttctttggagaaatgtctcctcaagtcctttgcccattttttaaattgtacacatttatgggttcatgtgtaattttgttacatgcatagattgcatagtgatcaagtcaaagtttttagggcgcccattacccaaataatgtacattgtactccttaactaaaatctcatcagccgggcccttgtcaccccctcacccttccaggtctctgtcatccatcattccactcactacgtccgtgtgtatacaaattcagcacctacttgtgagtgagaacacgtgacatttgactttctgtgcctggcttgtttcgcttaatgacctccagttccatccatgttgctgcaaaagacatgatttcattctttttttatggctgaataatattcaattgtgtatatataccacattttcttttgattaatccactgatgggaacttaggtttattccatctctttgcgattgtgaatagtgctgcaataaacatatgagtgcaggcgtctttttgatatattgatttcttttccattgggtatagacctagtagtgggactgctggattaaatagcagttctattttattttattttattttattattactatactttaagttctagggtacatgtgcacaacgtgcaggtttgttacatatgtatacatgtgccatgttggtgtgctgcacccattaactcgtcatttagcattaggtatatctcctaatgctatccctccccgctccccctaccctacaacagtccccagagtgtgatgttcccctccctgtgtccatgcgttctcattgttcaattcccacctatgagtgagaacatgcggtgtttgtttttttgtccttgtgatagtttgctgagaatgatggtttccagtttcatccatgtccctacaaaggacatgaactcatcatttttgatggctgtggcagttctatttttgattctttgagaaatctccatgctgttttccatagaggctgtactagtttacattcccgccaatagtgtatgagttcccttttctctgcatcctcaccaacatctgattttttttttttttttttttttttttttttgagacagagtctccctctgtcgcccaggctggagtgcagtggtgcaatctcagctcactgcaacctctgcctcctgggttcaagcaattctcctgcctcagcctcagaggcacccatcaccatgccagctaatttttgtatttctagtagagatgcagtttcaccatgttggtcaggctggtctccaacccctgacctcaagtgatccacccacctcggcctcccaaagttctgggattacaggcatgagccactgcacctggccgtctttttaataatagccattctgactggtgtaagatgatatctcattgttgttttattttgcatttctctgatgattagtgatgtggggtattttttcatatacctgttggccatttgtatctcttcttttaaaaactgtctattcatgtcctttgcttactttttaatgggatcacttgggtttttttgttgttgccatcgttcaattgtttgagttcctcgtatattctggttactactcccctgttggatgaatagtttgcaaatattttctcccgtttaacaggttatattgtcactctgtttattatttcttttgctgtgcagaaggtttttagtttaagacccatactatagtctgtggtgtaatttgaaatcatgtagtgatatggttaggttttgtgtccccacccaaatctcatcctgaattataatcctcaggtgtttagggagagacctggtgggaagtgattggattatgggggcagtttcctccatgctgttctcatgacagtgagtgaattctcataagatctgatggtttgataaatggtagtttttcctgcgctgacacacacacctctgtcttttttggtccttatgaattttaggattatttttctttttctcttttcttctcctcctccttcttctctcttttttgcttcgagatgggatcttgctttgtcacccaggctagagtgcattggcgcatagctcactgcaacctcgaattcctgggcccaagagattgtctggcctctgcctcctgagtaactggactatgggtgtgtgccaccatgcctgactaattttaaattaaaatatgtttttgtagagatgaggtctcactgtgttgttcaggctggtctcaaactcctggcctcaagcagtcttcttgctttggcctcccaaagtgctaggattacaagtgtgagctaccatgcccagcctgagattgttttttctaattctgtgaaaaattactttggtattttgatagggattatactgaatctatagattgccttgggcagtgtggtcattttaacaatgtgaattcttctgatctatgaacatggatgttttcgtgtttgtgtcatctacaattttctttcatcagtgttttgtaattttccttgtagagttttattctcaggtattttttaatggttattgtaaatgagattgtcttcttgatttctttctcagctagatcattattggtgtaaagaaatgctactgatttttatatgttgcttttgtattctacaactttactgaattcacttatcaaatctaagagtttttttggtagaatctttaggtttttttagatataaaatcatattggcagataggaataatttgacttcctcttttccagtctgaatgccttttatgtactttctcctgcctgatcgctctggataggactttcagtattatattgaataggagtggtgaaagtgggcattcttgtcatgttccagttcttaggggaaatgctttcaacttttcctcattcagtatgatgttagctgtgggtctgtaataaatagcctttattattttgtggtatgttccttctgtgcctagttttttgaggatttttatcattaagggatctgaaatttattaaaggcattttctgcatctattgagttgatcgtatggtttttgtccttgattctgtttatgtgatgtattacatttattaatttgcatatgttgaaccatccttgtatccctgatacaaagcctacttgattgtggtatattatctttctgatgggctgttggattcagttagttaatattttgttgaagattttttttgagacagggtctcactctgtcacccaggctggactacagtggcaccatcttggctcactgtaacctctgcctcctaagttcaagcaattctcatgcctcagcctcccgagtagctaggcttacaggtgcacaccaccatgccctgataatttttgcatttttagtagagacagcattttgccgtgttgggcaggctggcctcaaattcctggcctcaagtgatccacctgccttggcctcccaaagtgggattacagtgtgagccactgtgcgccgcggaggatttttgagtctatgttcatcagggatattggtctgtagttttctttttctgttgtgtctttgtctgattttggtatctgcgtgatatgggccttctagaatgagttagggagcattctctcctactcaattttttggaacagtttcaggaagattggtcttagttctttttttgcatgtttggtataattcagcattttttttttttttttttttttgagacagagtctcggtctgtcacccaggctggagtgcaatggtgtgatctcggctcactgcaagctccgtctcctcccgggttcatgccgttctcctgcctcagcctcccgagtagctgggactacaggcgcgtgccaccatgcccagctaatttttgtatttttagtagagacgggctttcaccatgttggccaggatgatcttgatctcttgaccacgtgatccacccgcctcggcctcccaaagtgctgggattacaggcgtgagccactgcgcctggccagttgtgagcttttcttttgggggaggtttttaattactgattaaatcccacttttcattacttatctgttcaggttttctatttattcctggttcagtcttgggagattgtatgtttccaggaatttatccatttcctctaggttttctaatctgtgagcatatagttgttcataatagtctctgatgatcttttgtatttctgtggtattagtgttttcctttttcatttctgattttgtttatttgggtcttctctctgttagtctagcagtctctatttcgtttagcactgctctggtctttgttatttcttttcttctgctaattttggtttggtttgttctcgcttttctagttctttgaggcacataattagattgttaacttgtaatctttctacttttttgatatagacatttaatactataaaccaggggtcctcaacccccaggcctcggaccggtacctgtccatggctcgctaggaaccaggccaaacagcaggagtgagtggtggacgggtgagcattaccacctgagctcttcctcctgtcagatcagcagcagcattagattctcataggagcacaaaccctattgtgaactgtgcttacgaaggatctaggttgcacgttccttatgataatctaatgcctaataatctgagatggaacagtttcatcccaaaaccatccctaccgacatctgcagtcagtggaaaaattgtcttccacaaaaccagtacatgatgccaaaaaggttggggaccaccactataaacttccctcttagcactgcttttgctatatcccataggtttttaaagtatgtcgtgtttaattttcatttgtttcagcaatttttaaatttccatcttaatctctttgttgacccaggagcatattgtttaatttccatgtatgtatagtttccagagttgctcttggtatttatttatgattttattccactgtggtttgagaagatacttaatataattttaatttttaaacatttgttgagaggaagaggaggagaagcaggaggaagaagaggaaaaaaagaagaaagaaaaatctgttaagacttttttttttttttttttttttaaggcagagtctcactctgttgcccaggctggagtgcagtggcatgatctcggctcaccacaacctccgcctcctgggttcaagtgattctcctgcctcagcctcctgagtagctgggactacgggtgtgcaccaccatgcccagctaatttttgtatttttagtagagatggtgtttcaccatgttggccaggctggtctcgaactcctgacctcatgatccacccgcctcggcctcccaaagtgctgggattacaggtgtgagccactgcacctggccaatacttgttttgtggcataatatatggtctgtcttggagaatgtcccatgtgctgatgaaaagaacgtatcttctgcagttgttggggagaatattctataatgtaaatgtatgtggaggcctaaagtccagttgaaatcccatgtttctttgctgattttccatttagctgatctgtctaatgccatgagtagtgtgttgaagtccccactattactgtattgctctctctctctctttagttctaggaatatttgttttataaatctgggtgcaccaatgttggatgcatatgtatgtagaattgttttatcctcttgcctaattgatccctttatcattatataataaatgacctttgtctttttttttttttttttttactgtttttggcgtaaagtctgttttatctgatatgagtatagctactgctgttcgcttttggtttccgtctgtgtggaatgtatttccccaccccaccccccgcctttactttcaatctgtatgtgtctttttaaaaaaatagagacaggatctcgctatgttgcctaggctggtctcaaactcctggcctcaagcaatcctcccatcttgacctcccaaagtgctgagattacaggcttgaggaacaatgcccagcctatgtgtgcctttagtggtaaagtgagtttcttgtatgcagcatatagttgaatcatgcttttaaaaatccattctgccaatcagtgtctttaaagtggaacatttgcctgggcatggtagcttacgcctgtaatcccagcactttgggaggcagaggcaggtggatcacttgaggtcaggagttcaagatcagcctggccaacatggtgaaaccccatctctactaaaaatacaaaaattagccaggagtggtggtggagggctatagttctagctactcaggaggctggggcaggagagtcacttgaacctgggaggcggaggttgcagtgaactgagattgcaccactgcactccagcctgggtgacagagtgagactccatctcaaaaaaaacaaaacaaaaaaccggactgttaacctgtttaccttcaaggttaatattggtatgtaaggtttgattcctgttgtattgttatttgtttcctagttgttttataagttatttgtttctttcttttcctctggctgtttgtcattgtggtttggctgaattctgtagcagtgccatttgattcctttctcttcgtctgtgattgctttatgagtgagttttatatatacttttgtgtgtttccataatggtgaatgtcgtcttttcacttccaagttagggcttccttgagcagttcttgtgggactagtggtgatgaattccctcagatcggcttttctgggaaagactttatttctccttcatttatgaaggttagtcttgctggatatcaaattgttggccgaaagtttttttcttgcagcagtttgaatatgtcaccttattctcttctggcctgcaaggtttttgctgagaactccactcttagtctgatgaagtttcctttataggtgactagatgcttttctcttgattttagaatttgctctttcactttgactttggactgattcatggtgcactgtggtagtgtcttttttgcacgatgttttcctggggattgctgagcctcctgtgtctggatgcttagatctcttgctaaacttggcaggttttcatatattccttcattaaataggttttctaagcctctcaatatctcttcatcctcaggaagaccaataacttgtaaattcagtcgctgtatgtagtcccaggtatctcacaggctttgctcattctttctcattctttttgctttgtttttgtttgattggatagtttcaaaaagcctgtcttttaagttctgaaattctttcttctgcttggtctagtctattgttggagctttcaaatgtattttgtatttctggttttttttaaaaaatgtatctatctccttggtaaatatctcattcatattctgaattaatcttctgagttctttgtattgattttcagattcctcacacatctcattgaacttctttaaaatcaatattttgaattctttatctgggattttgaggatttcttttggttgagatttatctactgctggagaattgtgtttctctgggattgtcatattaccctgctttttcatgtttcttgtgtctttatgttgctttctgcacatctggtgtaatagttgctttttcttgttttggggtttacttttgttgttggggggcaccttttactggagatgtgactgggatgttggttgggtagggccctttggatttacttctgaggcatgcagcagtgaagcctctgtatgttttatttggctattagcagtgttagtggtatctgcggcttccttggttagggtgcagttattggtggcggctgtggtgaagttgtgctggggactgggatgctgggtgggcccatcttcaggcttcagtggtagcagctgtgggttaaccatgtctatccttgtgccccagggtggcacacactggcacctgtgttggcagtaccaggcaggctgattcttgggcctctgggtggctttctcagaagctagttgtagtagcagtgtaccatgcgagtgagcaggcttcctagtttttgggcagccagagtggtgtgggcaatggtggtggcagtggtggtgagatgcacttttgggtcccaagctctgtgtgcatgtgttggcagtggttgcaatcggctgtgctggccagcctccagaccagcagctggcacttgcaggtaggtgccagctgaggtggtagtggcagggtgtcccctgggagaagggctcagtgtcccaggtggtggactgtgttgtgggtcctccaggtcgctggatcccacactctgtcttgtgggcaggctggggaagggggatgctgggcagagctggaccaggcaagcttgctctagccccctgagtgcatgcaccaactgtgacaggtgccactgggtgattttcagggcccatggcagaatgcctggatgaggggcagctgccacagggagggtggggccagtcctagcagccagagccttggccatggatggaagacctgcatccctttcatgccccaatccccatgtggcatgctcccccatcctggctgttggagacaaaagctgatccatcagccttggcagtttgtgcctggcccgcaactcagctccaggctgtaggccctgcacagctcaagaccaggcccccatggcaactctcatcttgctcaagtcctgggggtggtgcctgcttccagtgctgggagctgcagcccatgctacacttgcctcttagtcctggtccactctcacacctcagttccgcaagcagcagtccaagtccaagtttccctaatgcctcggactggcactgcttgtaccaggaacatgcaccgtctgctaagaactaggatggagaatggtgtcttgctctagctgcttaaatttcagaaagggtatgagacccagggcatgttccctcctggagcacttccttctcagtctccctaaatccgatgcagatttagtctcctgtgtcagggactgcatgattctccagtgggaaagtggactgcgggaagacccaccctcaccctctcatactggggagtcactcccagttcccagccactcttggccacacatcctgcctgttttccttcttcctaagttttgctgtttcctgtcactttcctgctgaactcccatgttgtctcttggaaaatagattcaaagtgtgatcatcgacacattattttggttcttctaagtggatgaggtgtgcttgaaatgcttctagtcaaccaccttttaaaaaaagcctttgcccattttaaaattgggttgtctttttgttgttgaattgtaagagttctttgtctatgctggacactagacccttatcagataacatgatttgtaaatgtttattgccattctgtgggttgcctcttcactttcttggtagtgtcttgtgacacaaaaatttttagttttgatgaagtccaatttatcaatttttttctcttattacccgtgctttttgtgacaaatctaagaatccattgccacatttaaggtcattatccaatcaaagccattaaagatgaattcttatgtattcttcggagtgttatatttttagctcttacattaaagtctttagtcaattttaggttaatttttttcatattgtgtgaggtagggatccaacctcattctttggtgtgtggctttgtttttttttcctcttagagacaaggccttgcttgctaccttgctcaggctggccagttatctcaacaccatttgttgaagagattgttctttccctgctgaacagccttggtgcccttgtggaaaatcaattggtcattggtcataatcaattagtatctctattcttatgccacagtttctttctttttaatgtttttttttaaagccaaacattttattatggcacttttgaaatattttacaaaaatagagaaaattatacaaagagctcaattttttcatcagctagcataggtaatcaactatcaatattggctgatccagtttcatttaaagtccagcctgccaaccccagcccacttagactccactgtcctccccactttatagagaagcaaatccctaacatgccatttatttcatatgtgttttaatgtgtatgtctaaaacgtggattttaaaaaatcagctctctgtttttctttatgtgtatgtatatacacacacatacatacagggtcttgttctgtcacccaggctggagtgcagtggtgtgatctgggctcactgcagccttgacctcccaggctcaagcgatactcctgccttagtctcctgagtagctgagactacagacatgcgccaccatgcttggctaatttttaaaaattattttctgtagagatgaggtctcactgtgttggcgttttatattttaaatttttttttatttgaattgagaaactttaatgttaggaagtctagatagcaacagtgatgcagctatggaggggagaggagaactctggatggtgctccggggctgcgggaggcccctaaggagtgcgcttggaagggggctcccttcccaaagctggggctcgggcctcattggaggaggtgtaggttccgtcccctggagggcagagaagtttgctgagttgccctgtctatggcagtggtgagcaggaacacgaaaaaataggaagcactggaaccaggagaggctccttcttcctgctgggctcctctaggaccgtattcaggccagtgcaacatcatgccctctataggaagaaatgctgaaagactgcggcttattaatgcagatcaggcaggatggagagtctggagcctacaggcaacaaacaggtagctggcacagcttctgagtactgtcacctcactttgcgaatacatgtctcccctcccgggtctgtgtagccgccatatacttgatgtccacgtttgttgtgaaccccacaacacactgttgttattgcttagtcacttatcttttaaagatatctaagcaataagaacaaattatgcatatttcaccctctagtagtcagttcttgcgctttttgtgccatgttgtagacccatactacaatctggtatcattttcctttggcctgtaatgtttcttatagtgtgggtcagctagtgatgatttctttcagtttttgtgcatctgaaagctctttatttcaccttcacttgtgaatgatgttttcataagatgtagaattctaggtttcagggttttttctttcagctttaaagatgttgctccactaccttcttgtttctgatgaggaatctgctgtcatcttatttttgatcctttgtacccagtgcctattttctctggcttttaatattattctaggccaggtacgtggctcatacctgtaatcccagcactcttggaggccaaggtgggtgaattgcttgaacccaggagttcaaggccagactgggcaacatgatgaaaccccatctctacaaaaaatacaaaaataaatattattctacttattactggttatgagcaatttgattatgatatgccttggtgtaattttcctgtttcttgtgcttggagctcactgagcttcttgggtctgtaggtttacaattctcattacatttggaaaaaatttctgctgtttcttacattttctcctaactcctttcccctcctattcattaggggtccagttacacatatattaggtctcttgaaatacctattttatttttattggggtgctattgtaaatgatactagtttttaaaaatctgaattccagttgttcattgctagtatctagaaacacaatttatttttgtatgttattatccttttactgtgtgaccttgctggtctcagtaattagttataggtaattggttttagtaaaatttttggaattctctctctctctttttaagagacagggtcttattctgtcactcaggctggagtgcagtggtacaaacacagctcactgtcaccgcagcctcaatgtcctgggctcaagtgatcctccagcctcagactcctcagtagctgagactacaggtgtgtgccaccacactggctaattttttttaaaagtatgttttgtagagatagggtcttgctacattgcccaggctggtctcaaactcctgggctcaagtgattctcccaccttggcctcccaaagtgctgggattataggtgtgagccacttcactcagcctttttggaattttctacatgtacaatcatgtctgcgaacagatagagttttcttttatttttatttcccagttttatgacttttatttatttcccagttttgagacttttacttactttactgacttattgccctggctagtacacaaataattttagtgggaatgggggtacaccacagctttgccttgttcatggtcttggggggaagcatttagtctttcaccattagctgtgatgttagctataggcttttgtagatgttctttatcacgttaattaagtttccttctgttcctagtttgatgagaggtttttttggaaaaattgttatgaatggatttggattttgtcaaatgcttttctgaaagattgagatgatgatgtgcattttctttttagtttattattatagtgaattacagtgattggtgtttggatgttgaagctgccctgaattccttggataaatcccacttagctgtgatgtatcatcctttttatatattggtagattctatttgccaatacctatatttaagtgaggatttttgtgtctatgttcatgtgggatgctggtctttagttttcttttcgtgcaatgcctttggtgtggcatcagagtaatgctgaattcgtaaataagtcgacaattttaaattttttctttgatattttttgccaagagagaattggtattatttctttacattggtagatataccagtgaaaccatttagacctgggttttttgatgttgttggaatagatatagagctatccagattatctgttttttcttgagttttgatagattgtgcctttctaggaattcctctatttcatctaaatcgttgaatttttgggatagtatttgtcttactctgcttgggctgccataacaaactaccatagactggatagcttaaacaacagaaatttatttcacactgttctggaggctgggaagtccaagatcaaggtgctggctgatttggtttctggtgaggcctctcttcctgccttacagatggctgccttgttgctgcatcctcacatggtggagagagagagctctgatgttgcttctctttttatagggcaccagttctacaggattagggctccagccttattaccttaatcacctatgagggtaggggctctatctccaatacagtcacatggagagttagggctcaacataggaattttgggtggacgcaattatgttcacagcaatattatatatatatatatatatatatatttttttttttttttttttttttttgagttggagttttgctcttgttgctcaggttggagtgcaatgatgtgatcttggctcactgcaacctctgcctcccaggttcaagcaattctcctacctcagcctcccaagtagctgggattacaggcatgcgccaccatgcctggctaattttttgtatttttagtagagacagggtttcaccatgttggccaggctggtcttgaactcctgacctcaggtgatcctcctgcctcagccttccaaagtgctgggattataggcatgagccactgcacccagctctataatttttctttttcttttcttttcttttttttaggccaaatctcgctatgtcgcccaggctggagtgcagtggcatgatcttggctcactgcaaactccgcctcccaagttcaaatgattctcctgtctcagcctcccaagtagctgggactacaggtgcacgccaccatgcctagctaatttttgtaattttagtacagacggggtttcaccatattggtcaggctggtctcgaactcctaacctcaggtgatccacctgcctcgccctcccaaagtgctgggattataggcctaagccactgcgcctggcctcagctctataatttttcttttaatgtctgtgggatctgcagtgatgtcctctctttcattcctgatattggcaatttgtgtcttctctgtttcttgatcagtatggctagaagtttatcagttttgttgatttttttcaaagaaccaacttttggtttaatcactttccttcccctcccctcccctcccctcctttcctttcctttccttttccttcttttttttttttttgacagagcctcactctgtcgcccaggctggagtgcagcggtgttggctcactgcaacctccatcttccaggctcaagcaattctcctgcctcagtctccagagtagctgggattataggcatgagccaccacgccctgccaatttttctttatttttatgttttatctcttatcgacttatttttattatttccattcttctgttcaatttgggtttatcttctcttctagttacttgttagaagcttagatcttattttagaccttttattttctcaaatataagcacttaatgctatcagtttccatcaaagtactggttagctgcatcccacaaagtctgatatgtttgcattttcatttttgtttagttcaaaatatttttaaatttctttgtgaatcaaagaggcatctttgatccttgcttatttaaaagtgggttgctttccaaatatttggaaaatttctagatatctttatagtttaattccattatgtcaaataacatactttgatttctgtttttaaaaaaattgttaaggatagttttaagtcccagaatatggtctgtcttggcgaatgttacatgtgtaaaaaccagatactcttcggttgttggatggagtgttttataaatttccattaattcaagtctgttgtcgtttggatattctgtatccttactgattttatttacttgttctattgatcactgagataggaatgttaatgtctcccatgaattatcctttttgattttattagtttttgcttcatgtgttttgaagctccattgctaggtacatttacctttaggattgtcagatcttcttggaaaattgacctctttattattaaagaatatacctttttgtctctggtgatattccttgttctgaagtcttctttgtctgggactcatacagctgcttcatttgattaacgtttgcatgttgtatctttttctatccatttactttatctacctaagtctttacagtccaagtggatccatgacacatttctgacatttttatggcactttccacacaaggtggatattgcgtgagtctgcctcctcttccaggctacactcacttcaggtcaggtgagggctccttaacttcctccccaaggcttctggcccagagcctggcacgggatggttactgcacacaggtctgcagaacgtttgtgagggctcagctgcacccattgcaaggaaaatcaagattctgtgagaagaagggtgatgccctctctgaggtgggtggcaggcaagctgaccagcctgggcacagatactgggctgctcctcaggggccccgctgggaggcacatgcctgtgtccagcactgttggtggcagctggtgggtgtagtcagctggactcagggcgctgtgagctagtgacttaagtggaatcccaggactgtagagtggagtagaattttacatagaaaagaggaagcctgttggcccaaagcacaaggctatcaagggcagagatgagaagagcaagacctgccacaaaccgcacagggagatcacaccacagagaggagattatgctgttgccctgcatgcgctcttgggggtgatgggatcatgtggccccgtgtgtcctctcggagtgacaggaacatgggacctgagtaccctctcagaggtgacagaaacacgggaccccacataccttctcggggtgacaggaacacgggaccccacataccttttcggggtgacgtgaacacagaaccccacataccctctcaggggtgacaggaacgtgggaccccacgtaccttctcggggtgatgggaacacgggacccgcgtaccctcttgggggtgacgggaacacgggaccccacataccttctcgggggtgacgggaacacgggaccccgcgtaccttctcgggggtgacgggaacacgggatcccgcgtgacgagtgtttggaggctgcaggctgcccaggccttggctgcgccccgccccgcccgttcctggcttcctcgatggcttcctcctcaggacgccggtctcccgccacggcgccctgagccaggctccagagcaggcggcttctctgggggaggccgggacccgcctgacaccgaggggaggcccaggcgtgacccggccccggtggctcctcggtgcggggtgctggagagcaggggtcccgggccagggggtcccacgaggaggagcaggaggtgggggcctcgcggggtcgcgggtgtgggggcgccaggaccgcgctgaggggcccggggcatcgcggcgggaacagggcgcacgtggcgcgttccggtgaccgggtgcccccttgtcttccaggccgaggacgatgatcccgccgggggagtgcacgtacgcgggccggaagcggaggaggcccctgcagaaacagtaaagtatcccgccttctgcttgtgtgggttgttgcacccatggaaggggagggttggggtttgccttgaaaacggagttttaggaacagggcgagcgaggaaggcttcgggagccgggcgggccggggctgagctccggcgcgggcggcgcaggagtcgtctccccgcagcgccccggtgcccggagcccccggcgaggctcgtccctgcgccctcggggccctgagcggtggagcgaggcggcgggcaccgtgaggcgctgaggccaaggacgcgggcggagctccgggcggcagaggcggaggcggcggggccacggcagcttcccaggctccgcaggcgagaccgccacccgctgggacggagggtgtggcacggccgggtgtgtgcgtgtgtggcgaggctatgcgaggctgtgtgtctgcgggtggggagggctgcgggggtgtgtgcggtatgtgtgaggctgtggggggctgtgtgtggggtgtgtgtgtgtgaggctgtgtgtgcgcggggggagctgtgtgtgtgtgggtgtgtgtgtgtgaggctgtggggggctgtgtgtggggtgtgtgtgtgtgaggctgtgtgtgcgcggggggagctgtgtgtgtgtgggtgtgtgtgtgtgaggctgtggggggctgtgtgtggggtgtgtgtgtgtgaggctgtgtgtgcgcggggggagctgtgtgtgtgtgggtgtgtgtgtgtgaggctgtggggggctgtgtgtggggtgtgtgtgtgaggctgtgtgtgtgcggggggagctgtgtgtgtgtgggtgtgtgtgtgactgtgcgggtgtgcgaggctgtgtgagactgtgtgtgcgggtgtgtgtgggggactgtagggagctgtgtgtgtggggtgtgtgagactgtgcaggtgtgcaggtgtgcgaagctgtgtgagactgcgtgtgcaggtgtgtgtggagggctgtggggagctgtgtgtggggggggtgtgtgtgtgaggttgggggctgtgtggggtgtgtgtgaggctgtgtgtggggagtgtgaggctgtgtgtgtgcgagggggactatgtgtgtcggatgatgtccctggctgtgtgtggggatgtgtgtgtgtgtgtgtgtgtgtgtgtcagatgatgtccctggctgtgtgtggggatgtgtgtgtgtgtgtgtgtgtgtgtgtcggatgatgtccctggctgtgtgtggggatgtgtgtgtgtgtgtgtgtgtgtgtgtgtgtgtgtcggatgatgtccctggctgtgtgtggggatgtgtgtgtggggagaggggtgggtgggtgtgtgtgtcggatgatgtccctggctgtgtgtggggatgtgtgtgtgtgtgtgtgtggggatgtgtgtgtgtgtgtgtcggatgatgtccctggctgtgtgtggggatgtgtgtgtgtgtcggatgatgtccctggctgtgtgtgtgtgtgggtgtgcgtgtgtgggtgtgtgtgtgtgtgtgtcggatgatgtccctggctgtgtgtggggatgtgtgtatgtgggggggagggggtgtgtgtgtcagatgatgtctctggctgtgtgtggggatgtgtgtgtggggatgtgtgggtgtgtgtgggtgtgtgggggtgtgtctgtgtgtgtgggtgtgtgtgtcggatgatgtcccccgctgcaggggctgtaggattctgtgtagattcacagcaatgccaccctcactgccctaacacctgctgtgataatgaggtaaggccccttggcgcctggacgtgtcaaatgcttggccttagtgtgtggccgtggtgcctccaagcactgcggggccccaggaggagctggggctgggaaacaaggggaggtaaggcctcccttgggaaggaaggatcctgtttactgtttacatcttgtttaggtgtcttgttatggtaaacagtaaagagatcccatgtcccgcagggagaccttaccttgtccctcaaggctgcagtttgcggccaaggcctcgcactctctgtgcatcgaacaccagcatgcagtaggctcagtgcccaggctgacgctggcccagcggtgagcacatgcgcaaaaccatgcctggggccaggcacacagccgaggccgggaccaagggctgcagaagaaacagcacagccctgcgctgcttgcgaacaagctctagcgggggacggcagtagatacggatgctgcaattcatatataaagggaggaaacataaatacggtgcatgcacattttctagtttattcgtaaaatgtctcccgacggaatcacagaaaacttaaaatcagctgcctccaggcagggagccagcctgaagacactttcctctgagttttgaaataggtgagcacactagctattcaaaacaccaatacataaaacgcaaaggcccagaaactcctttctcaggtctttgcagtggaataaaaacacaataaaagcaggaaatttcgttctgattcttccccagacggccccaccacagggactgcatttgcagctgtgtgacaaagctatttcctctccttatttaatgtgacaaatacgtctgctacccaaatctctcaagtgcacaggctcaggagcacattccgtcgcccacccccgggggacccagctatggaagtgtctcaacccttcctggccccctacgtgcacccggcttcatccttggcccccagggacggcggcccttcacctgcagacctcagcctcaccctgtataaagctctgtcttcctctgctgctacaagaacccactgcagatgcagcatcagccaggatgcttccacatccccccgcgggacctggggacctgggtgaatgatgaacacgcggaagctcacgtagcttgctgtgccgtgagtagtaagccctttgtctccgcctccggggtctcatgtcttcttccagggtccacgaaacaggaacgagttgttagcttgcaagagttaaaatcaaatcccccacactcgtgtattgggaggatgaaaacctagatgtggaattgctcagccaaagcacgggcgtttgtaatttcaatagttgttcccaaacctcccagcattagggttagagtccctcatcagttcctcctccccacgccccagcacatagtgtatttcagatattggtgattttaatttgcattcttgtatcataagtgaggtttaagagcgatttgcatttccttttctgtgaaccgtgtttacgccttttgctcatttttctagtagattgtttatgttttgtgcctcttgatttgtaagaacttggaaactagggaaattaatttttgaatgggtttcaaatactttaccccagttttgattttacatatagtgttctttgccatgcagaaaaaattaaatttgtatgagttgaatttgtcgatctttacttttgtggctaattttacatcacgattaggaagatctcccttacttcaagtttataggagaatattcccattagttcttcgaatacattccttaaaatatatgtatttatgtttaaaacttttaagcacttggggaagaaagaggaaaaaagagggaaaaaagaaaaccagttgtgatttgaggggcaatgaaagacagtgaatgacttgaatagtcgtgaaatgttttccaactcagacacacacccccactgcacacatacagtaggcaaggtgatggaggctggtgtgtccaagcatgggcatctgtgaaggctgccgtgtctttctccatggaggggctgctggcacgtgcaggggtcctgggaacccctctagggacccactctgggaaactggaggccaaaacactgttttgatgttgagtctgggtgcccatcctgcaccctctcctgcggtgggggccccctccgctctggccatcccagctgtggcccttgatgcacctgagggccgtgtccagtgctctggtctgcccagctcctctgtggtgatgggggatgggtctgtgtgtgccctaaattttgtctggaaggggtggctggtaaaggctgtggagcatgccatcggaggtggagttggtctagaacctgcccctgagaggcccccacaagcactgagtgcagggggcagctgatgtgggggaagccgggcggccggctgggacagccctccccttggcagtgcccttgactcccacccagcctcggtatcctttggatgacatgggtgatcctgaatccacagtgctctcccaggagtgaatgccctgtgccaccaggagcctgtttgatgctccttgtcttctgggattccccggagtcctcagcagggacagtgccttcagctcatgacactgtggaagccacagggattccccccctccttttttttttttttgcattttgatgtttattgagtataattgaagtatacgtatttcagctgaactgcacgtttaaggtgtgcagcgggtccattttgacatttgtgtacatccgtgaagctatcaccaaaatcgagaggaagcgtttctatcactccacgagcttctttgtggcccctcgtaattcctccctctagctctgccccaggcaacctccgatctgtttcctgtcactgcagatggtttgcttgtcctggcattttgtgcaaatggaatcacacagcattttgtctgtctgcacttggtataaaagttctgagattcatccatgtttctagcaccagccatttgttctcttttattgctgcgaaatgttctgttgtatggatagaccaagtctgtttatttacctgtggatggaagttcaggtcgttctctgttttagactgttacaaataaagctaccatgaacatttttgtacaagtctgtaggtttttatttctgttggataaatacttaggcatgcagttgctgggtgacacagcaggtgcacgtttaactgtttccaaagcagtggtgtcatttcccattcccagacactgtgtgtgagaatcccagtttctctgcatccccgccggtgcgtggtgtgctcagccttcttggttttgaccatcctcatgggttggtggtatctcatcagagttttaatgtgcatttccctagtgactaatggtgttgaggataactttatgtgcttcttcaccatccatatatcttgtctggtggtgtctgtttaaataattgcccgtgttcttattgtcttgttttcttactattgagttgtaagagttctttacatattctggatataaacccttgttgtgaatattttcttccaacctaaagcttatcttttcaattttcttaatattgactttcaaaagacatttgaaaaccttttggctgggcgcggtggctcacgcctgtaatcccagcactttgggaggccgaggcgggaggaccacaaggtcaggagatcgagaccatcctggctaacacggtgaaaccccgtctccactaaaaatacaaaaaaaaattagccgggcacggtggcgggcgcctgtagtcccagctactcgggaggctgaggcaggagaatggcgtgaactccggaggcagagcttgcagtgagccaagatcacgccactgcattccagcctgggtgacagagtgagactccgtctcaaaaaaaaaaaaaagaagaaagaaaattttaaaaaaagaaaaccttttgatgaagaccaacttgtgagctttttgtctttttgtgttctgagagtcctgtaactacccccaaggtctgaaggattgatttttgcacattttcttgtaaagttttacagtagtttaaagcaccttgaagtctatactccttttttgagttaatttttggatattgcatgagggtagagctggtgtccgtttgttttcttggatatacggttgatccaacacaatttattgaaaagattttcctttccctgtttaattgccttagtatctttgtgaagtaaattgtccaatgaagacccaaggaaaaccagtgtgtctatttctagactcacaccattcttttctattcatttatacttctatgttttctctaataaccaaatcatctttaatattatagctttagagagggcttaaactcagtaatgtaggtccccagctgtgcccttctctttaattggctattctaggtcctttgcatttccatgtaaattttagaatcagcttgtcaatttctgtagaaattcctgttgggattttaatatgattacattgaatctatagatcagttttggggagaattgccatcaacaatattgaatcatccaatcaaagaacatggtatatcttcctgcgtatttggtctttaaatttttctcagctctggtttgagtgtcttttgttaggtttgttcacaggcattgcatattttggggcgtctctttccgcctgagctggcttggtgcacctcccacacctgtttctgtgctgatgggcgttgatgaatcctcctgcgagtctcctctgccctggagtgaactggagcttctcctgcacgccctcagggcttctaggcttctcgtatcctgtccgtggcctgtgtcctcctggctgtcctctccccactgccttcggccatctctcccatctctctggcgcccccattctgtggcctctcccagctgctgtctgcccactaggtgctccccttgttttctggggaggtcttgggtgtccttcactgacaggtgggcccctccagccaggggatgccagtgcacacgagagcaggtccaggtcatccccaattctcccgcctatttacatcttggctagcagcttcagtaatttttggtgggtgcaacattaaaaaaaaaaaaaaaagaagtggaaaggtaaccaaagataagacaaagaatgggagaaaataaatagaaatcgtgtactcaataagggcctggtatccagagtagttaaagaatcctcacaactcaaaaacaaaaagaaaaacaacccaatttaaaactgggcaaaagacttgaatagccatttctccaaagaaaatataaaaatggacaacaagcatttgaaaagatgctcaacatcataagtcattagaaaaatgcaaatcaaaaccgtaacaaaataccacttcacacacaccagaatggctgtaatcaaaaaaacagaaaataataagtgtaggtgaggatgtggagaaactggaggcctgctacattgccgatgggaaagtaaaatagcgcagccaccatggaaagcagtttggtggtgccccagaaaatgaaacagaattaacatatgacccagcaactctactgctaagtacatgctcaagagaattgaaagtatatattcaaacagaatcttctagatgagtgttcactgcaccgatactcacggcagccaaacagaggagacaacgcaaacgtccatcagcagatagacggataaagcaatgtggcctctccatacacgggaatattactcagccctgaaaaggaaggaagcacagagagctgcagcagtgtggatgaaccttgaaaacacgaggctgtgagaaagaagccggccacagaaggccacgtcttgattccatttctaccacatgcctttagtaggagggtccatgctgagagctgactgagggctgccagggctaacagaaggggaatctagagagacggctgatgggtaagggtttccttcaaggttggaactaaatagaggtgaggtttgcacggcttagcgacggccctaagtgacattgaactgttcacttttaaacagttagtttcatgttatgtggattatatctcaactgaaaacaactgctctgggtttggcgctgtcaggctgctctgtgactggtttacggcctaggttgttagacagtgagaaatggagtttgtgccgcagagttcctgacagaacagattgtttcagacttacagcttgcacgtgtcagctcactcataaatgcaaacaccttagaaaaataaggaacttcttgacaaaagagacccaaacccctggaaacagcaggctcactcctgtatgtgccaaggtcccaggaagggttagtgtggaaagtcaggtggcctcgttcctgtggtcctgccagtaactggcccctgctcagtctccccatgcattcccagtggactccatactggctgccatcttttctttcgcatgattgcatgtggaaatgatatctagaacgagatggcagttgaagtggcttcagtgcagtgatggttaaataggtcagctgtaggggacagtcactgtgaggttaaatgggttagccgtaggggatggtcactctgaggttaaataggtcagctgtaggggacggtcactgtgaggttaaatgggtcagctgtaggggatggtcactctgaggttaaatgggtcagctgtaggggacggtcactgtgaggttaaatgggtcagctgtaggggatggtcactctgaggttaaatgggtcagctgtaggggatggtcactgtgaggttaaatgggtcagctgtaggggatggtcactctgaggttaaataggtcagctgtaggggatggtcactgtgaggttaaatgggtcagctgtaggggatggtcactctgaggttaaataggtcagctgtaggggatggtcactctgagtttaaatgggtcagctgtaggggatggtcactctgaggttaaataggtcagctgtaggggacggtcactgtgaggttaaatgggtcagctgtaggggatggtcactgtgaggttaaatgggtcagctgtaggggatggtcactgtgaggttaaatgggtcagctgtaggggatggtcactgtgaggttaaatgggtcagccgtaggggatggtcactctgaggttaaatgggtcagccgtaggggacggtcactgtgaggttaaatgggtcagctgtaggggatggtcactgtgaggttaaatgggtcagccgtaggggacggtcactctgaggttaaatgggtcagctgtaggggatggtcactctgaggtgagagggtcacgccaagctcctgtcattttaaggtaggttgggtgagaggggtcagctccctccctctctgggctctgtggtgtggaagccccacaggtggcccctttttgtgggtagagcaggcctgctctggcttattaggagaattgggtgatggccctcactgcccctttgtggggccccagagtggcaggcacctggtctcatttgccctgggtactctcccctcagccccagcatgtacaggagaaaccaagctcggagcggccttgggcacggcccggctgatgccaggaggaccttttcatgtttcctggaatgtgttaggttttgtttagacaccgaggagtcccctaaggatgctgaatgaatgtggcattttctatgctcactcctgccccgccagcctggggccaggcgtcctcctccctcctcagggatccgtagtggagaggtggagaaatgtgcctgtcccgcagctgggggccgtgccctgtctccgtgctctgagctgcggttctccggctggtttgcttcttctctctacatcccctccagatactgagctgtgcttggctgttgtgcgctgtggtttttagtgtctatgtcttgaggcatgggtgagctttagtcctcttcccgtcttttgtcctggcagcagcgtagatgctcctagtaaggtcactgcagaggacggtttccgccccagggggcctgtggcttctggtggagaagcccacctgacccagaccatctccccacaggaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaaggtaggactctcacctgctcccacctgttcacttgagtcaggctgtgtctcccctgagtccatctggggccttgtggccaggtgaagtgtgtctggtgggttgcaccatgtgcactcccttcttcccccacgctgcccccagaacctggagacttggcccctggatgggagctggctgggctgtggattttccctggggccaggtctggccctagctgtcctcgacactctcagggtgggggcctcacctcagtttgctgggatgggccagtttgcgcctggggtcctgggtttgctgaagctgcgcagctgctgagggaggggctggggctgttcctccccgtgctgggcctcactggggcttccccacagaccccggctccagggaatgagggatcggctttgtggatgagcagggctgggcatggtcaggaggctgaggcagctgactaggtgggacccgggggctgccctggggtgccgggcgcctccccctgcccacgccaggccgtgcccggacacagctgctggggctgccctctcgtggggaggggcttctggggctcctgcatctcaggtggggcctccccaggcctgtgccctgtctgtccttggaagcatggcgtttccttagatttcaggttattgctgccctgggagctgggatcgctccagagaactcgcaggtgtagaccgtggggcctttgctgttgcgggagggtgggagagaagctgctttcagcttctgtgttgggtgacgtgcctgcacgtggtttgattgcagcacttttagaattaaaaaccccgtgaccagcagcatgtggcagttgtgcccggtgcctgcactcctgagtttgagtcagggtgggggcctcccctgggcggggggcgtctgtctcagggtgcaagaggctgtcagtgcctgggcccctgcagacctctgcgcaccctcagacacccccagggaaggacgtggcccatgggctgcgggaaggaaagtcacggtgatgcccagcatcacgcgccgtgtcctgccagtgccggccccacactgagggtcttccccgggtcccggctggccgcagcctccatggaaatcaaatcccacaaaatgttaacagagcttatctgagtggtgaggtcacagcaagttttagttttacattccaggttttctaattttatgttgaaaactattaattttatatttatctctgttcccagcctgggcctcctggtgcccagggctgctgggtggtgttggactcagtttacctgagagacctggggtttgccgtatgtgcaggatggcagcttttccaggagggttaagatgtggtgcagttggtgtggtctggtgtggtggagtgggcaccaccctgcatgcacctgggcatgggcaccagcatggaattgagggcaggctcccaggtttgccttctgggacacgcctttcatggatggcgcagtgcggctcagcagcgccaatggcagagggcagtccccgtgtctggacagcgcaggaagggctggggcagccggcagggaggctttgtcccgagctgaagacctgtcacatcggcttcctcccaccgacaccgcacagcctcaccctctcgctgggaggttggaggagaggccaggtcatttcctctccgcacaggtcccactgtgtccagccaggccagggcttgacggcctcagaaagtcttcgattctggtgtttccagcaagtttggacacctggctcttcttaaactgccagcgagtgagcttcccatcctgctgcctgccccaagccggggcaatggcactggatggccatcctgtgcaggggcaccctgcgtgcctcctgctgccctgctgggaggtgcccacctctgccgcagctgcagtgactctcaggggccaccggcttacgagagtgctgcagctttcaggaataaacttcctgatttttctaccaaggattgtgaattttgtgatccccttcaggctgtacattttagaggaaattctaaaaacttttctgaagtcatttccacgtataattagaaacaagtcaagctataaaagttagatcttaaactatgcctcttgacttagagatgggtaagctaatttcattacggctgccataaaaagttgcctttgggaaggacatgaaccagggtgatgatggcctgagcatttgcttgtgatgtttaatgttaatgtgactgttaaggtcgggattttccactcttggtgattttactattcacaccaggggaagtcaggcacaaaataagagggaaggaggtggtgaggaggagacagtctgctgctgccttgagagagctctctgccctcctgctgcggggcatggaggggagctgggccccttctaggctgaaccctggtcacagcctgggacgtgggaccctaacactgaccaggaagggtccagaagccccggctctgttgctgaagcccagttgtgggtcaggccaccctcccagaactccttgggggtgcctgtgtttgccaggacccctgcagtcagcgactgaggaagagcgcccgcgagtggaggccctcagtcacggagtccacccgggcagtcagcgactgaggaagagcgcccgggagtggaggccctcagtcacggagtccacccgggcagtcagcgactgaggaagagcgcccgcgagtggaggccctcagacacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactgaggaagagcgcccgggagtggaggccctcagtcacggagtccacccgggcagtcagcgactgaggaagagcgcccgggagtggaggccctcagtcacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactgaggaagagcgcccgcgagtggaggccctcagtcacggagtccacccgggcagtcagcgactgaggaagagcgcccgcgagtggaggccctcagtcacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactggggaagagcgcccgcgagtggaggccctcagacacggagtccacccgggcagtcagcgactggggaagagcgcccgggagtggaggccctcagtcacggagtccacccgggcagtcagcgactgaggaagagcgcccgcgagtggaggccctcagtcacggagtccacccgggcagtcagcgactggggaagagcgcccgcgagtggaggccctcagtcacggagtccacccgggcagtcagcgactgaggaagagcgcccgcgagtggaggccgtcagtcacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactggggaagagcgcccgcgagtggaggccctcagacacggagtccacccgggcagtcagcgactggggaagagcgcccgggagtggaggccctcagtcacggagtccacccgggcagtcagcgactgaggaagagcgcccgcgagtggaggccctcagtcacggagtccacccgggcagtcagcgactggggaagagcgcccgcgagtggaggccctcagtcacggagtccacccgggcagtcagcgactgaggaagagcgcccgcgagtggaggccgtcagtcacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactggggaagagcgcccgcgagtggaggccctcagacacggagtccacccgggcagtcagcgactggggaagagcgcccgggagtggaggccctcagtcacggagtccacccgggcagtcagcgactgaggaagagcgcccgcgagtggaggccctcagtcacggagtccacccgggcagtcagcgactgaggaagagcgcccgggagtggaggccgtcagtcacggagtccacccgggcagtcagcgactgaggaagagcgcccgcaagtggaggccctcagtcacggagtccacccgggcagtcagcgactgaggaagagcgcccgcgagtggaggccctcagtcacggagtccacccgggcagtcagcgactgaggaagagcgcccgcgagtggaggccctcagtcacggagtccacccgggcagtcagcgactggggaagagcgcccgggagtggaggccctcagtcacggagtccacccgggcagtcagcgactggggaagagcgcccgggagtggaggccctcagtcacggagtccacccgggcagtcagcgactggggaagagcgcccgcgagtggaggccctcagtcacggagtccacccgggcagtcagcgactgaggaagagcgcccgcgagtggaggccgtcagtcacggagtccacccgggcagtcagcgactgaggaagagcgcccgcgagtggaggccctcagtcacggagtccacccgggcagtcagcgactgaggaagagcgcccgcgagtggaggccctcagtcacggagtccacccgggcagtcagcgactgaggaagagcgcccgggagtggaggccctcagtcacggagtccacccgggcagtcagcgactgaggaagagcgcccgcgagtggaggccctcagtcacggagtccacccgggcagtcagcgactggggaagagcgcccgcgaggggaggccctcagtcacggagtccacccgggcagtcagcgactgaggaagagcgcccgcgagtggaggccgtcagtcacggagtccacccaggcctggcatgtggctgtgtccacctctatgcgtagggccggagtgctgacggggcacagaggtgtgtgttcttgttgctgtgtagagaagtgtggagtagattagtaccaaaaacaaagtagggaggagagaaggtggcacagcctcactctgaaagcctggggattttcctgtcaggatgatgctgctccctgctcccttcactcatcacccgcagcagcatcggagtcctcttgttcctttgcatccaccgtgctccactgtggggcctgaacacacacctgtgtccatcctggagcccctcctggggtcagtcctggctctgaagcccacccgggctgaacgggcacatccgcttcaccccaccctaggtgggcaagaacagaggccccacagcgccacgaggtgtcctgggttcttgaactctggaatcccacacttgctagcaggtcaaaagttccatgctccttgagattacgagtgattgtgtaaacccaggcctgaagttatactttattaaggtaaatcatgctgattttcagctttcactgaagatttaccttttccttgatgatctttttatggactggatgtttgtctcatcccttcacctattcatatagtgaaaccctaattcccagtgtggccgtatttgtaggtgggtccgcttaggaagaaattaaggttaaacaacttcataagtgggggtggggggtggcctgaactgataggaccagtgtccttaaaaaggagacccaaaagaaccctctgtccctctctgtgctgaacaccccccaaagaaaggctgtgagagaacacagggggaaggcagctgtctgcaggctggaaagagagccctcaccagagccaaatcagctgcaccctgatgacgggcttttagctccagaaatgtgggaaagcccattcctgttgtttaagcccccggacgggggtgtttattataagcagcccaggcagagaagtggggtgccctgcactacatgccacatacctaagaatgtggaagtgacttgcagctggctggtgggtggaggctggacgagttttgaggtgtgtgctagaaagagccctgatggctgtgaagcagttgttggtagaactatgggtgttaaaggtgttgttggtgagggctcagagaggagagcattgtagggagagctgtggtcgtagagaacacacgtaccccatgaacagaacactgatagaaatgtgagcattaaggcagattctggtgaggaatgtgcccgtggaacgcgaggaaagtgattcttgttataaagtggcaaggacttggctggactgaattctagcattttgtggaaagtggaacttgcaagtgatgaaatggggtgttttgctggtgagatttctaagcaaagtgttgaaacccttgcttctccttactgcttatagtgaaacgtcagaggagagagatacatggaaggaattgccaaaagaaaaggaaccagaacttgaaggtttggaaaattctcagcctatccacattgcaaaaaatgagaaggtgggccgggtacggtggcgcacacctgtaataccagcactttgggaggctgaggcgggtgatcacaaggtcaggagttcaagaccagcctggccaagatggtgaaaccccatctctactaaaaatataaaaattagccaggcatggtggtgggcgtctgtaatcacagctacttgggaggctgaggcagagaattgcttgaacccgaggttgcagtgagccgagatcttgccactgcactccagcctgggcgacagagcaagactccatctcaagaaacagagaaagtgttctggacggacttgcacgtggtgaaacagccattggatagggagactgggtgtgagccaggagcccagccgggaagcctcctcagcagaggccaggagtgggatggcaccacgcccgcagagacactatcagcttggcctaaggagaacaggacgggaggtagtgcttgccagtggctggcatgtttcatctttccagaaaggggagagtgtgcctgggggtgattcagaggtaaccaggtgccacttccaccacaggcacagggcagggctgtctcttcctggatttcggagagtggggccactgcagagctgggaaagaggccgggcctctgggcagagcatggagtcaaagaggattgtcctgaggcctccaggtctcaggcgctttgccttgctagacgtgtgacttgcttgggacccgtctcccctctcttcctactgggtcctgccttttgcaatggggagttccatcccatgcctgttcactgttgtattttagaaggacgtggcttgtctggtctcacaggttcttggctggagagcaggtctgctttaggagaaattgtaccttgagtcttacccatttctgatttagatggtagttaaatgaaactttggcttagactttagagttgatgctggaatgggttaagacgtttggggctgttgggatggagttaatgtattttgcatgtgaggacataaattttggaggcaaggattgaatgttataagctgaatgtttgtgtcccctaaaactcatatgttgaagccctagcccctagtttggctgtatttggagaaggggcctctaaggaagttaagtttaaggttaaatgcggtcataagggcagagctctgatctgatgggattagcacacgtataaggagagacatcggagggctcactctgtccacaagcacagcaggaaattcatgtgaagatgcagtgagaaggtggctgtccacaagccaagaagagagccctcaccagaaactgaatttggtggcaccttgatcatgggcttccagcttccagaactgcaagaaaataactttctgttgtttaaatcattttgttacagcagccctagaggctaaggcaagcccccatggcagggccgcaggtctgggactcgatttttctcatcctgcggtgggcatgggcacatgtgggtcgagtgccttccagctctccaggctgtgctccaaccctttccctcacccccttcctctctgtcactggtgccttctggaagatggcttccccttggggagcatttcctgcaaagactcacaagtttaaaataatttaggatatttctctgtacttgagagccaggataggatgagagttggtcctgccctgatgctgtaaggccactcctgtctcagaccctgaggtcctcaggaatggtttcccaagtactgttgtagttgtatggcaagatcactcttgattattttaggagctgattttacttttcctacctcttttaactgcttccaaaagatgaatctggccaagaagagcaggggctcattcactcatttactcactcattcctggtgcttgagtttattcctgaaggaagctgaccaagggttgagagaaaacaactttgatttttctcatgtctgccccagcaaacctcctttgtggactgattctccttctgtgcctggaagaaactgggataatcccaggacttttctggtcccttctaggtaattcagtgtcttccactaatgtggccccacacaggctgggcttgttgattagtataggtccagcaaaacagttaaaactctacatgtcttccgcatgtgaacctcttcccaacctcacctggtgctgtggcaggtgggaggctgggtgtcaggctggctgctgccccctgggttctgcccagctggtagctatggcttccaaccctccagtgggaggaacaagagggataagaggtaaggacaggagaggttctgtatggctggcatggcagagagctggcacatgaggctggcaggaaatccagagggctctgggggcattctcatggtctcctaagtgaccacactaccctggggtgtctctgccacaactggccaactcaggaggtgtatcctctccagctggtcccttacactcacttccttagccctaggtggccgtggtacctctagcctcttgccaaggtctgccctcacatctccaggaacccttctgggcaggatttaagacatcccaggccagtgttcaggcactatgaccccacctggtccacaggaaatgtgcacctttgatccactgggttagggttatttccacatgcagcctagttgcctactgggagctccaggagtcaacttttgccctttagatttcttgagtgtaagagggataccaggtctctgcccaccaccagcctcagaaggcacacagtaggcacttgcaggcctcgtgaaacccctcttggaatgaagtaaggagaaagctgcccatccctctcatggtacaggttgggtggggacagactgagagcactgcccccctctcccaaggaagccctcctgtcaaacttgagcttctctcatcttcaacacctcctctacctagatcacccagaatttcacatgggaacaattggcacttcttgtcttggggcctcagctaaaattcagactggaaaagctccatattaacatcctgttctaatgcaagtaaaaaaagagctgctatggtctttgcttcttggtatttagagtctagtgggagaatattggctacttaatgcagtctcttccattttcaatatgtaactgaggcatccttctactgataacagccaaaacttcaagaaaaaatattttaagcctttaaaaatacatttgtgggctggtaggaaattaaggaataatcagagaccaaaaactaagtgaagctgagaacccagagataactttattaaaggagaatattaaacatatacttcacgcagaaggaagagaattccaggtggaagatttgagatgcaagggggaatgaaaaacaagaaggtggtgactatatgggtaaatcaaatcaaatcaaacaccttgtgtaaaataataatggtgatataagaattttaaaaagagaaataagtatatagtcataatatgatacaaatttgaagagggtgatgagttaaaaagttctaagattcttgtgttaactttggaggatggttatctaatttgtaataaaattttcaggataatcatcaaccgtagaaatggggttgaaatttcaaactaatggaaagaaaaaagaatgagaaaatataatcaatcaaaaggaaaagactagaaagggaaaggaaaaaagaaacacaaaagaggtggaacaaaagtccaaatatatcagtaactacaataaacataaatggaataaacataacaactaaaagataaagattattaaagtggattactatatgctgtttacagaaaacacatctacactctaagggtacagaaaggatgaaagtaaaaggatgggaaagggtatactggggaaatataactgaaggaaatatgatgaatctatattaatgtaaaaaaattgattttggggtaaaaagcatcactggagatagagagaatcactatgtaatgattaaacaattcatttcatcaagcagataatataattttgaattttattctttccataacataatttcaaaatctgtaaagcaaatattgacagaactataaggaagaatatataaattcatcatcagagagaaatattttaaatactgtaactcagtattttatagaagaagtaaataaaagccagtaaaggttatagaacatttgaacaatgcaaagaaaaaaaaaaggttaatttagtggacatacataaagcagtatacccccaaactacagaattcacgtattttcaaagcccgcatggaactggtaaatatatggaaaacttactggccaataaagcaagtctcagtaaatttcaaaagataaaatattgaagaataatgaggtgggacctcaatgcaaataaactagaaatcgataataacaagataacttgaaaacccgtatagttggaaataaataaacacacttgtatataacgcataggtcaaagaagaaaagaagatgtaatttagaaatatttaaaatgtgtgggatgtagccaaagaaacacttagaaataaataatcttaagtgtttatgtataaaagaaggctaaatattaatgagctaagcatttaattaagtagttctgataaagaacagtaaaataagagagtcaaagaaaataatagaagatattgatgaaatagaaaagaaacatacaacagagttcttttaaaatgataaactttacaaagatctggtgaaactgatcaaggagaaaagaataagcagtattaggaatataaagaggagctattatgaacaaattaatgccaataaatttgaagtttgaaaacataaatgaaaaaattcctagaaaatataacttattaaaactgactcaagaagaaatagaaaacctgaatgtcgtaggaccattaaagaaattgatttgtttaacatcttcacacagagaaaatctaggctcagatagcttcaaagcaatttctaccaaatagtaaagaaaaaaataattccattatattgaatcctgggatgttgaattggaattggaggtattggtgtgagctcatggttttcaatatataaagagagacatgaatatgtacgtaaaatgtgtgtacactcaccttccccccccaccccctgccccacacacacactgtccactgagagagcctcggaacagtgacaccctagcagcagcaatcacacctaacattcagatgttggtttctaaatgcttcctgccattaaaaggactagggcttttggggctctttcaagagctggagcagacaaagtacaaggtactttgtacttacctcatgccagaaagcaaggcagtggtcaccagggatgaagacgtgtcacaggacacagaagccgtcttgaaggggctcccgctggccaagtctgggacaatttcagcattaaaatgaataatgatagtaatgggctataccccagtgaataaaatatgattttatagggtcacatttatataaatgaatgaataagtaaataagtttttcctcacaacaggctaattaatggctataagaagagagatgactatagaaagaaaaggtgaattacaaatcaaatttggtaaccactacagtcataattcaggcaagaaatatcaattggtgctaaaattggtggtgaaaatgggatgagacaggatttttgtagtcttgaacaaaatatctattaattatgaagccgaaaagcccagcattcactgtcctaagtgatcgatcttacccgccaatagtggaataagccggcattgtgcaccccgcaacaggatgagtgggtggagcacagcattgctttgctgatactcggctggaggtgcataacttcggtctaatcacgaggaaacaccagacagacccaaattgaagggcagtctgcaaaataactcacctgtaatctccaaaaaacccagcaggccatgaaagccaaggagttactggaagggatggagaggtggcagggactaaggcagtgtggcgatggctgctgccgcagtccagcaccaccttggctgaaaggatgttattgggacactggtgaaactcagtggcatctgtggacaaggggtatctgggtgctttatatgattcttatagcttttctgtaagtttgatatcatctcaaagcataagcaggaggaacaaggaaaactaaaatggagaagttgcagggtgtttatatgagctctaaagtgagtccctggggggtcgccgcagatccccagctgctcccaccctggaggagctggggggaagagcaagtgcccagggaggcagggggagaacgggagttcgtgggcacgtggtgggccctcagcgtagccagatgtgggacagcatcgtgtgcatttgtatgtttgtgaggcaagtcacgtcttttaggagcacttgtcattttgggcagctgggccttttgcaaagagaaatataagaataaccaacaccttcctcaccgcccatcatgaccaccctgccccacagacacgggtctgagctgcagtgcgtggtcaagggcacagaggagtgggcagcggtggccgtggggaccggatgagccagcctggtggggcctgaatatggcagcgccaggcagtgatgccacgtgggccttgctgggggcggcatccgaggctcagcacacctgtagcttttgaaggccatgccctcctgctgggtctcttgtcttcacccgtcaggaggccttccccagcctcacttttaacatcacagcctctgcccctctgccctgacaccaccccctctgctgctcgttctctcctagtgcttaactcgtgtgttgctgggttctgtccccctccttctctgttgtatgcccaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtgaggacaatgaaggcaatggtgattcacaggcaggccagccccatatgggtgttagttgtaaattcatggttacataacataataaatttacctacgaattcattatttataaacaaatggagactctgacagctgagctggcactcctcgttgatgtgaaagttgacaagcgaggcagcatccatacctgtgggtagagggcagaggactcagtgagggctcggtgccctcttccgcagtaggagaggccagtggggctgctcaggaagactccctgggcgtgcaccgcgcactgtatcctgcctgagggtgtgggccagggcgctccctggctgtggccgcgtggggttagtggcctgcagtgttgaccgctcactcatctgtacacctgtgcaccgcacgctgattcactgaatatttggttgttaaacagcaccagcacagtgttttgggttttgttttacaaaatgtttcttgaacccttggcttgtccctgctgtgcttttctttgatacgttgaaatgtaacaagaatgcccaaatagtttgcttataccagatgtttcacatcatgaagagaatatggatttgcaatgtgtgcaagtattctttttttccccaaagagctatttttggttgcatcttccacgataacgtggggttccaaggccagggtgtgtttcctctgcaggacgagcgtgtgactctggtgaccgcagagcccccctgaggcccccgggttctgtgatctcagaaagtggttagaggcgcattctcttgaccagagaaacgcgtgggcactgccagctgcagccaccccagtcttcgctggctcagaggaagtgcatttctttgcggttcattttgcactgtgaggaagtgtgaaatctctgaagctctctggtgctttttgaaaaatcgggaaattcttgccataggaaattcagcaacttgatgcagtatgtgtcttggggtgccccccgttttgtaaatatcgtgtctgtgaaatgagtgtgtttatttatactcctgatgctttttctagcttaggggaatttgggactttgaaggacatttttaaacccctctgccccacaagctgtaactaagggttttggaagcacactcgcccatccagcacccacttgctgggacccccttctgacttgctgcttctctttgccctcagtgagcacctcgaatgcattccctcacactctgttaatacacccgcccatgtgtcaagagcagcacggcacagtcatccgcttctcacacttcctcacaccctccctcttcctgggcattctgtcttaaccccctaacctggtaccagctgttttctgggacacctgagggctctccgggcacagtcctggtcccctcctgcccacagcctgaaggggcagctttgtcccacagggtggacttgcctgctttgcaaggctgaggcacatgctccttgcagatgaacagacctacagctaggcgagcatgcagcacagcccgactcaggagctgaggcctcccgctgcacgagcccgggctccctctgtgtcacttgcttcgctctgagtctttgtcacctgcctgaatgctcctgatgcctcctaggccactggggagagctgtgcttgtcccacgctctggcacagagtgtctgtcccgagtgcttcctctaaacctttcctgtgcagaagctgggacaaattctgtgcatcctggtgcagaacacacctgttcagaaagtaactgggtggtgagaagtttcctttgcaaataccatttgtggccatcaagaatcactaaatgacattttcttccggaatgtacatattacaattcatcttcaaaaggcaaaacggtttctcatccagttcttgagaagggaaggaagggagagtttgaatgttcgaaagccttgaggctctggtcccctcatttgacgtaaaacttgcaaaggcatttgtaggaatggttggggtgtgagagcaggggtcagaggtgccctcctgggaatgtcttggctctgagagcactgccctgccctcccgggctcttgctggtgccccatcctcccgggccctcgctggaagccccgtcctcccgggccctcgctggaagccccgtcctcccgggccctcgctggtgccccgtcctcccgggccctcgctggaagccccgtcctcccgggccctcgctggtgccccgtcctcccgggccctcgctggaagccccgtcctcccgggccctcgctggtgccccgacctcctgggccctcgctggaagctctgctcatttactccccgtgttacggttgtgcagcatttcctggatccacagtcaggtcaggcaattctggggcgagcaggcgtcggggaagggttggatgggcgtcccaggcttctcagagcatcccatccaactcctggacgggagaggtgtcgtaagggtccctcaggagggagcttgagctggaagcaggggtgagtgaaatcaggttcaagggaaattttcaccaaggtcatccgccacccccaggaccctgagagtctcacagtgggtgcagccccaggcaggtggtggtccataggggacagcccccaggaagatgcaggtgacaggggtggggtggacagcccatgggaaggtgtgggtgatggggggacagtccatgggaaggcacaggtgatggggttggggacaggtctcgggaaggcacaggtgacagtgtggggtggaggggggcagcccatgggaacgtgcaggtgttggtggggggaggggggcacgttcccatcatgcttgtccgacctccctgggtggctggaggaggaagtgatccagaggaggcctgccttggaggcacccagagcacagaggctgggcctggtgtggagctctcggccgacctcgggccgggctttacagggcatgtcagttagggctctgcagaaaaacagaaccgaccggagacagatatggggaggcttattatgagcaggtgtctcagacagctgcaagctggagacccaggagagccgaggtgtagttcagtccaagcccagaggcctgagggccaggggcgctggggtaaattcccgcctgtggccggagaatgggagatgagctgatctggctcaagccatgagtcaggaaaaaggggtgactcctcctgtctagttctctccagccccccatggactgcccagccacactggggaagaccactggcttcaccgagcccacggattcaaatgggaccgccatctggaaacacctcccaacacagcaggcacgatgtttaatcgcagcacccagtgctgcaggtggttgatgtgtgacatcggtcagcacactaggcctgtgtcctcattagttcgagggccggctgtgactgccaacagtagcttcccatctgagtcaggatttcagcccagccctgctctaggctttctgagtgagtctctggggctctgaagtgatgagcttgcaggtgacaggaatcctgcgtcccattccctgggcaggtgcagcaggggctggcaggctgcctcatgcacgggtaagcccctgtgtgtcccatagtaggactgagcatctgggcccacctgtcctagacccacctgtcctgggcccacctgtcctgggctgaccagtcctggactcacaaggtggctctgactgtccttccaggcctgtggaaccgactcccgtggtcgctgttgaagccctctatggtgaaatgctcccaggagctgcagactgccagacagctttacttaggatgattccctagagggagtcctaaaccgagtcagcttgggggccgcctgctcctctctcccttacgcccctgtctgtggagttctgtcccttccaacgaggatgcttagggtcgatgtgcctgttaagggctgagtgaaaacgatggagaagaaagggatcctgggccttcctctcatctggctgcttgcaccactcaggccccgccgagggctctgcagagaggcaggcagtcctgccaatagggaccttcatgaagcacccacattccttaccaccttctcccctcacaggaaggaagcagcagggtttctgctggttgagctcctcctccaggcttcctggataggaagcagtggtgctgctcagcacacagcccctcagtgccttccctcctcccccagggctggggtgggctggcggggccacccctgctgatccatcccttggcttctgggcccagctcccctgactgcacagaggggactgtggagctgtgggctggggcctcatggaggcatgtcctccttcccagccaaggtgctgggatcctgactgtcacctgccccaaatccagcctgggccctgtgcaccctgggatgggtcacaggaggcctgagaaccaggtccaggctgcggtttgggtgaaggacaaagggacgtcctcttctgctcgctttgcctgttctgcttcttctgtttcttcatctcgccttcttttcagctccccctgggcccagctccctgtccagcactgaagacctgaaatggaccttactcagccctgcacagagcaggaaacttcagccgcagtcgctgcacagggctggggtgcgtgatctccagtggcaggggtgcgtgatctccaatggcagggctgacctcccaccctccgtctgcaccgcctcccccgcccctaccagggaattggcttcaggggactgggagcaatgtggcttcgtttctgggcatcacggcatcacccagacgcacagctggacctgccttctggctcctcctccaccagggactgtgggtcagaccgagtcacaggcccaggtgctcgtggtgggggccagatggggtggccttgggttcccggtgacaccttgctctgagtctcctctgtgtgaagaaacagagggcccttagcaggaccccatgggaagcctgagcccccaagggagccactctgctccagcccttgctgtgggcacagggtcgcccgaggccttggtgctgacttcacattctcgctgttccaaatgagccccttcttggttgcagtgaactctgcagccgtgggcggacggctggtaatggccctgagactctccaaggtggctgaggttctgcgcggttggcagagtgctggcaggacacaggggttgcccaggctacagatccgggttcaggcccagccgtggggactgttcacctctgagagggcagccctgccccgcggccctggccctgccctgcacccggctgggtctcatctgacacgcagccttccagcctctcattgcccgaggggtgggccctgggagtggtcctggcagggcccctctctgcagaccctgcgggaccagcaggccgggcggtggctgggaggcaggggacaggttggcctctgcggtcttggaggcacagagctcctcccgccctgggcctgtggccccctcctgctggcccagctgtgccttgtaagggccacggtgatggcccacctttctcaccaatgcccaggaaggacaccgcgctcccagctcccttcctccccatccactcaccatgggcaactgcggtggctgggcggagggggggtctctctccacatcacagaggaggagactggggctggagaggtgggggatgggggctccctcccggggcggaccctcaggtgggacccccaggctcagggagggcggggggacctggggaggccgtggccgggtccgcccgccccgtgtgcacccggagcgcccgcgcggaccccgagccccattccccgccacgcgcctggcgctccccgcgctcctggggctcctggcgccctgcccgggcgggcgggggcgggagcgctgctcgcacgcgaggcctggctggccccatcgcgtgacggcgccggcggctgcgggggaagtaggggggaagtgggcgggcgcccgcggggggcacgcgatgccgggaggggcgcgcccctgccgccgcacctacgcgcttctcggggaaaaggccggggctgccgggtccgcggggcgcattgcgggtgggacggggtcggctccgctgcgggagcgacccctgcaatggggcttggctgcaccggccgcctgggtggtcggtctgtgtgcgggtgacccaggcgtgtgcccccacccgcgctgccccagcccgcggacctcggcggggagcgcccagggccagcacgggggtctcacggggcgaccccagcagcgtctgtgtggggccgctcctgcccgggtctctcctcgggctcggggtcagctgctgggacacccggggcgcctcttgccctggcttctcctgggtctgcacttgggagaaagatcttgattttcactgttaaaaaccttcagctttctgaacacgcgtattgtgtgaactgtggcgtctctggctgagcctggagggcaggaggctaggatgctggggtttccaggtgggaagaggccgcccttgcccaagggatgcccccacctcggtggactgttcatgcttcctcggaatagtcctgctttgtggcagaagaaatggggcagtttttgttacatttagtgcagtgaacaaacatccagtttttaccagctatgggagttgagggagaaatgagggctcagagaccagggagggaggggaacagagaggccgagtcccaaggccacccggtgccaccgtctccgggcttctggctgcctcacctcctcactcgggccctcgccccccacggacaccttagctcgtcagcatccctgcagctggtacctcagattctgaatcaatggctcccagtatggcctttctggtggagggtggggtgctagcccagtccagcagccggttccggggtcctggcctgatggggagcaggttaacccagcgtccggaccccacctgtgctcaccacggcctggggacaccacagacgctggtcctgtgggtctgggggctgccggcccagggactgtggggtgaggagagctcagagcaaagtgtgaaccactttgactagcaggtggatgccttcctggaagtccaggaggattcctgggagcaggagccagtgacccacaatgaggttcaggccacacacatttcagagcactctcaggtgacagacacagtgcccctggggctggagactgggagtccagcccaccctgagtgagacattatgcttttattcaagtggttattctagttcttaaaatatccagcagcctcacatcattttgggactgtgatgggctacaaatagacacgtgcgcttttcgatgaggcggtgcccctcaaacttgattttctgtctgggtcgggctcttgctgagcagtggggtggaggcagccaggagtctaagctcggcccagtggggagtgagggtggtggggggctgctttggaaagggctgtgtctccctaacccgcggaagtgggcagatccggtgaagcatggccgcctgggctgtgccacgccgggaccccggcacaggctgcccaccgtgaaggacggtgtgctggccttaaggtgccatgcgtgatgacagtttttatgccatctcaaggtcagaactggtggcaaggtagcatctgcctgagcggacaccacctgtgacttcagctgaggatccgggagacgcgggagcagcagatgcccccccggccttgctggggtgcgctttggtccacgcactggggccagctgcttgctgggacacccttgcccctcagtcctctcagaagctggggaggggtgtccctcccatgtctccagtgcccatgaggacactgagtgggcagtgagcacctgtgctgggtccggaactcagcccttggtcagtctggaaggtgaacgtgtcatctgtccccttctgcacccaaaaatggagaatgcaccatcctcaggagtgggagtgtccttgggggctgtgcgcagtcactgggaagggggtagcactggcgactgtcctggacctgccttttcctgccctgcggtgttctgtgcggcccctgggggcgtggggcctggcctgcttctcactagggagggggctgcgtgggttccaggagggagaggcgatgcgggtgtgcagggcacagaagacccaggtggacgcaggggaccttggcccagccctcaaaggggtgcagcccaacagtgccgtgggtctcaggggaggggccgtagggacctcctgggtggcttcagggggatctggcaggaagccagactttgtcccaagactgggtgggggccctggggggttgggcaggaggggacagagagcagtttctgcagagcagagcgggtgtgggggcgtcctcaggccaggctctgcctccatgtcctggtgtccccctgcctctcctggctgatctgaggcctgtgtctcagctcctcctgccccaccttggactctcagggctgtggaatgctgcgtggcctgcagaggggtcagtgcagcccaggccagatgtcaggtgagaaccgtggggtgaacgcggggaaacacaggaaagatgtgaatgaagaagagtggccaggccaagggttgggggtgcctaatgtgtcttttcttctctgacagtcgtgcaggagcagagctcacggcagcctgcggccggcgccccctcgcccggagacagctgtcctcttgcagggtctgccgtgctggagggaaggctgctgttggaggtgagtgccacccttggtacctcgaacacttgacacttggttctccgtgtcacgcgtgttcaggctcagtcatactccgtgtcacgcatgttcaggccctcacccaggaggcccttaggttgtgaggtttataactgtcaggaagcgtaggctccaaaatctgttgaagaagggtgtccctgggtcggggtcagccttgggtgtgagcctcgtaggctgggacagagaaggcagcccgagagctctcggccttgtgtgctacatcaggaaatcatcctcattctgcaccgtctgcttttgcttgtcggtgagagaaccttgtacaaaattaagccttttttcccccaaaatgaaggatttggcaaagtctacactgggcttccctggtgtggtttcaatcttggggtggcctgtgtgacaccctggaagctgtgggcctgggcaggaagctctgtggtgagggggcttttcaccccatctcccccatccctgcgactctgaagtgctgagttgtcctgtgctgtaacgcggggcctgttacccctctgggagaggagactgtggaccattttcctaaacaagataagatggtggcatggagcctccggggtgaatccattcgccattttgaagatgaagggggttgctgcctccaccagtggctggagagacatgggccctgggtggtcccaggatggggttgagtgggcttgcagggaggaggcggggacaacatgacatttcctgggtaacagggtgggctccagccggaactcaggacccctgggtggggcaggagggcaccagccaacccgctccagatgagagggtactggggccctggtggcaggctgccccacagccagcagccactagtctcccatggagctgtgcacccccagtgcctgggaggggctgctcaaccccctgccccagatcctcctgtgtgtctccaggtcagttcacaacccccagctcgctctactctgtccccgctagtgaatgggtcccagctcctggggcctgggaagcctggagcctgcgggagggaggcctgggcctggttccctgctgctggacttcccaccctgctcccagcagcgtgggatattttggagctaccttcagggggactctccaagaagactttggaagaggcatggaggctgggggtcagggtccgcccgtctgctcctgacactgtggccctcctgctgcctggcctgactcccctacctggccagagtgctggtcacacccactctgttctgggggaggttgagcagttcccgaagtctcagtccactgcatctggttcatgtcctctggcccacggaaatttctggaagtttgcttagattgcatctggtaggttgtatggtgagggttcctcactgattgccagggcagtgaaaggggttatatgctctttttgaagcttaaaaatattccaacagggcaaaataagcaaagcaagcaacaacagcagcaaatcccagcttttatttctaatcttcaatctcttcacaataaactgaaaaaaaggggaggtttatggcagggcaccctaaatccataaaccgccttgagccggcacaggcttcagagtgctgtggccatggtctgttgatttaaggtgaggaagtaaggcttggagccaccaggtgccctttggggctgagctggacccagcgcttctgtttatttatttatttaagatgctccacacgttcagagaggctttagtaatgatctagaaatgacccctgagagtgtagtctggacctggtgtttctttgtcctgagttcactggcttgtcctccaagcctccggccttccccagggaagccaagacagatgggccacagcccgtggcttcccctggtgcacatcttggtgcaggtgctaagagtgggaggatggaggagtggggagaggtgggagactggagagggaaacaaggaggagggctccaaagacatgtgagcacacagaggaggccctgagctccctgcacaatacgagtcagagcttctaggttttcattctgtcttttaggtgggctacagggctgttgggtttagcatgactcactggagccacggatgtggcctgtctcgggctaggatgctgtctcactgactgcttaagttcagctagaattcaagtgtatggttactgcaggatacattttctaacacttatttaaaaatttacatacactaaagttcattcttttcggcattcagtgggatgtgactgccaccgtcatgaagattcagagccatcccctccccaaacatttctcctctgctgctgtttgcagtcacagccccctgcccccagccacggccgatgtgtgctctatccctgcagcctgtcccttgcctttctctggatgtcttccacacggagtcacacgcatggcctttggaggccagcttcagtcagcacagtgctgttgagatttgctcacggtgctgcgggtcaccagctggtttcttgttgttgctgccggttaggatttgggctcatccacggtgctgcgggccgctggtttgtttcttgttattgatgaggtatggaccaaccccatgtgtcattcaactgttgagggatatttgggttgtttttaggttttggtgtttatgaatggagctgcagtcaatagacgttcacatacaggtgtttctatgagcgtaggtcttcgtttcatgaatagtaagcgtgtttttaactcttatcccccagcagtgaatgagtgtttcagttgctcagcatctttgggtttgcacttggtattacttttttcaaagccattttaatactggaatcttgttagggttttagtttggatttccctgtgactaacaatgctgcatatcttttcatgtggttatttgcatccgtgtgtcatctttggtgaatggtctttcagatcttttgtgcattaagaaaaccagctcatttgcttgtttactattcagtttagagatctctttatatattctggaaacatgtcctttctcatatgtatgatttataaatattttctcgtagtctgtggcttgtctttttattcttttgacaggatattacagatagtgaaagtattccattttgattaagtttaatttatcaatttctctttttgtagattgattttgttgccacatctcattacctaacctaaggttacaaagatttttcttttatgctttcttctaaagttgtatagtttcatatgttacattctggtctatgatccactttttgttaactttggtatgagatgtgtgaggtaggggtcaagatttattgtttttgcatgtgactatccagatgtctcagcaccatgtattagaaagactatctttttatactgaatggcgtttatacctttgtgaaaaatcaattggctgtatttttgtggatctgtttctggactctgtattctgttctatatatctgtatttttaaccttttaacaataccacattatcttacctactatagctttaaaataagacttgatatcaaataatgtgaatctttcaattttattcttcctcagaattgttctggctattctagttcttttttttccatataaattttagaattagcttattgaccgatatctacaaaaatccctgctgggattttgattgagattgtgacatatcagtaaatcaatttggggagcattggcatttgaacaatactgactctcccaatccatgaacatggtatgtgtctctatttaggttttctttaattatgttcatcggtgttttgtagttttcagcatacatatcctgcatatttatgttagattcatgtttaagttttatatttttgttcttaatgtaaatgagacttttttaatttcaatttttagttcattcctagtatatagaagtacaatttatttttctaggttgactttgtatcctatgaccttgctaaactcattagtagtcatgggagctttttaaaatagattccatgggattttttaaaacatagattttattagtcaggagtctccagagatacaaaaccaataggttatatgtgaggagccttattagaggaattggcttacatgatcacagagacagacaagtttcacaataggctgtctgcaagctggagaaccagagaagctggtagtgtggctcagtccaagtctggaagccccagaactagagaagctgatgatgcagctcctagctcaaggccaaaggcctgagagcccccaggaggccactggtgcaagtcctggagtctaagagctgaggaacctggattctgatgtccaagggcaagaggagaaaaaggcatcattccctggaagggagagaaagagagaacagaaagcaaattctcctcttcttgtgcctgtttttcccagctgggcctccagccagtggaactgacccacattaaggctgattcttcctctctcagtccaccgaatcacatgccaatctcctctggaaacactctcagaaacaattctccaccagctgtctaggcatctctcaatccaatccaatcgacacttgaaatgaaccatcacatagattataattgttgtctgagaatagagttggttttatatttactttttcaatctatgtgcctcattttccttccttattgcacttctaggatgtccagtacagtatagattaggagtggtcaaagaggctatctgccttgttcctgattttagggggagacctttagtctttcaacattaaatatattagcttaggtttgctttttttttttttttttttttttttttgagacagagcctcactctgtcacccaggctggagtgcagtggtgcaatctcggttcactgcaatctctgcctcccgggatcaagcaattctctgcctcagcctcccaagtagctgggattacaggcatccaccaccatgcccagctaactttttgtatttttagtagagacggggtttcaccatgttggccaggctggtctcgaactcctgacctcgtgatccacctgccttggcctcccaaagtgctgggattacaggcgtgagccaccgtacccagcctgcttttttttgtttgttttgtaaatgcctcatatcagattaagaaatttcccttttattccttgttttctgagagctcttattgtgaatggatgttaaatcttgtaaaatactttttctgcatttattgagatgattatggtttttcttctttagactgtcaatgttgtacattacattgattttaaaatgttgaactaaccttgcattcttaagatagatctcatttctattttgcccaattcaatttgctaatactctgtggggacttttatgcctatgttcatgagaaatactttttgtggttttcttgtaatgtttttgtttgattttgatgggtttgaatatcatggtaacgctggcttcttaaaattaattgagggtattcccttctcttctgttttctggaagacattgtgtagaattggtattattttctcttgaaatgtttggtagaattcattagttaaaacatcttgtctgggagatttctttgttagaagatttttaaaccatgaattcaatttccttggactgttgaagtttttcttaggtgaattgtactagtttgtgtctttcaaggaattggttcatttcatctactttattgaatttgtgatatcagagttgttcatgacattaccatgttgatcttttaatgtctgtaggttccatggtgatgtctcctctttcatttcattggtaatttgtgtcttctcactttttcttggtcagttgagttacaggcttatcaattttactgattttttttcaaagaagcagctattggttttattttctgtttccaattttattggtacctgttcttatctttattattttcttttctttgcttggtttggatttaatttcctcttctttttctagagttttaaggtggaagcttagattattgaatttgtctatttgtctattttccatttcattaatttccactcttcttgtttgtaatttatttccttctacttgctctagttttaaatattttatttttctttagatacttaagatggaagtttaaatcactgatttttttaactaaccattcttactctgtaatataagcatttaatgctatgagcttctttaagcacctttacctgtattacacaaattttggtatgctccgttttcattttcatttagttcaaaatggtttctaattttacttggaactttctcttcaacttgtgttatttagaagtatgttgtttaacttacaaatatttggacattttccaggtatcctgatgctattgaattctggctcaattttgttatggtcagagaatatactttttaatgatttctattcttttatatttgttaaagacaattttaatatggtctgtcttgatgactgttcactgcactgggaaaataggggtattccactgtcattgtgtgagttgttctgtaaacattaattatatccagttgacttgttgtgttcaggttattcttgatttcctatctagtctcaacctgagagaagaatgtcaacatcttaaagtacaattgtggatttttatatttctctttttggtcctttcagattttgcattatgtattttggaattctgttttagggtacatactcatttaggatattactgtgttttcttcatgaattgaccctgtatgtaaaatgcctccttattcctggtagtttctcttgttctgaaatccactttgtctggtactaatatagcattccagctttcttttctttttttttttttaatacagacagggtcttgctctgtcacccaggctgaagtgcagcaatgtgatcatagctcactgtaaccttgaactcctgagctcaagagatcctcccgcttcagcttcttgagtagctgggactacaagcatgtgccaccatacccagctaattaaaattcttttttatagagatggggatgtccctcgttgctcaggatagtctagaactcttggcctcaagctgtcctcccacccccggcctcccaaagtgttgagattacaggtgtgagccaccacacccagcccccagctttcttttgattaatgtttgcttggaatatcttactccatctttttacttttaatcaatttatgtcattatattaaaagtgtgtgttttgttggcagtatgtaagttgggccttgattttttttcaatcaagtctgacaatctctgtcttctaattggtgtgtttgggtcatgtgtcatgtatgttgaccctgtatgtaaaatgcctccttattcctgatagtttcccttggtaatcattgatattattggatttaagtctactgctttattatttttctattttttgttctcctctttcatcttttctgccctctctttgattatgggaatatgtattggtattacattttagcttatctattcgcttttgggtgtatattttcttattttttagtagttgttgtaaggattataatatataaatcctactttacaaagttgaaattttactacttcaagtaaaacctcaaaaccttaagccacataaatcctcttacacttttgctttatatttgtcatatgtattatatctacatacattaaaccctccagacaatataatttttttgagatggagttttgctcttatcacccagactggagtgcaatggcatgatctcgattcactgcaacctccacctcctgggttcaagcgattctcctgcctcagtctcccgagtggctgggattacaggcgtgcaccaccatgcccagctaactttcatatttttagtagatggggtttcaccatgtttgccaggctggtcttgaacccctgacctcaggtgatctgcctgcctaggccttgcaaagtgctgggattacagccaccgcacccggcccagacaatatagtcataaatattttaaagaacttgagtttaaaatagtatacatattttcccagatacttgccacgtctgttgttctcctttggttcctgaggttttgcatttccctgtggtatcagttctgtttaagaactctctttaggccgggcgcggtggctcatgcctgttatcccagcactttgggaggctgaggcaggcggatcacaaggtcaggagttcaagatcagcctggccaacatagtgaaaccctgtctctactaaaaatacaaaaattatccgggcgtggtggcacatgcctgtaatcccagctactcaggaggctgaggcaggagaattgcttgtacccgggaggtggacattgcagtgagaaaaaacaaaaacaaacaaacaaacaaaactctctttagcacttcttatggtgcaggtctgctggtgatgtgtcttttatttatcgtttttttttttcttttgagacagggtctcaacctgttgcccaggctggagtgcagtggcatgatcataccttactgtaaccttgaactcttggactcaagaaatccttttgcctcagcctcccaaataattaggactacaggtgcacaccaccatgctcagctactttttaaattttctgtagagatacagggttgctatgttgcccaggccagtcataaactcctgacctgaagcagttctcctgcctcagcctcccaaagtgctaggattacaggtataaaccaccatgcccagcttcgcctccatttgtggtgaatacttttgctgggtatagaattctgggtagttattttttgtctagcactttaaatttgttgtccactatcttctggcctctgtggtttctgatgagaaattcacagtcattcaaattattgttccctgtgtgttatgtgtcatttttctctggttacctttatgactatttctttatctttaattttaattttgatgcttaattatgatgtatctgagcttagatattagagattttcctgtttagggttcgctgatcttcttgaacctgttcatttatttcaccaaatttgggaaattattctttatggcacccatctttttcttcccctccatttcagagactcagttgatgaaaatgttagactttttaatatttcctcacagacctctgaggctgtgttcatttttttcaatgttttctttctcagactagataatttctgttgaactgcctttaacttcactgattcttttctctgtcgcctccatttgctattaaactcatccaatgaaatgtttacttcatgtattttatttctcagttctaaaatttcaatttcattctttttttcagtgtctgtgtatctgctgggactttttagcttttttttaaatttcaagagtctttacctttccctcatggagtatggttatattggctgtttaagatccttatctatcattatatcatctgtgtcatttcggagtttattctctgtttatcatcttttcccttgaatattagtcccatattctggttcttaggatgtacagtaatttaggattgtgtgatagacaggataatgggcccaaagctgttcacatgctgattcccagagtctgtgaatatgtcactttacgtggtaaaagggatcatgcagatgtgattaagcaggtcttgaggtggggagattatccaagcaggttcaccgtaatcacaagaatccttaaaagtagagaatctttctcactgggccagagaaagagatgtggcaacagaagaagggtcagagtgatgctgcatagctggccttggccctgagccaaggtgtggagcgcaggcagcctcttgaagctgggaaaagcagcaagatggttccccctaggcctgcagattctggagcacagccatggggctcctcgctttagcccacggagatcattccaggcttcagccacgggtctgtagggaatgtgtttgtgttgttggaagccatgagtgtgtggtaatgtgctacagcagtaacagggagctaacccagacgtcatcccggacacttttcacctgtgccctgaggctctgggtcctggaactaacccagacttcatcccggacacttttcacctgtgccctgaggctctgggtcctggaactaacccagacttcatcccggacacttttcacctgtgccctgaggctctgggtcctgaggcaccatctagggaatgtggattattttttgttttgtcttagtcacaggcagcccagtagtgaggctcagctcgcaggttctctctccttctgggagccttgtttccatatccgtttgattgtcaaagcctctgctgcacggggtgggtctgcccctgacaggcagtccttggggccttgggcacaggttcacgtcagtgcagctcaaagtgctttacgctgtgtctctggtgtgttccacacctgcagcttgggatgagccaggacacgtgtcagttcgtacacagaagcggggtcctgtctcctgctctctcctctgcttacgtcccccaccctgctgcctcctggggatgactcctggtcttctgatgagaaagacgatgtttctcttggggtcatagctgccattcctgctgcatggttctgtgcaaacaggcttgctgccaggacaaagtggtgagagaaagggaggaaaaaataatgaggattgccctcttcttgtacagcagggaccccattgtgggggtcctccatccacagggacggattttctctccaggtgcttatgtgcacacaaacctttgccacagcagccacgcaacaggcacacaacagccatgcagcacgtccctccacctgcctttcaccctgtctgctgagggatgaggcactgttggaggtcctgggacaggggcctgacctcctcagcctcttctgtggcttctgacagcagcagtggtaataccggtaacacatagtggtgatggtggtggacgctcgtgttttctgagtgtgatcgtgtgtccatacgctgtacctgccggaacttggcgacaccatgtcagcttcctggggcagccttaatgaatgactgcaaactgtgtggctcgaacaacaggggttattcttcacagcctggaggccaggagccaaaaccagcgccgatgggctgcaagcgaggtgttggcaggacgggccccttgacaaaggctcttggggagagtgtactccacaccccctcgcttctggaatgttcttcttgtgaatctgcatctctgtcagtgtgtctgggtacaaatctccctcttgtaaggacagcagtcatactggatttagggcccaccctaatccagtgtgacctcatctcagcttcgtgacatccgccactgtcctatgtcccaatacaggaaggtcacattcatgggtttggaaggaaatgaattttggaggacaccactcagcccagtaccactgtgcttacctcacagctctatcgtaccagacaggggaaagctcaggttggaagagctcagggttggggcagaaactcaggcctccccccgtcccgaacccaagccctgaactgctgtcgtacacagggctcagtgcgactgcgcctggggctgccccaagactgtgaagctcatggactcacgcagccatccatcgatggctatggggagggtacctgccattacctctgtttatgcttggggaaactgaggtgctgtgaggttgtatctgtcacacccttgtaaggagggagccggggtccccactgctgcttttctcccagggggagcctggaggagtggggtttggacacccggcaggtctcttccaaaccagggcgtctgcggtggccctgagccgaggctgcttcatgccaggcagccctgaggggccgagccgactggaggggcacagcctggcatggggcttggtgacatgaggagcgggggtgtcagagccaggggcaccgtcctcccattggccaggacgaggactaagctgtgacccctctgggccctgaagagcatctcgggggacttcagtttcaaacctcaaagccactgggcagaggttccgtcccgctggctggatggaaacaggaagctggcaggaggacagtgtggctgggccagatgcctgaggacacaatgctcatgacaaaagcagcaggtgcggagggtttccgccggtgcctcgcacaggagagaagatggagccgagtgaggacccaagagcaaagggccccaagcagttgtcacctgaacgggagggctggctggggctcagggctgtcctgggggccctgctgggccagacgccccatgagccacatggtcacagtctgggcacgattctctctcctcagggagaccatctgcggcagggaccagccgccccatgagccaggtggccatgctgacgatgccctggcggaggggagcccgggggcccagtggggttgtgggggtgtcgaaggcgggggtgagggaggggggtgagctggggctggacagtgagccgaggctccagcagatgcggctgaaggaacaaactttaagggaagaggctgtgaaccaggcagcatccacagtgcgtgagtccacgtaaagccctgaaaaccagagagatcgctgggaagtggcacagtggccaccggtgcccgagcgactcggatcacattctcaaagtgaatcaacgacaccaacatcaagccacattcaacgcgagggagccacgtgctgcgtagccggaaatcccaatgcgtgatgcagctggacgtgcttcagatgctgctgaacagtcgaggagcccttagccacccaggtccccccattctgtggaaaagctcgaggggctcttcctcggccctgcagaggtggcagctgggagccctggacaccgagcccgggcccttcccccagaccagcgtcagagcactgcacgcctccaccacaaggcctctggggggtctgacggcccagagaaaggaccagggcgcagatatggcggcccccaggacacacggcacaggcccgctctggcacctgcgccagcattgctgggttcttaaggaaagaggccaccgtgaaagacaggagtgagacccaacctgagaagacgagctggagggaacagagatgcacagaatgaagaaaagacagaggcaggaaaggaaagggtggggggaggggaagggagggagggggagggggaggggaagggagggagggggaggggagacaggacagaggctggaaaggacagtgatgcgcagaatgcagacaggacaggacaggaaaggaaaggaaagacagaggccagaaaggacaaagatgcgcgggacgaagaaaagacagaggccggaaaggacagaaacacacggaatgaagaaaagacagaggcccggcatctgtggcacaacgcggggactgcagtcaacggtaacttaatcgtacatttaaaaataacgaagagtgtgattggattgcttgtaacacaaagggtaagtgctgagggatggacaccccatcctccatgtgaccgttatgcatcacacgcctgcatcaaaacatctcagacacgccataaatatatacacctactgtgtacccacaagcattaaaataaaaaaatttcttaaaagaaagacaaaggcagctgtcatcaggatcctcggagaccagtgaaagcaccgcaccgaccaaatgaaaatcagtcgctgcagaaagaaaattcagacatgaaaacggctcaacaattaaaagcatgagagcaaaagccctaacgatcccggagaagcatttgacgttaacgctgaagaggtctttccatgagtaaaggaaaaagaggtggaaataataaagtcaggaaaatgagcagagcctgagagacgccgggggtcagagctccaggaagatcggagggcagggagtcttcaaggggaggttgagctggcttcccagagcccagggcatgagtttccgggttggaagttcctgctgggatctctgtgagattccacaccctcgtggacaaggagaagatcctaaatgctcccagagaggaggggcgggtttcatggaaatgatccagagacagagacctggatgcaggaggccgggaggaaacgcacaaacgccttccaacctggagttcacgcacacccgggggcagggtctgaggttttcttctttcaagttgtttctcggaaagcccctggagggcttctccaccagaaccagccacagaaggggtctgggtggggatgggagcccctccaggaggcagtggcagagatgggaactaccacccaggcagaacatcctcagacagacgggagaggccccagagaggctgggatggacaggaaccagtgcagggaaggtgcattcaactgagacttgggggctccatcagcggtggtgtgagtgagtacctgggaaaactaagtcagcaaagatgcaagcaactccaggccaacagggctgctcaggcagagtggaggattcagaggctgcacacacctgggtgacaggagctctgcggggggagctgagggcagtcatgacacagccagattaggaaggtgggccagagcgtgcacgggcgcagggcgaggcgggcgcagggcgaggcagggccagagcgtgcatgggcgcagggcgaggagggcgcagggcgaggcagggccagagcgtgcacgggggcagggcgaggcgggcgcagggcgaggcagggccagagcgtgcacgggggcagggcgaggcgggcgcagggtgaggcagggccagagcgtgcatgggggcagggcgaggagggcgcagggcgaggcagggccagagcgtgcacgggggcagggcgaggagggcgcagggcgaggcagggccagagcgtgcacggacacagggcgaggagggcgcagggtgaggcagggccagagcgtgcatgggggcagggcgaggagggcgcagggtgaggcagggccagagcgtgcatgggggcagggcgaggagggcgcagggcgaggcagggccagagcgtgcacgggggcagggcgaggagggcgcagggcgaggcagggccagagcgtgcacggacacagggcgaggagggcgcagggtgaggcagggccagagcgtgcacgggcgcagggcgaggagggcgcagggtgaggcagggccagagcgtgcacgaacacacgggtgcagggcgaggcaggcgcagggcgaggcagggccagagcgtgcacggacgcagggcgaggagggcgcagggcgaggcagggccagagcgtgcacgggcgcagggcgaggagggcgcagggtgaggcagggccagagcgtgcacgaacacacgggtgcagggcgaggcaggcgcagggcgaggcagggccagagcgtgcacggacgcagggcgaggagggcgcagggcgaggcagggccagagcgtgcacgggcgcagggcgaggagggcgcagggcgaggcagggccagagcgtgcacgggcgcagggcgatgagggcgcagggcgaggcagggccagagcgtgcacgggcgcagggcgaggagggcgcagggcgaggcagggccagagcgtgcacgggcgcagggcgaggagggcgcagggcgaggcagggccagagcgtgcacgggcgcagggcgaggagggcgcagggtgaggcagggccagagcgtgcacgaacacacgggtgcagggcgaggcaggcgcagggcgaggcagggccagagtgtgcacgggcgcagggcgaggtgggtgcagatgtggcaggtgcagacgcggcgtccacagccaggcctaaagacggtgtctgaagctggggaaacccaacagtgactcgttatgtaagcgtgtgacttagcaagacagaggaaaatgcccaaaccgccggtgagaagggctcaaagcagtcgctcaaagcagcaggaagtgatgtggcgggaaggctggttttagggacaacggctgagtttcggtggaggcttgcatgctgtgtgactcttcagacctggctcatttcacgtcgactcttcttgcccattacgtcatttcatcaggccttaccgcgactgcctcaggccttaccgtggccgccccaggcttactttggttcttggctgcttggactgtctcccccatgccttcattttctgcgtttccttctcggtgtaggtgcctcttgcaggtgacgggtcaagggatctccccccacaccaagcgccgtctttcactggggcccacctacttcttgtgattctttaggagctgatttctgtcatcctattttgtattttccattcactgcacatcctttgggttttttcctcccctaaccctctgttagataaattgagctttcttgaactgaaggtgcacattctgcttttgttctcatggggatgcctttgaaatgagagctttcaggttgatttgctgtttctcaggctcttctgcggtgatgttcccccagcagggcctgtgccggcacagacgcgtcctccggccctccccacgttggcagcacgttgactgtgtctgaagcttaatcccgatgtcacagattcttgtctttgcacctaacgttacgtgtctcatccagcccagggcacccgatcacgtcgctcactaaccgatccttcctcctcccgagtgttcctctagcagtctgctgtgggccttgctgtgaaaccttctgggcacctccacgagtgggagaacactgctgtgtcttcgtgcgtggacggtagccaggctgcacgcagagctccaggctgaagcctgtcccagtgtctgcagggccacgtggccttgctgctgagcctggtgggtctgctctttcctggaggctgtgctcttgctcttctgggagctattgcaatgttttattgttttatttgttttctttggttttttttttgagacagagtctcactctgtttcccaggctggagtgcagtggtacgatcttggctcactgcaacctctgcctcctgagttcaagtgattctcctgcctcagcctcccaagtagctgggattataggcgtatgccacaatgcccggctaatttttgtatttttagtagagatggggtttcaccatgttggccaggctggtctccaactcctgaccttaagtgatcagcctcccaaagtgctgggatgacaggcgtgagccgctgcgcccggcctattgcagtgttttctttctggtggtcgagagttttgtggcgacgtgtcctctgtgagttcttcccagccgaggtctctcatctttggttctggacattctgtgtctgtcgctgcactggtggtgtccctctccattcttgcttttatcttctggacctgctgttatccaggcagggcccttctgcagccaccctgctggctctgggtttcttgctggctctgtctgggtggcaggagggaggccctacaaggagcctccaggctgcagctttgtgctcagctgcattcctgctggcgaatgttttctctgctccagggcctcccctttcctccctgtgtgctggaaccctcttgtctctcccctttcctccctgtgtgctggagccctcttgtctctcccctttcctccctgtgtgctggagccctcttgtctctcccctttcctccctgtgtgctggagccctcttgtctctcccctttcctccctgtgtgctggagccctcttgtctctcccctttcctccctgtgtgctggagccctcttgtctctcccctttcctccctgtgtgctggagccctcttgtctctcccctttcctccctgtgtgctggagccctcttgtctctcccctttcctccctgtgtgctggagccctcttgtctctcccctttcctccctgtgtgctggagccctcttgtctctcccctttcctccctgtgtgctggaaccctgcttgtcttcgcccgttgcttggctccactttcctggctgtgcctcctgtctctggtccccgtgtgcgctggctccgattgggcctgtgtggggccggacagggctggccctggttgcgtggagggcagaggggagggcaggtgggcagggccagctcctgggtgaggagtttacctttgaagggagcaccgtgggagggagcacttttgccccgagtcctccccagcctgggggtttgcacaagaggagggagggtgggtgctggagctggcggtgcggccgtgtcaagctcttgcgtctccggatcttgcccctcaggccccggccccagcctcctgctgtcgccccccaggcagggctgtctcgaggcatcttgggagggcaaaggcaggacgggaaagtgatttctcccacctgtattttgactgtgaccccaaagcccctgccctgggccgtggctcccaatctcctccacacctaaccccagatagcccaagacttctggggttccctcagcttttctggggatcctgtcctcaagtccccctcctgccaggtggccgacactggctgccctgcgtccccattccctgaatgacactggtgcggaatgcagacagagggggcctgggagacacgagccccggtggtgggatgcagttagctgaacgccaggctgagcagggtccgaaaattaggggaataaaagtcccgggagaggacaaggtggcaaacaggaagggcagctgactcaccagcccagagcaggggaatctcaccagttccctgaaacagagcttctcagctccaggactggacaggcagcttcccagaggccactgcaggccaggtcatcagaagcgcctgctccagctcccaccctgcctgtgcccagtggcagccgagcagggcctcacaaaaacagctgtgagaacagccttgcgtgtctggaagccccaagccgctcggcagacggtcatcgggccgcgctgctgctctggtgtggtttctggaaaattcctgagaagtccccaggaaccaaagtgtccagcagttgaaatttaacaagtggggagacactcctccgccacaggctgctgtcctaaagaaaggcctagaagccctcccagctggggctgcgcacacgttcctgtgagggaccctttgggagaggattgagtgaggggaacaggaggtgaagcaaaagggatgagcgtccccttcctccagcttcctccatgcagtgatgttgcctggctctaaggggctcctggtacgaggattaggaggccatgggtcgtccagaaactcaggccagaagcgaaggtataaaacaccagatggtaacacaggaccacaactcaggaggctctgggagcacaaagtgggggtaccggggaaacgagcccgggagggtaagagagggatggggcagtgggggcctgcagcccaggagcgggagggtcccagcccccatgacaaggcggcaacccagacagaggggccccgggccttgggcctgtcctggccaggacaaatgcagggtatgccctcctgccctccttctgggcctggcacccccatcctcaggggaggcatgggggctggaaaggacggccgtgtggggacagcaggctgggagggggcatcccacacccccctttgtccctgactttagaggtgatgggggtggagaaccaagccccgcataccatggctggggtctgtgtgtctgggggtactgaggcgggcggccccagcctcaccctggcatacgccggccaccgtggagagagctccatgatgcccaagcctgctcctgcctctgttctgggcactttcccacaagccccacagaacacacttggcctcatctcctggcctggcattttctgccgcttcttcggcctttctgctaagagaaatccacgttttaccgtctgttgtagctgctgggcctgctgttccgaaactcctttcaagtggctttcatttcaggagtccatcagatgtatgtaataaataaaggtatggccagaggtttcaccagggaggaagcatgccggccctgcagctggcctgagagtgggcacagcaggaaggtagtccagctccccctgcattcgcctgcccgccctctccccgacccccacccgcccatccacatcccaggccagttccaggaggctggggacccccgcccagctgggtcagagtgcccggctccttgcccacctcagaggctgctgcaggtgtctggggcccacaccggcctctctgtgacttttagatctccaggactctccaccatttacccctactgtccatgttagcccctgaccatccacgttagcccctgaccatccatgtagcccctgaccatccatgttagcccctgaccatccacgtagcccctgaccatccacgtagcccctgaccatccacgtagcccctgaccatccatgttagcccctgaccatccatgttagcccctgaccatccacgtagctcctgaccatccatgttagcccctgaccatccacatagcccctgaccatccacgtagcccctgaccatccacgtagcccctgaccatccacgtagctcctgaccgtccatgttagcccctgaccatgttagcccctgaccatccctgttagcccctgaccatccatgtagcccctgaccatccatgttagcccctgaccatccacgtagcccctgaccatccatgttagcccctgaccatccctgttagcccctgaccatccacgtagctcctgaccatccatgttagcccctgaccatccacatagcccctgaccatccacgtagcccctgaccatccacgtagcccctgaccgtccacgtagctcctgaccgtccatgttagcccctgaccatgttagcccctgaccatccctgttagcccctgaccatccacgtagctcctgaccatccatgttagcccctgaccatccacatagcccctgaccatccacgtagcccctgaccatccatgtagcccctgaccatccacgtagcccctgaccgtccacgtagctcctgaccgtccacgtagctcctgaccgtccatgttagcccctgaccgtccacgtagcccctgaccatccacgtagcccctgaccgtccacgtagctcctgaccgtccatgttagcccctgaccatgttagcccctgaccatccctgttagcccctgaccatccacgtagctcctgaccatccatgttagcccctgaccatccacgtagcccctgaccatccacgtagcccctgaccatccacatagctcctgaccatccacgtagcccctgaccatccacgtagcccctgaccatccacgtagctcctgaccatccatgttagcccctgaccatccacgtagctcctgaccatccacgtagcccctgaccatccacgtagctcctgaccatccacgtagctcctgaccgtccatgttagcccctgaccatccacgtagcccctgaccatccacgtagctcctgaccatccacgtagctcctgaccatccacgtagctcctgaccatccatgttagcccctgaccatccacgtagctcctgaccatccacgtagcccctgaccatccgtgttagcccctgaccttccgcgttagccccgacattccgcgttagccccaaccgtacaccttagcccctgattgtccgcattagccccgactgtctggttagcccctgactgtccaccttagcccctgaccatccacataagcccctgactgtccagttagcctctgaccatctgtggtcactgagccgggtgcacagagttctattcagtggtgttcactcggcccctgctctgccctcggctcagctgggcttggacccttgcatcccaggctctccccagcaggcagtgtcagcacaggtgagggtcctgggcctgcccctggtggaaggagtgtgtttgtgccaaaccgggtttcaggcgccgtgcgtgccccaccccccttggctgttactccgttttaagctgccgacactgggaggaggcattgccgttgtcaccgatgggcttctgtgagaagggctgggctggcagggccttctgccgccaggcctgggtcctgcgggctccggaggccgtgagtggccctcagcaaactgtgggtctgtgtgtggccctggctccagcagccgcccccgtctgttctgggtggattttccccacccgaggtcactggtgcacctgggacccccctgccaacatgcccagcaccaccgtggcgcacctcattcctctcgaggaccaagcagccgcagctcccgctcaatgcccacctctcggcctcatggctgcttccctgccattggtttcctaccgggtggttcttatccccatgccaccttccttgtctgctctgaagcagctgggtcagcgcggagctccctcgggctctcctgggtgtggagccgcaggtgcagagggacggcccaggccaactctagccccagggtctctgaggccggggctggtggtgcaggacacacccagggcgtggggtcccaggcttagggatcggcaggggtggctccccaaccaccaggaccccggcaggatgggcctggcgcttctggagggagattcactgtggtaaccgtcagctgcctttgtttatgagttgtaagtctgcttcttgtgaagtgcgtttcacactcagggtgtttgcactcagaaagcgggtcctggttttaaaagcataagttttgttctctagaaaatgacatcaactttagacgtcagattgcctgtccagcacagccatttgccctccagtcacagagacagcgggtgctgccctgatcactggagggtgcctggtgctgctgctcaccgccgccctcacagacgctcactgttgccgtcccatctttcgcaggaggaaaccaaggcccagagaggtgaattaactcgccaagggttcgcagcaaaggtgagggcggaggcggcgtcagcactggctggtctctcagccagaagggggcccaggacaccgggttaaccgagcggggctgcagtgggcgtcaggagggactgcctgggggccgccatctgcctgctcttctagggccccggggcttcagtcagcctcccactctgtggccatccggccagctgcattctcaagaactgttttcaaatgtcggagctgctccgtggaagagagtcaagcctgcgtttactgtttgtgggatctataaacagccagttattcagctccccaagcaagagcgctgcctcgcacgcacgcaagccccatggagcggcccctgtgagtgatctgcctccaggaggccgggccagctgccccgacgcccgcccggtgcccgctcgcgtgactagccgccgtgttgtggctccgtaaccgtggcaacggctctcaggggagcacaatactcccaacttccctttactccgaggaggggcagccagggggatgtggagggttgttcctttttccctcattttccctctgccatgaccttgacaaaaataatctttgaagtacttgccggctattttttctgccctggaactggaagagatcaggatatttaaagggtttgacagaggaagttccggctttctcagaacgtttgccccattccctgcggtccctgggggagagcgtggctccagccctcacctgcctcggccctcacctgccccgacctccgttgtccttgcgaagtggcaggtgcgccgtttcctgacgttcagtaacagcacatggatgtgatctttttccccttaaaaaaagtagagccttaaccttagagccaaatcctttttccgtttggaaaagtgatctcattttccatggaccacgtttaaaaaaaaaacaaaacttttgtaggattagaaaggcagagggagagaaaacaaacagacgttcgagatgcatatttgaaagatgggcccacatgtgtaaaagtatttggcatgacaatgctggaccagaagtcaatctgatattgaatccatatgacacggcaaacagcattttatggtctttaaaaaaaaattctgccttgtgagttaaaattaaggttgcttttggttgtgactaatctcataaaatcttttttaagaagacattttatatactcaagccttgaaaatttctttggtctttgaactattattagtaggacatcatcagtatgtggcaaccgctgaattgggaaaagctgtggcaggagccggcgggcacagacctctcccagcagtgccaggaagggctgggggctgaggacccgaggccctggtgcacacccctccagcccgtgtggggcgggagtgaggcccctcagtgtcaccactgcccggctcagagcgggcagttggatggcaactctgttccctttcagcagatgccccccaggccacatggcccccggctgcttcacgttctcacctgttttctaacaaccccttggggtgcaccccacgtcatctcaccctgtctctgcctaaatccaaggggagggaggggctgcaggagtctgaggggtggatgccagcctgaggggccagcctgaggcacagtggtagtttgggtcccctagttccagacacagctgctggcccctaagatgggagccgctgtagagaaagggcctcgatgccacaggtgccggctctgggccaggctttctgggttgctccctgtctgcatcaccacttgcgaagggggtgggattggcccatggtccctccatggccacaaagtccctgacctccattggcgccagcccagggcctagatcttgctgagcacaggcagggacgatcctgggccctcgtgggtactccccacggtcaactccaggcaggacaagaactccaggagttccagggtgaagctgtgaagccagggcaggcggatgcggcggcgaaaggcaggtcaagtgctcctggcaccatcgttccacaggatgccagctctgcggggcacagagtgtgatttaaccctcgccgcagcttctgagtcaccgtttctcccaggtagggattgcagagaagagcaaagtgtcgtgaagtgatttcagcctgagctaccttccttctggaaatgcagccacagcagccatgttcccaaccaaagcaagggggcaaccaagcctccgttgacaggtgggtgggttagcaagaggtatctacctacagaggaggagtattcagccttaaaaagagcggggcagcaaaagagaaatacgcagacaggcctgcaccaaactgaaaaacttttgcccagcaaaggaaaccgtcaacacaatgaagaggcagcctatggaatgggaggacgcatttgccaaccatacatctcactggcgggaaagaccccacatacataaggaacccagccaactcaagaggaagaaaaaaccccattaaaaaccaggaaaaggacctgatagacgcttctccaaaggagacacaaaatggccagtttgtaggtggaaaggtgctcggcatcgccaggcacagggaagtgcaaatggaaaccgtcagcgagctcctctcacaccatcaggacagctgtttcaaaaagatggaaggcagtcgttgatgagggtgtggagagaaggggaccctcgtgcactgttggcgggaaggcagtcgttgatgagggtgtggagagaaggggaccctcgtgcactgttggcgggaaggcagtcgttgttgagggtgtggagagaaggggaccctcgtgcactgttggcgggaaggcagtcgttgttgagggtgtggagagaaggggaccctcgtgcactgttggcgggaaggcagtcgttgatgagggtgtggagagaaggggaccctcgtgcactgttggcgggaaggtagattagtgtagatgtgttggaaggctacatggagcttcctcaaaaaattcaaaatggaaaacggaacttccatgcaacgcagcagcccccctgctgggcatttacccaaattaaaaatggaacttccatgcaacgcagcagtccccctgccgggcatttacccaaaggagctgaaaccagaatcagagacaccagtagccaagacatggagacaacctgcatgtccaccagtgaatgcacagataaagaaaatgctctgtgtatacaccatggaatcctgttcaaccagaaaaagaagggaatcctggtatttgcaaaccacggatgaacctggaggacatggtgctcagtgaaataagtcatgcacagacagttctgcgtgatctcactcatatgtggaatctaaaaaagtggaactcatcgaaacagagagtcagtggttaccaggggccgggggtgtgggagggggataaagaaggaaggaaggaaatggacacgcactgtggctcggatccaccttgacgactctgcggagtgaaacaaagtcaaagcctgcttgattcgctcagatgaggtccccagtgtaggcaaattcggaggcagaaagcgggtgggacgtaccgggctgaggaggggagtgggggtgagtgtttaatgtggtcagagtttcagtttgggagggtgggaatgttctgaagatggacggtcatgatggttgcacaacaatgtggacgtgcttaatgccactgagctcaaaatgactgaaatttaaccacttaggtcgggtgcagtggctcaccctgtaatcccagcactttgggaggccaaggcgggtggatcacctgaggtcaggagttcgagaccagcctggccaacatggtgaaacgctgtctctactaaaaatgcaaaaattagctgggtgtggtggcgcatgcctgtaatcccagctactcgggaggctgcagcaggagaactgcttgaacctgggaggcggaggttgcagtgagccgagatcgcaccacactgtactccagcctaggtgacagaatgagactccgtttcagaaaaaaaaaaaaaaagtaaccactttaaatagttaaaatggtatttttttttttttactttctctcagaggcatatttttccgtattaaaattactgatgcagaacatttgattccttatcatttccatggtctttgttcaaagggtctctttcctgggtctcttgagtttctcgatatgccttctcttcctttttgctcaaaggacaaagaacccacattaaagcttttcctccttgaacagcttgtggcctagatgagaatgtagctattccaggcacagtctggagtatttgatgaaatatctcctccactttattttctgactcgtctacattttctgctttctttacagtaattcgaacttggtgttttttcttaatccacggctgaatctgtttagtctttgcatccaaatcatgttgtccagcgtttgaagaaaaagtcagttccgttgtcagggttggtccaggtttggggttacccttctccgtctctctcagcctcagccgttcctggtgggtctgcattcctgtcacgagctggtcttctgcagcctttgaacccgtcgcagctctcgctcatccatgagtctaatcacatctgctccatgcatgttcccaaatcattgcccttctcatcaaacatgtgaataattcgctaatttttcttccagtgttactaaaagctgtttcactcttttttttttcttttttccttcattctgggtgtcttcagtggtcctaaagccttttgcatgatttaggaaggagagtcttggggcagaagcaacaggggaccactgtgctggtgctgtcgtgcacggtgtgttcaccaaaacatctaacgcaactattttcagactttacggtttgtagtgataacctcttcagaaaaagagcaggcgtcctgggccggggcaggcgattggtactaaaatggtaatttttatgttatgacggtttggaaaaaactgtcataaaaattcactctcttggttgagtcagtaatacgagggacatggaagtctggccttggggggcgtcccagtcttgtcacatgagctaaaactaaagtccctaagaatcctccaagaaagatttcttccagctggtgggaggctggatgagaaggtgttatgtttttaggtgaaaatcggaggtggcgcaggacatggtgagatgattatccagcttgctaatctgccagcgggcaccacctgccattcctccttcgtgccttcgagtagcaggctcagtccattttgaggaggctggcacgaggctgtcttcacactccccgcggggtccatttcatgtcctgctgattaatccagctactgagaggaaaatagtgatttcctttctgtggatcatcccatgggcacattggatcctttattcagtgacataaacaactaagtcccaagtgttccatggccccctcccccaaagaaatgcagcaggtctgacatttccccatttctcttggggaaatctgggcaaaccgagagcttgtgaacagccccgatgggtccaggcagattcaccagactttctgctcacgacccaaagaggttagcatggaaccaaccctcttcctcggagctgcacgggaatgaaaatgtacaaataccatggttcatggtagctcctcagatgctcccgtggatgcagatgtcctgcggggtccgtttccctttctctagaaacgtggtggagttcagggtgataacgatgggcttctttactgatgccaaaccgtataaagcattggcctattttgtcaccgtggagcagcctatggtgttgcccgctgttttgttgtgacagctgggcaggggctccctgacatcttcctccgagtgggaggtgctttgtgagacttgggtttcttgctcagacgctcaacacagagttcaaatcccactgtgaagtcatcacctggcgcctgcacctctgtatccagaaccaagtgggcggcacacccttcaggtcggtgggagtgagggccttcgggtcgccggcacctgacccagcagccttgtcccaccgcctgcgaccaccagctcctccgctctctccatcggtcgtaacatcttactgctcccctcgcagactgttgagttggtctttgacaagtgtttcttttatattttcacggcacgtgtgacttttctttttggatactttactgattgaaaaatatggctttgcagcctagcaaggctctcggtctgaggctgcgtccttctggtgtggctttcctcctgaattaggcgtggtgtggcagcgtccagggaagaacacgcagcctctggtttgaactggaccctgggtagcagttcaaccttccccacacctgtgacacccaacaagatagacacagatgtatgaaacgctctacagccacccgaaaaaggtagaaattctgcaacaaaattaactggggaaaaaaaaactagggagaaaacgggaaaggaaaggcattgtccggaagaagcctcttgcagtgtggatgggaacctgccacagctgggcttgggcgaggggcccacggtgtcgctggggacttctgctgcccccagccccccttccttccagccagtggctctgtgagccgcctcttgtctgcatttcttgcaggaacatggagggaccggaacatggagggaccagtccagaatggccccacgtcaggagaaagagtccccaatccccagcccctacctcataggccaaatcactccatgtgggaggctgggaggcaaacatttttgtgtgagctagctactctgaacataatcataattgcattggtaaggaagaacaggaagttgtctcaaaataaagggggatcaggtggctggtccacttgttcttagaaggaaatttcaggaaaacgttaagaaacagaaaatactcaagctggttaggctattcaagaacatagaaagggatagaaagctgtttagttaattcacagaggttaggaaaacgctggtgcaaaaatacgatgcaggcagctcaaaggagaaacgcagccccttctcccctgtgaaactgcacaaaacaattccagataaaataatagcaattaacttccatctgtgttataaaagcatgggccactgcagtcacggtgatccaggagtaaggtgagaccccgacattgggaaatactcataaagttaacttaccaacttaatatactaaaggaggagagtgtcagcttgcagatgatcctgatcaaacaggcaataataacaaagtttcttaatagggcaccagttattgaaaagcctatctctgtcccagtgatttgaggtgacacctttttcatgcatcaaatttccatttgcgcttggacccatttctggatgttccattctagtccattgatttatgtgtctgttcatgcgccatgatttaattatagaggcctgacagtatttcttagatgtttaataagatgcttctgtctcctgacttttttctttcctgtgcttttgtagctatcattgcatatttattttcatatttagtataaacctgccagctgcgtaatcagtttggtgctatgtttattagtattacagcgtgttgataaattgactcaggaggagcaggcatctttaggatgttgactcatgcaagactgaggtgtgtcttcctatttgttcaaatacaattttttgtgtctcgagatgttttgaagttttcttcatataggttttgcacacgtcttaagtttatttataagtactttagcttctttgatgtttttgtaaacggggctttctctacaattatgtaccctaatctggtcatttttccagtttgtaaaggttatgggtatctgtatgttaattttgtactgaattattttatttgggttattttattttattttatttttgagacagagtttcactcttgttgcccaggctggagtgtaatgtcacgatctcagctcactgcaacctctgcctcccgggctcaagccattctcccgcctcagcctcccgagtagctgggaccacaggcatgcgccaccacacccagctaattttgtatttttagtaaagacagggtttcaccatgttggccaggctggtctcgaactcctgacctcgtgatccacctgcctcggcctctcaaaatgctgggattacaggcgtgagccactgagcccggccttacttgggttattttatcatggattctcctgggttttcctgatgtactatgatgtcgtctgcaaagagagagtttcacttttccccaattgttgtacatcctgttgatttttcataccgaattgcatcaatccatacctgcaatacaatgtccgataccatgggagggagttggcaggtttcttctttaaaggctcacatggagaatgttttaggcattttgggctgggctgtctccacccctggcactctgctttgtggttgtagtacgaaagcagccacaggcaatgaataaatgtgtgagcatggctgtgttccagcgaggctctgtttacaaaagcaagtggcaggccatattgggcgccatcctgggggccagggttgcaccccttgtatgggtggtggtgggcctccctaccctgttccttgatcttactggaaacaccttgagtgtttccctatgaagtcgctgccttaggaatgaggtgcacacacatacatgttacctgtgaagaaggtattcagtaattcctattttcctgagcctttttttttttcaggaataattgttgaatttcattgagggctttttcaccatatatggagataatcattttccccctcagatctgtaaatatggtcttttatgttaagggacttcctaatattgaactagcctttcatccttggattatatctgcttggctattggtgtattattttcctaatgtgaaactggagtctatttcttaatatttcatttagcacatttgcatcaatattcaaagctgatattggtgtgtcattttcttttttattttactctccatatcagagttaagtgtcaatgttatacttcttaaaaaggactacaaattttccttcactttctatgctctggaacaatttatggggcattgaaatgatctgacctgtgaagatctggtagaattccatgttaaagccgtctgggccaggtgcatttttgtggggtaattccttgataactttattccttctacaggagttgatcttttaagcttggtatctctaatggggtcgatttttataaattacattttcctacagaaatatatactttaggttttcaaatgtatttgtacataggtctttctcccacttttattcaatcacttgccctctgccacacccagggaaccactttctgatatttattactgtagattagtttggcctgttcttagatgtcatataaacagactcttaagtttatgagcttttgcatctgatttttatttaacgtagtgtttttgcaattcatcaatgtttttgcatatttggtaggtttcaattttttaaattgtctaacagtattccattttataattattctgcaatttgtttatccattatccgattgatagttatttgggttatttgtagcttttgattattatgagcaaggccagtgtgaacatcctttttccagcctttttgtgaacatacccatttcccttgatgaaatactaaggctggaacttctgggttgtagggcagatgtacacttgcctttatgtggaacggcaggacagtcttccaaagtgactgtagcattttacattcccaccaatcacactctcttcctcgccagtattcagtgctgtcggtctttctgacagcggccaccctggagtgtggagcagcagctctgtgaggttttaacttgcacatccctgatggctaaggatgctgagtatattttcatgtgtatgatgggcgttactctatctcttttggtaaagtatctgtgcaaacgtttgtcccatggtttaaaattgtttttttttttaattgttgatttgtagcagttcttacagattctggataaagtcctttatcaatgtgctgtgcatattttttctctgtggcttatctcttcattttttactggcattttaaaataaagcccaatttatcaagttttttctttacgggttagtgtttttgtatgctacccaaatctacctacctcagactcattagggcattttcctgggtttcttctggaagctttgtggctctgggctttgtgtttgtgtctgttgtaggtcttgagttaatttgtgtgtggcgtgaaataggagttggggttcatttttccatacaaatctccagctgtcccagccacgctgtttcagaccttccttccccactgattgacctagtgccttggctgagggtcagcttgtctatcctgaccttgtcctgctgtgaccagagctttataggaagccatgaagtcaaaataagttccacaatttcgttcttttttaacaagatttctttagcaaggctaggtcttttgcaattccataactattttattattttattattgtagagacagagtctctgtcacccaggctgaagtgcagtggcgtgatctcaactcactacagcctcgatttcccaggctcaagcaatcctcccacctcagcctcccaagtagctgggactacaggcatgcaccaccatgcccagctagtttttaaagtttttgtttgcttgttttttgtagagacggggtctcactatgctgcccaggctggtcttgaactgctgggctcaagcaatcctctcaccttggcctcccaaagtgctgggattacaagcataagccaccatgcccagccataaaaattttagaatcagcttgtcgctttctataaaaagaaaaaaaactttaaaatgatgattgggattgcattatatctacagatcaatttagggagacaggacaatcctaactacattgagcctttcaatccaggaacactgtgtatctctcagtttattcaggtattttctcagtgatgttgctttgttttcaatataccagtcgtgcacatcttttattagatttattcctaggtattttatgttttttgattggagcctggagttttctttgtaggaaagttttgattagaaattcaatttatttagtataaggttatttagattttctagttcttcttatatcacttttgttaatttgcatatttcaaggaattttcctgtttcacttaaattgtttaatgtattgactatcacttttagtattttcttattatccttttaatatttgtaggacctgtagtgatgtacttttaaactcctggtgtcagtgatttgttttttttttcttgatgagtcttgctagcagattatccgttttattaatcttttcaaaattttcaaaaattcaaattttgactctgttaatggcctttattatttgactgttctaaaccattttcatggatttttgactcttacctttattttttctttccttttacttaccttagatttaactgactcttctctctccagtttcttgaggagggactacatacatacttttgaaacagtcattttaagctcactggcatttgatgctgacccttctgcttgtgtgtaattggaggtttattacacttcctgtgtcctcattatgatgcaattttgggtctgtgtagctgcacctgttcttaccattctccgtcattttgtggaatgttgtgggggatttggatttaggtaactgccattatccttggctgcctaggagtcttcaataccagtatttcaaaagctcttagaaattgatacttataaaccctaatagaaaaattagcacatgacatacatagggcagttttccaaagaagaaatacaagttaccagtgaatgcaggaaatgtttttcaatgtcattagtaatcaaagaaatgaaaactataatggtaaaataatttatctcttttcagaaataatatatctgttttcaaattggcaaagatttcaaaaaaagaaaaaaggaaaataaaagtacccagcatggtccagatttaagggaaattagtatatagtatactgctgacagccacaaacatcatgggagttaaagtctccgaatgtctgtgttttaaagacacaaatggaaacatttatgaaagctgtgtccaggtgactcagccccctcacccccagcttctacctcgtgtgggatgtgagactgggcgagatattccacctggtagcctgtgcttgctcagcgtcagtggccattgctgccatggacagatcctgcgactcagaggccaccgtctttcgcgcatcctcaccggtgatggccccgggaagctgctgcagggtggggctgcgaggctcgctgctcaaataaaggaaaacgccacatcaagcacaacacagccacatccttgccttctccatctgctccctccaaaatcccacgatgattacggctgtgactaggatttaataatcatgcaaatattgtgaataacatacacgaatgaatttaacatcaagatgaaatgaatttctagaaaatattttaagatgccatagttaatgtaaaaaaaataaataacttgcacacacgaacaataaataaatcaacatagtattaaaatctgccctgtttcatccaccatctccacaaaatgtgcccgcactagagggtcttcagggtgaggcggaccaggccttccagaagcacgtcaccctcatcttaagcagctccagaaaatggaaggaaaggagcaggagtgactcgtgtcttgatggttgtgtatactgtatgcaaaatatggagagaaactacaggccaagtttaaacatagatggttaagtgaggttaatcaattccaaggcatattaaaaagtcatgatcaaaggggcttaccacatgaagtacaagaatgatgcatcatcagaaaatctatcaatcacacactaaagaaaaactgtgattctttcagcagatacagaaaaacacttgatgagttcaacatttttctctctctctctttttttttttttttttttttctgagacagagtctcactccattgcataggctggagggcagtggtgcgacctcggctcgctgcaacctccacctcctgggttcaagcgattctcctgcctcagccttccaagtagctgggactacagtcgcacaccaccacacccggctaatttttgtatttttagtagagacagggtttcaccatgttagccaggctggtcaatggacttcaatatttttcataataaaaatccttagaaaagccaaaggatatcccagacagtgtgtaggaggaggtacgtgggcagaaacgtctgcagaggaaaacagagagctcctgcctcgtcttaggtaccaagtctcactgtcgcgtcaagacaaggtgcacataattttatatttattagaaaaggggccttgtaaaccatggctgccttctcatgttgcctgttaacttggagcctgtgacaaaatggtaataaataaaaagtgggcatttctagaggttatgaatatggactacaaaacaggaggaaattgttgaaaatttaagcaaaggattcttgcactttttcattttgggtgagccaattcgatttttttttttgttttgttttttcttctagtctcttaatggctttgctctggtcgtgagtgcagaagggacgatattttatgcatcagcaacgatcgtggactatctgggcttccatcaggtaaatgaaaccagaatagccctccagtctgttaagtgctatgttgtcttccctttgtaaatgtttgttgtcgtcaaggtttgataatgtgtaaaatcaggcttttcctatcactgagctcttatcagataaagatctccacaccccagctttgtctagggcagtgtttcttccagcctgggttcggggtctcggcaagaggcttctcagtgttaggggtgttctggtctaaggcagccgtggcgtgcggacggcagcatggtctcctctggctcaggcactccgctaggtcccctgccccaccagcaccatcccattcagccgctcccaggcaacgtcttaagcctcagcttcttggtgcactcaggacacagcttgttgtggaaatgcccttcctgacgtgcgagtggttcatttggaatgctgcccagccagccccaggtggatgactccagacttccaggcagagaatggggttgaggcctcgtcagataccaagccctggaagggcaactcacccgggaaaaggtgcaataaaaaatcccacccagccgggcgcggtggctcacgcctgtaatcccagcactttgggaggccgaggcgggtggatcacgaggtcaggagattgagaccaggctggccaacatggtgaaaccctgtctctactaaaaatacaaaaattagctgggtgtggtggcgtgcacccgtagtcccagctactagggaggctgaggcaggagaatagcgtgaacctgggaggtgtaggttgcagtgaggtgagatcgagtcactgcactccagcctgggtgacagagcgagactccatctcaaaaataaaaataaaaaataaaaaaatcccactcaaggccaggaggggagcaacggagctgttttttttgtctggggaggagctggggtccctcatggaaaatcagatgctggttgtagaattaagatttctcccattgcacggcgaggacccccaggatctggaaatcaggcgtactgcagactgatagatttctggagaacccaaagaagcaaaaatggggccctttatctgcacttccacaagccactcccacaaaaatacccgccctgcaaatgagctcacaatgcaagttataaacccaaggaagccatagatggtgagcaggagccagctgacaggtaaacaaaccgtgcttcctggaagaacttaaggagcaaagccgtccaaaggaaactggcaaacaaatagatttaaaacaataaaagataacagcagcaatataaagaaagcacagcatatgatgaaaaaagaacaggtatgtttgagaaagatcaaaacaaaactttgaaaaatagagagtagtatattagggttcagtctggagacagaaactgtgcagaaatttgaacagttttatagaaagacttatgacgggtttagtgtaaggcagtgttaaccagtagcaccggctcagcaacgaaggactaaagggactctgaggacacagatacagcaacagaggggcagcagtgcccacagggcccaggcgggggccgttggaaaccccagccccactgaggctgagagccagaccctcagtggcacggggtggggccatggccggggcagtggagaagttcccaagacgttcaggccagggctggtaggaaacctccctttgggacccaggtgagatgcgcacctggaggccgctaggcgctgggggaagctgtgacactgcggggtgcacaccggccccaggggaagccctacccctgcactacccagcacctctgcctacgaggaaagggtcccagagccagcattcacgctgagccagaggcagcacacggtgattaaagcaaaaatctgcctggtcgggtgggaggcctaggggccgaatctgcctggtggggcgggaggcctaggggccgagtctccctggtcgggtgggaggcctaggggccgagtctgcctggtcgggtgggaggcctaggggccgaatctgcctggtcgggcgggaggcctaggggccgagtctgcctggtcgggtgggaggcctaggggccgagtctccctggtcgggtgggaggcctaggggccgagtctgcctggtcgggtgggaggcctaggggccgaatctgcctggtctgctgggaggcctaggggccgaatctgcctggtggggcgggaggcctaggggccgaatctgcctggtggggcgggaggcctaggggccgaatctgcctggtcgggcgggaggcctaggggcggagtctgcctggtcggctgggaggcctaggggctgtgcagagcagcaggcagtggaagccacgaaccaccccgctcgcccacactagtccctgacaagtcattagaattcacgtctgcgcaggccctgaggctgcacagttttatccaatttccataagagctgggcttttgaattttttcccacagctgaaattgctgctgccttgctggtgattctgcaaaaaaactcctctagtccgcctctaagttcaatctcctgcccctgagcccaaggccagtctccctgtgaactgcaaggaccacgtgactgccgggcccattgcagtgagcttgttttctgcaccgtggctgtgtctgcacactggatgcctccttgggatggcctctcccccagcatccacgtgaaggtgcagctcgtcagcacgcctgggctggccctggtggaggacgcagggggacatggctgtgtgcagggagagggaacaccgtgcagtggacatggctgccaaggggtgtccaggccactgccctgttgggaacgcagtgcagggtggagacacagctctgctgtcccagcagcgaccttgatggctctgagcctcatttcctgtgcccacacaatggccagcagcggtgtttgcctgccaggctgtggccagaccacggggccactgagcaggggagtgctgggaaaagccctggtgcccggcacggcgtctcctaccacagagtgacatcgctctaggcggctgctgttgacaccacgtgaccacaggctttgctgagtgtgccctggtatctgtggttggggcactgtcatctcctgatgcgccctgtgagaggggacctgaagtgacgcctggtgggtccctcgttcccacagatggcatcagcgtctgggtggccacccggcatcctcttcatctccatcttctgtgctcagatcccatggagctgccgtgggatgcttcctttacacgtgtggagagtagtggagtgggtccgttgggtccgtaggcgtttgctggggtttggtgcatccttcactgtggggtgccgtgaacgggggagcactcacagtacaggacatgggcggacatgacggtgtggctcgatgactttgtcaacttaaacagagcagcttcggcttggtctttttgtgcagggcccatgtctagagaaggtggcttggtccatatgtgcaggtcccgagtctagagaaggcggcttggtctttatgtgcagggcccgagtctagagaaggccgcttggtctgtatgtgcagggcccgagtctagagaaggcggcttggtctttatgtgcagggcccatgtctagagaaggtggcttggtctgtatgtgcagggcccgagtctagagaaggccgcttggtccgtatgtgcagggcccgagtttagagaaggcggggtctgtatgtgcagggcctgagtctggagaaggccgcttggtgtgtatgtgcagggcccatgtctagagaaggtggcttggtctgtatgtgcagggcccgagtctagagaaggcggcttggtctgtatgtgcagggcctgagtctggagaaggcggcttggtccatatgtgcaggtcccgagtctagagaaggccgcttggtctgtatgtgcagggcctgagtttagagaaggcggcttggtccgtatgtgcagggcccgagtttagagaaggtggcttggtctgtatgtgcagggcctgagtctggagaaggtggcttggtctgtatgtgcagggcccgagtctagagaaggccgcttggtctgccttctgcatgctcagaatcactgtcaactctagttactgcatcttgagctgccctgagttctccagatgcacccagagccgctgcctttagccatggctcgatggtctcaccccagggtttggctttggggactggggcaggtgctgtgcagagcagctttgattccaggtcagaacttgctaattggactttttgttttcttggcacttggtcatttttccccaagcatgagaagttaaaaaaaaaaagttttgccttgattatgaggaaattggttccaaatgccattaaatcaggcattgcctctagtttatgcaaaatatctcatgaaaaaattagagcagctttgtgcttgtgtgagcttattgtgcaaaatgctttacaaaaagtcaggaaccaattattcccagtcacagcatgagtgcatgatttcagtgtcttcaagctcagcatgcttagtgatgaataaacggctttaggcgtatattttagttgccattgacatttgttgattcaataagttgttcgttctctcaaagattagagctcgtcgatcagagcagttagaatcccacaggcatggttagcagatgtgtgcaagcttttgcacaaaaaggtaaaaatgttagctgctagagtgagcagcatattgaaattggaaatgattttattctaaactccctaagtggtagtgtaaaactaaagtaaagactgtctttagttgacgaaaggagggtttgtttttgtacggtttggataattttaacatcatgctctccccctcccatttctcccaccatgtctcttgatgtcactttgtaggaattagactttaaaagattaagaaagacttagggcagacatgccacactgatgattaaaacacagaactttgttccctcaacccaaacaggacttacatctcaccctgtcttcagatttgcctcagttggagaagtctttccagctctcctgcaccctcctccacatgtgccatctggcctcggttcagcagcagaccctttctcgcctgttgattcccttttgttacctgactgcggggttggagatgatggatgaggcactcggggaggcctgcggctgctcagggagggcacttggggtgggggtcaccttccaggggtctacaaagctcagggttgcctgtggaaactcatgcgagggccattttggtgtaggtcagcagggcgggactgcagctgctctggcgcaggaggcggcagactccatgctgaagaactggagagagagagctccagaagatgcagggcctcatgatctggcgcagcaccagctactgtgaggacagccgggtgcccatgcagcaggtgcacccaggcctccagcactgccatgtgcctctggcgcaagcgcaggtcttggtgactggtgagttggagaagtcccaggaccgcctgactgggggcaccaggcattacagtgacaaagccagattccctagatgcggggagtgagggctccaggtgaagcagcagctgctggccatgtgaccatgggtgcagatgaccttgtatgcctcatcctgaccgtgaccacaaagctgaaggagtctctctcttctattgggaaataagtctttgcctgtggtcgttggggctgagggcaagaatctattttttaaaaggaatgggattttttttttttttttgagacagtcttgctctgttgtccaggctggagtgcagtggcacaatctcggctcactgcaacctctgcctcctgggttcaagcaagtctcctgcctcagcctcctgagtagctgagattacaggtgtgtgccaccaagcctggctaaattttgtatttttagaagagacggggcttcaccatgttgaagccaggctgatctcaaactcccaacctcaagtgatctgcccgccttggcctcctaaagtgctgggattacaggcgtgaaccactgtgcccggctgagagttttagtcttttaagcaacatttataaatgaagaaattagggatggcagcaagtgtaaggggaatgttgcttgcctctggatgctggttcctctgcgtttcacttctaaaaaactggccctaaaacgtgtcaagagctcgcacaggagtgtttggagccatatttcccattgtcctggcaaagccggggccctccatggtgcccggctcttactgcacagggaccaacaggccggcccataagagctgatggggttggtatttctgtttgttgccaacccctgtttaccggaagtgtccccacaccattttccataagctgtgaaacaaatgtcataaggtctctaatttagaagggggaagacccaggtttctgggtctttgtttccttggttttgtgttatgtgtgccagggtgtaaagtggattttaagatgtggaattgggaggtagagtggtttagaataagaactccgaaaggttccttgtggatccccttttctggccatcgggatgtggatgtgcatttgttaaacttctcacacgctgcatccttcagcctggagaccctttggaaacacgaggtgacgccacggtagttattcagctaagcttccctctgacgggccctgaggctgccgccatagagcggcagaaccgtgcagttcctggaggagaagggggttttgattgcgaaatgttccagtatccagagtgaacactgaaggaggagccgttggctacttggtaagagagctgtgaagtcctggatttgggaaaacctgttttcatagaacaggatgggatggaagcctaaacccagcattccttactagcccctgaattaacagagcccaacgaagacaatcccctggcaacaggaagtcaagggagaaagaaggagccccaggctgggaggagtgcggactccccgagcaaaggaggagtgaccccccactgctcaccaaacactagctggggggcctttgcagttgaacggaggtggggcctgcagatgctgggcaagctgcttccctgcaggaggaagccagtcttgagtcctggctcacaccacagacagcttcagggcatgatggaagtttccagaagataacagggcagagctagacccatgaggaaacatttctcaggacaaaagccttccccatgtggagaggatggaagggttgggccttgtggtgtccaccaggagggcgggatggcagcggggacaccttgcatggaaggcggcccagaagggactgggcaaggcagctggacggctcagtggggattccagaaagagacacctccgcgctgcacgcacgcagccacgcagccacccacccacgcagccacccacccacgcagcacgcacagacccacgcacgcagccacccacccacgcagcacgcacagacccacgcacgcagcacgcacgcatccaggcacgcacacgcagccacccacccacacaggcgcacatacgctggcaccgctgaacagccaaaatatacacgatggttcttcttatggttcaggaggtggaaagttgaaaccatagcaagaaacgtggcctatccaccgcagcgactaaaagataaagagggaaaaggacaaacattggccagaaggtgcagcggctggagcgttcgcgccttaactggaagaggagccgccccgcctgggaggccgctctggcgcccggctggtgccgggcaggaggcccttgcggacccagcggcctcctcgtcggcaacgcccaccccgcggttcagccacggagcggatgccgtgtgcaggcacggaacgggcgaggctgttgcgctgcaggtgcccccacggtcgcgatgcggggcagggggatgccggtgggtatcatccctccacgtggagtccgcgcacagtaccagcccccacacggagggcggcccggactcagaggcacaggcagaagcagcctcgcgggtgccggcgatgccctgtggcctcatctgggtggggtcccgcggggtgttttcttgaaggtgactcacccaacggtgtgttcgtgattgggcgcattttggcctaggttaccctccagttacaagtccttaggaaggcaccatggcagagccgcggaggagtgcaccgcggggatgctggcgccgcccttttcacctcgaggggtctctgttcctctgttcaccgctttctgtgacagcgcattcacagaagggaactgcggaggcacagacagagtccagcccctttagtgagggccacctcctccttctgctctcctgaggctgtgtctcatcttgttcggggagccccgcaggtccttgccattgggttgcttgaagatgctcgtccctttagggtgagtttgttagttacattcctctgaagtcttgactcttaaggagctcctcctccagttaggaagaaccacttggttattatcacgataataaatgccatttagaattaggtcacccagaaagagtcctaaggttctagcagtccctggcacggttaattattcggggctggcgggtggcgggccaggctccaggtgcagatgcctgactttcttcagttaggagaagggagaggacggtgggatggccggccttcctcaggcgccgacacgctcactggcagtggtgacagctgagtaccccttgaagtcagtcttcgtggcccgcagtgtcagcctctgtcgccagacatggaccctgggtgcctgtgagggtcagcctctgtgtcagggcccagattagcttctgagcaggtggaaggagagaggactagagagaggcctgtgaactggcaggtccttgaggcatcgtgaaagtgggtgaaggttgaggcctgggtgtcaggaagaaggaaatcacaggccataagatgtgaagtgatgggaaaccgagtcacaaagagtccaagtcgacaggaaagtggatgtcttggccccagagtgtctgcggcccagaagatgcccgtctcttagcctcccgcttgccccgaaaggctggatgtgggcaccacttggcgggcagacgggtgggcgggtgctccaggcaacttagacatcttctcaggagggagtggggaaccggggccaagcgccgtctcttcggtgggattctctccctgtggctgtgacttgctttgacaagtggagtggaaatttttcggttactcgtcggtggaataaagtgtctaaagccacttggggtaaggctgaaataatcttgttgcgctatttcagacggatgtaatgcaccagaacatttatgactacatccacgtggacgaccgccaggacttctgccggcagctccactgggccatggaccctccccaggtggtgtttgggcagcccccgcccttggagacaggtgggtgtctggggtccaagtgagtcagcaaaacctaaagcaggtcccataacacatcgctgcctctggaaatgaccctgtcgcaccttcttggtgtgctttgccttacacattgaccttagcgccaaatctcacctttcttcagaggcctcctcccatgtccctccctgtcctctgattcggctgccacagctccgtgtggctcgagtgtgcttcactcctggttgctttcctgggctctgccaggcttgaggtcaccgccattcttgtcacctcaccacgagctgcagtcctggcctcttgttttgcaaactcccctcaagtctcacgtctgccaggaagtttcatacagtttgcttcatactagagttatccaataaaagtccctgaaagattgttgccattcagagttggttgccccttttcacagaagacccctgcacagggcttgctctcaacctccctgtggcgctgactgatgagataagcctggcaggtgtggagctccttgacaggcaatgacaggcgggggctgtgctgggacagttgcatctgggctctgaggagaggcgacacctgcccgcggtcctgtgcagagggtggctcctgggttctctcgcacgtatccgcagaagcctgaaataattcacggaaagtttccaccatgacagtatgattgaccttaaaacagcaaagcccaggcacctacatgcaagacccttctgtaaagctaaaaacaagcaagatgaaaccattggtccatcgtcatgcatgcacatgtactaaaaacgatgtttttaaaggcaaaggatgatgaaggcaaaatttgagtgacatctagagggatgctgggggcgggaggatggcacagtgatagggtttacatgacctggcgcgtgagagccgtgggcgtggttgtgcgtgtgacacgtgtgttttggcttctcccaccgccacgccccttggcccctatggtctgcaggagatgatgctatcctggggaggctgctcagggcccaggagtggggcacaggcacgcccaccgagtactcggccttcctgacccgctgcttcatctgccgtgtgcgctgcctgctggacagcacctcgggcttcctggtgagtgcgtgggtccctggcagggggctcccgacatctgggatgcattctaccctggtgtggaaggaaacagagggcaagagggggtgggggcgttaaaccacatgtccctggtggagggacgggggccggtgctgagctctgtgtaccctgtgatggtgtgggggtgttaacccatgtgtctctggtgggtgggagagggctgggcactgagctctgtgcaccctgtgatggtgtgggggtgttaacccatgtgtctctggtgggggggcgagggccggtgctgagctctgtgcaccctgtgatggtgtgggggctttaacccacgtgtctctggtgggtgggagagggctgggcactgagctctgtgcaccctgtgatggtgtgggggtgttaacccatgtgtccctggtgggggggcgagggccggtgctgagctctgtgcaccctgtgatggtatgggggtgttaacccatgtgtctctggtgggtgggagagggctgggcactgagctctgtgcacccggcgatggtgtggggctgtgacgcctctgggcatgcgtgatgagtcaaccgtgaggcctgctgtggtggacaagccaggtcgatgagaatgtaaaactctgcagtaggtttatactctagttgtacctttatttaaaacttattaaaatattttttaaaatgtgccccacatctgccaagggctggcaaactgggagagcctctggctgtggctggcgtgagtggctgagcccatggcatctgctgagctttttggtttcaccctcttctcttgcaaacagatacttggggttttcacttctgctatttgaccatttcttcttccagctcctcattgaatcagagaactcctccccatcggacatgtcagggcaaaggcctcccaccctgtcccagagccctgcccaccttgcagaccctccaggcactgtggtccccctggccacagcacagtcagccctgggtcatggcccctcagagccccagtggtggcccttgctgtctcctggctgcaattcaatgccacaaggccctcagaccccagcaccccacaaggccctctgactccagcactgtagctgggcaggccccctgggctcagctttccacccatttgtggacccatgacctcctggggaccttgggtgcagacggtccccatggcagaggtacctgtgggtctgcctgtttctgtgtctttcccacccactgggtgcctggtggaaggaccagctctccacaggccccagatctgttgccacgcacacgccccagggcacatctttcatttaggtagctagggacaataaagttttatttatttatttatttatttttgatggagtctcgctctgtcacccaggctggagtgcctggtgcaatctcggctcactgcaagctccgcctcctgggttcacgccattctcctgcctcagcctcctgagtagctgggactacaggcgcctgccaccacgcccggctaatttttttgtatttttagtagagacagtgtttcactgttggtattttgttctaaattttgaggaaattaagatacttacttttattggctaaggaatgttgttcgttttttaaaattgtataaccaattcctggttaattaaaaactcttatttctaggtgacccaaaattggaaggattttactgtgcagccactggaatatagtttaaaatggaattgtcaaacaaagaactgaatggaggaaacaagccagagaaattagattgatgctaaaatattgcaataaggtttacacaaatacgtgtctgattctgttttcccattaaaatccattcatccacagcaccataaagggctcctgtattgacacagaatacaccaagaccctgcaggacctcacggctcttcccggctttcaccctgagtggtgcagtcttggcaatgcgggtgtcatggaagctccctcatgccacccacagggccaactgaaaatggtagtttttgagattcggctgaaattaacttgggagcttgaaatcagctgtgttgggaatatttatactaaaaaaattggcaaacactgcatatctgggaatttttccccctggagagctagatgttaaacatttcccagcacaccgctgccttgaatccccaccaattatgtgactgctacacagcaggtgtttattatttgtttaatatatccatggacagatggaaagatggatgaatggatgaatggatggttggatagatgggaagatggatggatggatggatggatgagtggatggatgagtggatggatggatgagaagatgatggatggttggataggaagatgatggatggatggatgggaagatggatgggtggatggatggatggacagatggaaagatggatgaatggatggatggatggttggatagatgggaagatggatggacagatggaaagatgggtgaatggatggatggatggttggatagatgggaagatggatggatggatggatgagtgaatggatgaatgggaagatgacggatggatagatggacagatggatggatgaatgggaagatggatgggtaggtgcatagatggacaaatggaaagatggatggatggacggatgggtggatggatggatggatagatagaaagatggatgggtggatgggtggacggatggatggatagatggatgggtggatggatggctagatggacagatagatgggtggatggatggatggatgggaagatgatggatgcatggacagatggatgaatggataggaagatggatggatggatggatagatgggaatatgatggatgggtggaaacatggatagatggatggatgggtggatggatggatggatgggtgggtgggtggctgggtagatgaatgtatgggaagatggatggatggaaacatggctggatggatgggaagatgatggatggaaacatggatggatggatggatgggtggatgtgaagatggatgggtgggtggatggatggatgggaagatgatggatggatgggtgggtggatggatgggtggatggatggatggatggaaagatagattggtggatggatggatggatagaaagatagatggatgaaataaggatagagggtggagccacattgtggggtgattcttccatacaaggcaggagtacccctgaaggcccttggtaaacaactaaattatacatcagccttccctttgtagagagatattttattttcttatataacaaactcctagcttacttgctggcttttaaagtctcactgtacaccctagataaataaaatcaagtcgtgcctaaatttcataattacaaatgaagaattgataatttggaaatggagtgttaaagctgaaacaatccttggagatcatccactcctgcgaattcttgccaggggtttgccgctggcccggctgtgggcaggtggcaggtcccacaggcgcagttcgtgccacctgcgcatggggtggcacacatgaacaggcacacacgcgggaatgaacctgtcaaaggccgtcgccgcggctccagagaaactgggagtgggggatggtttcaggatgattcaagcacatcgaatcactctgcaggcccgggggtcacaggcttggcagctgcggctctgctgtcccgagccactcatggtgagctgcctccctacgaattccagccgctgtcgcgcccttgagttctgtgtcctgtgaccaccttgccaggccacttggtgaacacgccttcctctctgtctttaaaacaccagacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaagtgagtaagactcgcccttcacagccacatggtgcctgctggcggcccccacaaaacacctccacactcagtgttttctgtgtcttctttcttcatttccagccagtaataagtcagtttcgtgtcgtaaaagtcattacacaacataggcagcagcgattagatgaaacaatgtttttcaaactcgtatttgcaaactggcaccaaacgttgcctgtatcgattcattcctaaatcatcctgttacagaaccagtttcagaataagtgtcctgaccccgtgtcctcaagaaaatgcggagctggctgtggcccctgcctttctccatctcttggctgcccgcccttcacaccgtctgtctatggacaagtggaggtagttcccggctgcaggacatgccggagagatgcgtccctggtgggcagatggagggtgaacggcacagctgcccctccagctggtcctcgtccctggccaacccaggcctacccacagctccctcagcctttcagaagtagaaaacaccctgttggtccccgagcttgttggtactagggaccagtttggtggaagacaatttttccacagactgggagtggggggatggtttcaggatgattcaagcacattacgtttactcactatgcatttcatttctgttttattacattgtaatatataatgaaataattatacaacttggcataatgtagaaccagtggtagctctgagcttgttttcctgtaactaggcggccccatggcgggggtgggggtgatgggagacagtgacagatcatcaggcattagattctcatgagctcgaacctagggctctccctcacatgcacagttcacaacagggttcacagtcctgtgagaatcatgccccagctgagctgacaggcagtggagctctggcggtcacgcgagcagtggggagtggctgtaaatatagatgaagcttcactcgcttgcgcagggcccacctcctgccatgcagcttggctcctagaggccatggacgggtaccaatctgtggctgggggctggggacccctgcccttggggattcgtgtctatagtttcctagaatgtgttaagtctgccttgcgtgctgggagagatgcaaatgctgtgcctatagaaactgtgttccacctgctgggaacacaccagtgaggtagggccggggctgccaggatgccagagatccaacttcctctcagagaatcgtgcaggagtgaggtagggctgggccgccaggatgccagagatccaacttcctctcagagaatcttgcaggagtgaggtagggccggggccgccaggatgccggagatccaacttcctctcagagaatcgtgcaggaccccttccccggccacctgggcgagttgccgctcctgccacttcctcctgggacagcctgatggggcggggctgagcgcagggcagaggggtggtctgggccggccctgcccctgccccctggccctcagcccccgggtccttggctgtcggtgaggtgctcctgctctgtgactccgagacccacccgacttgtcctcggcccctcggcgctgcaggcccaggccctggtaaccaagtgcagctcagccttgccgcgcgatcctgcagccgccactgggcagcccgctttgttcgtggcctccccactctgtgggtagcaaatactgagtgggaaaggaatcttagcaggcgtcgaattcagctccccagccagcccagtgggaatctctggcatagcgcccaggagtgattggctgaggctgcacaaaccccacacggaaaacattgctgggttcagacagaaccttgagagcagattcttcgtggtgtgactcgaatctcactgcctggggttgccacggccctgtgttggctgagcgctctctgctctgtttgccttgccccgggttacggtttccagatatgtcctgattccgatgctcctcctctgtgcatggacagccccggggatgttcacagcagatggagctgtgcagaccggagcagacgtccccgccctgttctgggcgctgcctttactgctgtacctgctgtggcaggcgcgttggggtgatcttaagttgcagtcacgtgtgttgccttgtggtccgactttgaattctagctgcattccttaacttccattagtattcaatttcattttttagatgcggtcttgactgaccttgtcagagtccaggctcccgaactagtttgagatctgggactcagcagcacccggcacgctgccgtccctcctgttctttggcgcctttgacgggcagcacatcttctgtattcacacccgtgccctccgtgggagcaccaggacccgccactgagccccctctgggaggaccccgtcacacgcctgctggcttcccgatgcagaggatacggccgagggccctttcgccccaggggacctgcaaaggaggaccttggaggctctgggacgccctgctcagtgtccagggttgactgtgaagggcttctgtctgcaggccccaaggccaccttgccggcactcacggtggtctctgttgtgggcgtgagttccatcctcacctttgacctctttcagataaccgtttagacagctctacagtctgacagcagcagcggttatttgaaggttttcatgctgtgttggtttccacgttcgttactcatttctgcttatgagcagcttctgcctgggccctgctagccccacctcactgctgctgtctgagggtggacagagggcagctccagggacggccaggacacgggtcagcctgctgaggcccacacatctctggaaggttttaaattaaatgtatgtaccttattttaaaggatggaaatgtagagtgcaagggaggaacatagaattctaaagggaaaagaagtaaatgctacataggtgcacagaaaaggacctggggtctctgcagggctcgggcccaggtcttccggcacctacagggaccacgcaaaccctggaacactgtcctccgcttaccgtcaccgtggagtttccactgcacatggcaagcccggtcttccctgggagttcccaaccctagaagcagaggggacgcagccccctggtgtcagagcagggcagggcaggcctggccctgtgtgcgcacagccctgtcccggccctggggtggagcgtaggtgtgggatcacaagctcaggtgtggggccgaaggtcacagcgctcctcctgcggcctggacgagaccccctgtggggctgtgagggtggggtggagcccaaggcacataaagctggcacacaacttcagctcaacaaacatgttattcaaactcagaagggggaagaaaacttgccaaaccaagaatactgactcccatgagccgaaggcttttggaattctccccaccctgctctgagctggattcagaagccggctttcaggatacaccttgtggtccaccagtcctgagccgcaggactgtggtccagggcaccacagtggtgcaagatgcaaggtgcattctgcagaatcagagccctgaggcagtggcagcagcctccagcggcccccaacagcagcccccatggcccccagcagcggcccctagcagcccccaacagccccccagtcttccacagcttttcccacaggggttttgtgacatgatcttgatctgcctcttcctgaagcccattctgtgaattcctctgctcgccataattcactgggacccccatgtcaacacaccctgtgctttgcagccattcatggacatagatggggcattgtgagtcttgtgttagtcatgggcctcctggaggtgcccagaggacagagaggagggcagcaccggagctgtggctgtggggccagtcagatgggtttgaactcaactctgggacctgctggtggggcagcgctacttactgtttctcttttgaaaagcaaaagaaaatagaatctaccagggtgagttgttgggatttaagattcagatcagtgtgatgcgtgtgtgggtacacacacatgtcccgtgtgagttggtctccaactcacctcagtgttcacttcctggaacataactacctggagtcatgagaatggaccgtattttctttctggccttccaggaaaaaaatataagctctaaaaatcatcctatgattttatccttctactttctgaagcaaattcattagcccttcattggcctgaaaagtgacgtgacaatattttcagtaaacctgtaactgagaaaataactttccacactataaagaattaaacaagagtgaactattgtttctgtcttcactgctcaggtgtgacagcaatacctgtcattattaatttctaccatcaaaacatgtttcatccacatgtcatcttgttcatccgtcacatgtcacatgttcatctgtgttcttcacagagtaaaagccaccaccagtctgtgcgaatcggaactgcatggaaaacccaattactcagcaggtacttagaacatttcttatctgatcttttccacatgggtaaaatgtgtttctgcccttggagagcttccccgcccagtggagatgttggcgtattccatggaaaagccattttgcagagacttggtgtctgtcctgctgtggacaagtgccgttcctgggctctggtctgtgcatttctgaggagccgatgggtcctgccttgctgagaacaagcaaccgtcttccaggagctcctcagctcgcaccgtgacggcttcccccccctctaaaccccaacaggaaggagcagcagagagagcggcgttttggtgctcagggaacagactgacgctggccgatgggcacaggttcccgccagggccccatgcctgtgcctccggggtggccctgaccttgtccttgaccccaaggggggctcagggtaagtggtgccaggcagcctcccccagccctggcagctccctaagtcaccgtggaggccaaagagcgggtgggggagtgattaagaagaaaaataaaaaagacgacagcagccttggccaccacacgagccacagctaaccttactctctgtggagctgtccacacagcttcccggactggaagtcacgtgtgtcgctggggactgaccccgggaagcagtggtccagggatgttgggagcgaggatgccccgtgggctctgggacccgccctcacctgtcactcggaccctgggtcacccggctccaacctcatcttgcctttgctcagagccctctctcccccctctccctccccagggcctgcctgccacccaggtgggcctcctcccctttcctgaccagcccagctgtgccccacaggcccctccccactctccaggtcaccatctcacagtcatgcagtgccagtcccaaggcacgtggtgtcctgttggtcagcagcagagcttggccacagaaactgctggacatggtgttttctgctttgcagttccctgggaccatttgcaccgcccttccccacccctaacgctagtgactggtgtggctgacactggacagctggcataggcctcacagagacatctccctgaagcctgcaccctcgccccaccctgggccttcctcactcgccccaggcacgcagtgggggtggggtgctggcacagcctcctgggctgctgggggggttagaaggcacagcgcagtgaggggtcggtgtagcagccttggcagatttagcatcgtcctgatttcgtagcctcccttagagacccccacccagggcagccagacctggtgtcttcagctgctgtcaaatgggccccgtcttttctctgcagggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtga

SEQ ID NO: 36409 - DNA, 7081 bp, Homo sapiens
attgcaacttggtctcacagtggcttaggccagggtgggagcagtgaacggagtcacaaaagaaatttttcaggtagcattcacgggtgggtgctggattagatgcagggctaagggcaggggaggaagcctgggtaatggaaggctgcggggccaaggggggactgggaatcctggagggccaggtctgggggagagttaggaggtcgtgaatttggacttggatgcttgttgaagctgatgcatcttgaggacatttgtgggacacataggctgggtcagggctgaaagaggtgctggttatggccgggggcagggactcatgcctgtaatcccaacagcccaggaggatgagacaggaggaatgcttgaggccaaaatttcgaggccggaagttccagacgagcctgggcaacacagcaagaccctgtctctagaaaaggaaagaaagaaccgctggttgtggaagccagccatggcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacacccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacaggtaggcgcgggcctggcgcttgggggccccggggggcggtcaggggcgtcggcgggtcccccggcgcgggggcgagggtgccaggctctctgggtcctcgatcctggggcagccgcggaggttcctgaaccccgcgccttcagagcggaggccaagggggcacctggaaagtttggggttgctctgcagagagaacgcgaattgggaagggcggggagcccgagtttggggggagccagaggtgaggtcgtcgggggatgggacatcttttgttctcccggggaggttggaatgtggcgggtggggtggggggggggggtccggtgggaatggccgagacagagacgcagagagacaaagagagatcagagacgggagcgcgagggcgcgcggagcaagtttccgcggctgattgttcccagctgtgcggcgctgcaacatctgggtttctcccgccgggacccctccccctgagcccggctctggagccggcagagccctccctccgtctgatgtctgagcgagcgtcggggccccctgtcccccacctcccaggacgcaggggagtcgggggtgggggaggccgcagctgtggaagaggccagaggtgggggtggggcagcctcccaggcaggtcctggcctcccgcacgccccaaaaccccttcgtctagaagagctcggagatgtggtcccgtgggaggagttcatgaactccacactgacttctctctttcctgcctccccgctagcccgtgggcctccttcccccaataagcctgggttcgggggccagtcctaggggaggaagactccccgcagggtaccgacaggcatcccccaacaccttgcaacccctcttgccccaattcagcgccttctgctgagcagcgggggctccgaccgacctgacggatggggagaagggcaaggaaggctctctgggtcttttcatccccctcccatgaggaggtcaagggttttcagaatggggtgtggggagccagctatccctcgcctctggggcagcttggtcctgagcttcgtctcccggctcccactccaccttagtgaggtgcctaatgcatgagaggagccagggggtcaggaggcctcaggattgagaggaaggagggaaagacctcctgctttctcccctttccctcccctctccctggactcccagtggggaaaatagaccaaagttggggtttccagctagctctctgaaaggacttcctgggttgcagccgggaggggccctcctggatggaccccgccctcgcagccctccctacagaaggctgacggacctgaggtggccctccactgagctggggctggatgtggggaaccggaggctcccccaagtcccaccgtgtagccaggactggaggctgggctcttgaatgtcaggagcctgatgaaagccacggaccccatgccctctccctccaaatgacacacacacttgcctacagtgtcagggggtgcagaacccccagcctgggtgatgtcacggccccttcagtgctgcctttctgggatccagaggagccccctcaggcttcactctcgtgcttcctgctgctgcaaatagcccgggtctcgtgagcctgtgatgcacacagccaggtcttgcgaggcctggaggcctggcaggagaggagtcttctgggagctgggagccctgcccggcctggccgctctgggggccgggcaggcccatgtgtatgtggtttcctgctgagcaggatgcttagggcccaggggctaattgggagcaggtggtggcttggcagaagctgctgagtccaggcggtgatgccggctggccagggctggggtcccaaggatgggcctgggttcagtgattcacgcagtcagtgccttggacacccagggagccactgggccagagggctgagcacgggtgtgggtgaggacagaatggcctgggctgggagcacattaggaatgtccccttagtgagcagggcagggtccgcccttccctgaccacatcaagtacacccactacacggggtttgcttgtcaggatcagccctggagctgggttggaggccttgtcccttgtgacctgaacacctgggtgggccagcagggactgggatgtccctccactccagccctcccatgcctggcttctattctgggtgccaccttctccagggcgaaatcaggggatcaaaggtgagctctgctgtcctgggtgtggccctgggtagagctctcccaccggtctttccccagctgtcctctctgacaccaccccggcctgcctctttgttgccatgagagctgcctacctcttcctgctattcctgcctggtaagtggctcctggggcagggggtagctcctcttatgtggggctgaggagtagggttagtagggggaattcatagtgagcctttgtcacgacttatgaccagaactcagctccccagctcccagggccttctgcctgcttggaccacagactggaccagccaaccctggcagcatctggaggcagctcctggcccttcccccagccttccacagcagcaggcaggcagggttctggagggcacgtcccaggcacaaggactccgtgggcacaaggcacaaggcctctctgggagccgatgtgcaggtgcaggggcacccaaggcagggagtccggatgcttgagttctagatccattcagggcccttctgctctatacagtcctgaccttgtgggggtccctactggccaaatgaagagaatcaatgaggaccacaaaagtcctagcagggccaacattcattcattcagcagcgatgtgttgagtccctaccacgtgccaagtgctgggctaggccctggggattcagcgatgaaccaggcagacacatcgttgctcctcatcatgctgccagtccagggaagggagacaaataggaaacaagcagacatgagaaactccagcatgtgctgagtgctggacagaaatcagcaggagggctggtgggctggaggtggggcggcatcttggcacagctgaaattccagggaagacctgaaggagctgagcaggcctcacaggcccagggagtgtcaggtgcaaaggctctgagggaggcaggagcatgtggagtcctaggagcagccaggaggccagcaacaggaaggggcagggtaaggtcagggaggtgacccatgaccagggtggggaagggtctttaccatcgaagaagagtctggatcctctaggaatctgcttgtggggtcctaggctcttatgggcctgaccttgtgacccccgcctccactctccagaagcgcctcgggcccccgttgcccctcccgatggggtaccctacatgctttgcctccccacagcaggcttgctggctcagggccagtatgacctggacccgctgccgccgttccctgaccacgtccagtacacccactatagcgaccagatcggtaagggccttgccgggtcaccgaggcctggctgctcagatgtgcctggctcagccagggaccgcactggacacgctgatgggaactctgggggttggtccctggctcaggagggaacttgtttgccccaggggctgggggattagccttactcccaccaattccactttcatctttgtttgcagacaacccagactactatgattatcaaggtaacgggctaggggtaggataggacgggccggcagctggggtggggagaccccctgggaggggtagagggagcagacccccttatcctcccctggctgcagaggtgactcctcggccctccgaggaacagttccagttccagtcccagcagcaagtccaacaggaagtcatcccagccccaaccccaggtaggccccagaccctgctcccacccgtctcagctcctgcctcacccctccccaccctgtcaaccctgggagtgggggtctgccagggctgggagaggtgactccccttgccctgaggagacccctcccagtgatgtctgcctacctctgtctccacaccagaaccaggaaatgcagagctggagcccacagagcctgggcctcttggtaagggctttcttgacagctggaaaaatggaggcacgccctgaagttggggtggagtagggggtggtgctggtgggctggaggtctttggcccttgcccatgtgggctcttggcagtgtgggcagtatgactgccgtaggctggcatcaccaggccccccaggcagctccaggaggtcccacctgtccccagtgtgcctggctggaggctaaattggcagcctaggaaggcccctgacctcacagatactgggaggggcagggagtgtgctgggggcttcctgccagccagagagactgagtggtgcacatgtggaggcgaggaagggccagggagtgcaggctggctgagcggtgccctccggctgccctagctgagagcttgaaagaacaaggtgtgtgtgtgcaggagaatccgtgtgctcactctcgtgtgggttggtgtgagcgctcctatgtgggcttctgtgagcgtgggcacgtctgctcgggagttggtatgggcttttgtggcgatgcatgggtgggtgcaaatttctgtttgaacttaggcttctatagtaagtgcggttgtgaattgatacgtgaatattacagccctgggaagtctgacaatgctgcgtgggtctatgtgggcatgtgtaggtatgggtgtctgcacggggcctgaaggtacaggggggactaggccctgtgagccagcctcaggtgggtgaggctgggggccgccccccactctgggctcctagtctgaccccacctgtcaccagactgccgtgaggaacagtacccgtgcacccgcctctactccatacacaggccttgcaaacagtgtctcaacgaggtctgcttctacaggtgagcacagatgggcagctgtcgggaggattccggagcatggggggctagagggcacaggggacagctctggcccgccaaggtgggagttggaggaaagatagtgagtccttaagttgagctcagttctgtggttgagcctgggccagggacctcctccactcctgggctccagtgccaggttctgtccgggctcccgtgccaggttctgtccgggctcccgtgccaggttctgtctgggctatcccagtgggattgggtggaagtggggctgagacctcccgtgccctgtccccgcagcctccgccgtgtgtacgtcattaacaaggagatctgtgttcgtacagtgtgtgcccatgaggagctcctccgaggtaggaaggccacctccccaagacctcccctgtccccacacccgcatcattatctggccacctagccacccacctgatgtttattcaacacatattatccaccaggcccacttccaggacaccctgagctcccctccttgctacttttcatcctcaaaacactcccatcaccagagttgggggaggggcagcggttcccatcacccagctccaccctgaccctgcctccttcctgcccccaatagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacaatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttac

SEQ ID NO: 36410 - DNA, 11364 bp, Homo sapiens
gggggagggaaacggagcagtgacaggtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcagagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggtgagaagcgcgaggtggaggctgggcggagtagaagggttttcgggggcctgtggggtagagctggcacgctttttagacctgtaactgctgcttctactctgattgactatcctgcccgttcagttcactagctatcgtttgtccaggccctaaattcccaaaatgtacaaggaggcaatacagtttcttcttcctttagacctggcactccaaattgactcccttactcatgggactagttgtttattcgtgaaaagaaattgctcttcaaaccatcctcttcctttggttttcacgctctgcagtgagggccaaagctaaattcgcaaatggcaaacccacttttggaggggctcgactggtaatgctgaaaattattcagacattggctacttaggacagtggaactgaacggatataaaaggagatcgacatggatacaagtggagttaggaagttttgattgggtcaaagcttcacttcatttgatcaatatcttgtatattgtgtaattgtttttgcttctgtgtgtgaactagaatattttgaattagttacacttcttagtttactatttaaactattagacttttagtttattttagttagccacagatagatgggacaagaactagttgatgcctctgatcccagtcagaatttaggatgacagattgatactcactgggtttattttaaagaaagcaaaacaaactaaaaaacgggtggggggggattacagggatttactttatactaattgccaatatttaaccttgatttgtactaaaaaatgtttaattttgtgtgacttagatgtgatcacctggattctcctcattagaattcctagtgaaatgtagtgggtaccctaatcaaatttatctgtgaaatcagttttctagggggaaagtggggagggtggggacaaggtctgcttctatcgcccagcctggatagtgcagtggcgatcttggctccctgcagcctccgcctcccaggttcaagccgtcctgccacctcagcttccctagtagctgggactaaaggcatgcgccaccacgcccggctaatttttgtattttttgttgagacggggtttcgccatgttggccagggccagactggtctcgaactcctggcctcaagcaatctgcccgcctcggcctcctaaagtgctgggattacagacgtgagtcactgcacctggccgtgtgaaatcaatttttaaacgttaaggtgatgaaagcaaactttaagctcagtaaatagtggattctctgttactctattttagtaacatggattcttggtggaatcaatatcaatagttgctgcacggttataaatattttttattaagttgtaccttgactttctttagcaattcattacatggcttgtgttccaaggcttatgtgaaatgattcgtttttcctaacttttttttttttttaatttacaggcagagaatatgttattccatccttggcccacagatttatggcagagatggtggatttctttattctcttctttataaaagcaaccattgtcttaagcattatgcacctcagtgggataaagtaagttgaggacatttgcagaagggttttaatttctactgtttaatgatcttgttttattacattctgtttgtctacacgtgactatatggataatgggcttgtcagtgtcatgatttctttataagagctttgttagatttattgttttcttgttgattttaagaaataactagaaaggaaaaaaaatagcttactgaattctataagatgtgtgggaatctcacctatcaaaaataggtaaaaagagcctccaaacctgctttgattttattcacctattcttttaggccaggaactaatttacctctcactatcctgttccctcttgctatcttgtggagtctctaaagacaaaggtataaagagcttttggtaggtgaattaataatcaactagatggcatttccaaatgggattgcacatactgtggggcaagtcccaagtgaacttcaaagtgagacgtttatttgagtaatccttccagattaacaataatcataatagcagttaccacttcctgagtactttctatatgccatgtattgagcttgctcacttctttatgtggattcttatttaatcttaataccaagatgaggtgtagagattaataccaccattttatagagtttgaaatttgggtttatgaaaagttgagcacagaacctaaaatgttacaaaggtagtaagtgacagagtcaagatacaagcctgtgcagtcaaatttcagggtccttgccagaaacctgttactgtgattcctccctgtccctccctctcactccactccacatccagtgaaataccaactcctttatgttcaattttctgaatagctttcaaccccagacctcctcactgccagatcatttttctttttttgagacagagtcttgctctgtcacccaggctggagtgcagtagtacaattatggctcactgcagccttgatctcctgtgcccaagtgacactcccacctcagcctcacaaggagctgggaccacaggcatgctccaccatgcctagctaattaaaaaaaaaaattgttttttgtagagatggggtctccctatgttgcccaggctggtctcaaactcctgggctcaaatgatcctcctgccttagcttcccaaagtgctgagattacaagcatgagccaccacacctggcccattttttatcatcattgcttctccctactccgattactgtcgtctcttgcttggattatagcagaagccttctagtggtaactcagtctcctgttttatctcaatccagtctctgatataaaaccaaagtgatcataaatcctggttctgttcctttcctaccttaaaacccttcaatggtttctctttttaaaatgtttattgtttttttagagatggggtctgtgttgcccaggttgctttcaaaatcctaggctcaggcgatcctcccacctcagcctcccaaagtgctgggattacatgcgtgagccaccatgctcagccccttcaatggtttctctttaccagcaggataaagtctgaatttcatcatgtggtttatactcaggaggctgtctcaacctcccaagtaggtgggactgcaggtgcataccaccacaccctgcctttatttcttaatcactgccacctctcacatttagtatatgagccacaccaaactgcttacagcttctatcatattctctctttctccaagacattctctcctgctgttccctctttctggaacgttatttcctcttcttagtctggctaacttctcttcatccttcagagcctcatctaactgtcttttctgggaaaccttcacaaggttaagtgtatctggtgtatgtttccatagtatcctaggttccccatcacagcactcatcccactttattattgctatttatttattgttctgttttctttgctaggttagaccctccacgaaagcagggaccgtgtaaattcattcacccttatttcccccgtgctagtacagtgtctgctcatgataatgctgcttatttgttgaataaactaatgaatgctttatgatactagatggttgggaatctaaagattagtttagaatttcaattaaaatgtatgacttgcactaatgaaaaaaaagtcagtgctactgttctggtaactaattatttataaccccaaactattattttgtgtagggatatctctaagtttgctatgcattatataatagaagaaatagatgaagacacatcaatggaagacttgcagaaaatgatggttgtggcacttatatacagattattagtttgtttctatgaggtaagctactgacttcagcaagaattaatatttaacaatctaattttatgtttttacatttatttttttgagacagagtctcgctctgtcacccaggctggagtgcagtggtgtgatcttggctcactgcaacctctgcctcctgagttcaagtgattctcctgtctcagcctcctgagtaggtgggactacaggtgcataccaccacacctggctaatttttgtatttttagtagagacagggttttgccatgtaggccaggctggtctcaaactcctggcctcagtgatctgcccaccttggcctcccaaagtgctgggattacaggcatgagccactgcacctagccaacaatctaattttagattatcagcccaagacgaaaaagtaatcgaaatttataattattcatgtcttttccacatgtctacttttctgttttttttcccaaattttaactaatcattaagtaaaaacttttggaagagagacattttacaatttctttgtaatatttttcagtcttagaaactcaaataaaatttcacttatagattgtggtccaaaaatatacttgtaaattgcaatgtagttttctgcagaagcagcttactagaaagtatagtagtcatagagaaatattacaggagacagacatcttgtggtattggacatgttagagacctacagaaatgcataaagttaaatggttaacttttgagtattctatgcaattctttcaacttgaaaaatttaaaacatgaaataatatggtgggaaaagtttatctttaaaattggtatagttgagccagtaatttttaaatcatccttctttccttagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtaagtccttttcttagcttaatctactacatacttaatgaaaataatgtgttttagaatattggggtttttttcttcatagtagataggcttatatttattaagttaaaacaaagtttgaatatttatttcagttgtgttacatgattgtagacctcttttacagtacacattttcaagatgatttttttttttttttttttgtgagacggagtctcactctgttgcccaggctggagtgcagtggcacagtctcggctcactgcaggctccgcctcccaggttcacgccattctcctgcctcagcctcccgagtaggtgggactacaggtgcccgccaccacgcccggctaattttttgtatttttagtagggacggggtttcaccgtgttaaccaggatggtcttgatctcctgacctcatgatccacccgcctccgcctctcaaagtgttgggattacagacgtgagccaccatgccctgcctcaagatgatcattttatgaattataagtcacaatacgagaggatgatttgggtgttgatggtgtattagtgctccacaatcagctttattattctttggacctgtggatgttaggtcaggtactagtctgccttgagtctccatttggccatgcctgtcattattccatcttgaataggcagcagagttttgacagctatgcattcgtgcatccttctcctgctgttaggtgagagcttgtaatactgccagtattcaaggttagctgttggcatctagcgctgggggaaggtacaaccagtgataatggaaactgtggaggtcagtggctggtagtcagttgagccaaacaaggtattggctgcaatttttgccagaatgattcagagctggattgttacatcaagaaatataaacaagtgattctagaaaccttggttttgccatcttcaaatttttcttaaaatttggtagttatagccgggcacagtggctcacgcctgtaatcccagcactttgtgaggctgaggtgggcagatcacgaggtcaggagatcgagaccatcctggctaacatggtgaaaccccgtctctactaaaaatacaaaaaattagccgggcgtggtggcgggccctgtagtcccagctactcaggaggctgaggcaggagaatggcatgaacccgggaggcagagcttgcagtgagctgagattgcaccactgcactccaacctgggcgacagagcaagactccatctcaaaaaaaaaaaaaaacaaaacaaaactggtagttataaacctacctacttcttttaataagagtcagtaatggctaatgtttattgagtactttttatatacctgcactgttaataacactgcatatgtattaatttaatgctaacaacctcataagatagagactattgatctatatctatagtatcataagatactataggtagtctctatctatatactataggtagtatctatatactataggtagtatctatatactatctatagtatcataagatagatactattgttccctttttgcagatgtggaatacaactagtaattggtagacgatggatctgaatttaactagtctggattcagaacccacactcctagccactgtacttttctgcagcccttcagtgcactaaaaggcagaaatctaacataagtaggataattctccatcctgagtgattgttgaaagcttttaaaagctttgcttaatcactggatcccacaaaggaaaatgctgattaaagaacacacagtactttaaaatgcatgttttttctataaggtagacaaatgggactacagtaagcatactcagaaagtactcagaattaatgttcatttcttctgagaaaatactagaaagctctgtaaaccattaattcaatattctgagacatgtttattactgctttttatgttgttgaagtcttattagaaatagcccaggtggtttgatcatgatacagtgctacttgaaaatatatcaaaggtaaaaattctctcaactataccttgaatgtctttttccctgtagacttctgtagagaagtacaattgtgttttaaatgtctattttgaacttgatgggataccattaatctatatgtggtttgatgtgtaacttacctgatatttttgttttaactttttaggtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaactgaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgc

SEQ ID NO: 36411 - DNA, 22211 bp, Homo sapiens
cggagggcgctcatttccgggccgcccaccacccgcgtagcaccggcagccgctgtcccggcagtctccagccgtcccgcccgcttgtggccaactggctccagtcactccccgaaatgccagtcgacttcactgggtactggaagatgttggtcaacgagaatttcgaggagtacctgcgcgccctcggtaagcgctgcccgctgcgccctgggcgccccgccgagcagctccgggccgctccctagagccctcccgagacgctgcctgcctgcctccatcccggcgagccgcggtccggtgcccccggacgccagaaagggcgtcctcggccaccgctcccagggcagcccccaggctgcagattggagaattcggggttgttaggttaaccggtggcaaatgtctgctcgttggccctggaggtgggtaatttcattagtaaatctggggcttggtttgctactttttgtttttaaacggttaacataagagcagaaaactttgttgggggcggcaggggaggcacaggcaggctgtgcgcagagacaacgcaaagccagcgggaaccctaacagtgttcgcgggcggagagggctcctggggccccgctaccttgggaacggttctctgagtttccctgccaactctctggcgctctctctctccccgttcaacccccaccgcagacgtcaatgtggccttgcgcaaaatcgccaacttgctgaagccagacaaagagatcgtgcaggacggtgaccatatgatcatccgcacgctgagcacttttaggaactacatcatggacttccaggttgggaaggagtttgaggaggatctgacaggcatagatgaccgcaagtgcatggtgaggattcgcgtccacctggtgtctcctgcccagggggcctgaccaagggctgggctagttcatccgagagggggcaagggcctgagggactgaaaactcttcccactctcagcccccatggtgggcagcaccaactcatgaagcatcctgctctatctacactggaaggtgatggttatgaaggctgccatgtgctgtgtctccactgcgttcaggcactctgcccggtgctttatgcacatgacttcacctaagcctcacacagcctttgagggagatatgaatatgcccattttacagatgaagaaacagtctcaaagagatgaagtaacatgtccagagtagcacagctagggagggtctggagttcaaagcatgtctgttgatgccgttctctggctgactgggctggtggagggtaaaagaaaagaaaggaggaaagaaaaaagaaacacaggtaacccctttgaagtgtaaactttcagtatgacttagtgtgaagtcactccaggaagctgggggccccttgatctctgctggaagccccctgatctgcccatccttgccccagagctgggatttggctcctggccatcccctgccccaccctgtcatccaatgcctactgagcattctttgaactttgcagctgacacctattcagtaagtcagggcccctccagcccagaccagaggaaacagcagtgggggaagagggagggccaagagctcccttccacaagggtgggaaactcctgacccaggacatcccaattagtactgccacagcagatgccggaaggccagccccaggcctccatcaacattatctggttgctgggaggtcaaggtactcttgttctccctttatagtcttgggttcagaagtggcttatgttcatcccaggagccaccttgcttattgatggggtcctcacccaccacctcccaccatttaccaagggtctttaccgctggtctgctgtgtgtccagcactgtgctagtcatcttacagcacagcacagtgagggagggataagtaaccccatgttatgcagtgactgaggctcagacagaggaagagacttgtaagagatgagacttgagccctgggccttctgatgttgaagcccacagtcctgctttctgccagcttctctgctggtagtctgtgcagaaacaagatagctgaggtctgttaggattgtagttgaagggatgcccatgtctgggaataggcatctggagcctggatgactcatccccccaccttgtctattcatctgaaggcagtcaggattggtatctgagtctgctgtttggaatgatgggaaagagggggtagtcagcagggagtggccttggaaggaccactaatgggagaaaacaccattgttgcagagaaatgtcaggttgtgcctttaaaaatctcaaggactcttaatctgcaggaaagactcacaataggaaaggagaccttcagatggcatctgcctttctcattactgcccaagacctgctccccggcacactgcatggaactttgctccttaagaataatccttacccccactcactattgtggaactcacagatcacatcgaacctttattttgggtcaccacaaatctggcatgtgctggcttgtactaattatcttcactctttccttcctttcttcatccattaacacatgaaacatttattgatcacctagtaatactagcaaatgcagtactcatcaagtgcttactgtcatgccagatgctattcaaacgttacattagctgacttaatcttcacaacaccctttcaagcctcattttacagataagaaaaccactgcaggatttcttgctgtgtgaccttggggaagtgcagagggaggattttagttaaccactgccctgaacatactgcttccctcacgggctggtcaccacggcaggcacaggacagcagagcatgtcacaggccctgatgtccaggaaagcaaagtctttgcagtggaggcaggcacaccaacactcgcaacacagtgtggcaaagaaaagcacagggtgggagtgaggggatggggactacccagagaaggggatcccagaagaatttctgaaagaggtgacttctgtgcttcattgtaaaataaagcagggaggtagaagggagggttttggatacaaaggaaaggacaagggccaccttttcttctcactacagcatcagcgtcaatcgagcatcaagcagtagtcgagcagaccgtgcagattcagccactggacgaatccagtgaaactggtctaggatgcatggttactatcactgccccaggactcagggatgcccactctcaagtagatagccattcgctcacctgttgtggcctgttgggagatggaacagcctgtctgctctgctcaagccttcgcctagccccatgcagtacagaaaagcccttctctctgggctggccgctgggtggtatgctgctttggactgccggaaggacatggctggatgggggtaggatgatagaattagagcagctgtcaggcctgagacttgtgaatggaggggagctgggtacccagaggccaccagctgggctctctgagggccgccaggggtcctggacaaggtggttgccaaagatcactttcactgctaccccctctgcctcacacactgggcacccatcagccaggagcagtggcccagaggagtttgttcccagcatattacaggagtcccattctcacttgggatcggtcattcgtctatttttttcattcctctctggacaccacaagcatctcatggtgcttccactatctttgcaacccctgtgtcaatgagacaaatcacacacgattcctgccctcatggagttcagtgtaaggaggaggcaaattgaagcagccaatcacgacgtagtggacactgtgctgatacaggcagagaagcactccctgctcggtctgagaggtcagggaacgctcccacaggaattggagtctgaactgtggcttataggatagacaggaagtagccaggcaaacagaaaggggttgaaagaaaggccacggccgaaagctgtcccacaccaagccctgggcttggccctggggtcgcagaggcaacaaggccttctggacacccaggccagtggaggagacaggcacatcttcaggccattacagctcaatgcatgatgggagcacggtgggctggggagcatacagctgggagtaggaaagcagtggtcagggaaagtcccagaggaggcgacagctgagaggggccttaaaggactaattagggcagatgtggagaaaaggataagagctttccagtaagcgggaaccacatgtacaaaggcccagggtcagaaaagcctggctgggagggagtttcagaggtgagagaggagcagtctgcgaagacttcagcatgcctggagtgcaagatgtggctgggagagaagagagccaggagaacctggcagggagacttgatgtgaccctgacaggcctctgtgagtccttgctgggagaggtgtggccaggctgacatccctccccaaagggcagaggctctcactggctgagagatctctgatcctgcctcttttccatgggaaccttatctgtattctagaactgcagccagagggtgaaacccagcctgcagatgtgttttgtttggcctgtacaatgtttgaaaagcttcagagtcagttgccaataattgccaaagattgtaagatttcacagaaaatccgtatttctggctgttcttaacaaaaacaacaagaaaaggaaaggccctggaaacactgggcacctgtttattcctgcactgcgtggatccctggaatatgttgcagctgctccctttagatgttacatttcctagtttaccacagtcttcagcccatcctgttacctgaagtcaaggatcaaatggccatttgtcgctgtttgcactgtgggttcctttagagctgtggatcccaaagcagaggcagcagcagcagcagcagcatcacagggaacctcttagaaatacagattatctggccacacccctggcctactgaatcagaaactctgggagtggggccagctatctgtggttcaataagccctccaggtggttctgatgcaactaaagcttaagaatcactgctctggagtaaagaaacatactctgttcctgtgtctctataaaaaaatggaaaactgtaaaattaggtgtacagggccatgggcatgtagagggccagtttggcccatcacctgagtcctatggacattgcagtccatgcccagaaccacctgaaacagctctgtgttctctccccaggtggaggggtggagggactcagatctgggcggctctgcatcactaggctcacatttccagtctgatctaatcagattttatgtgaccacaaacagcaggcactattttggtagagatatacaaagtctgggctcagctgaacagacacagggcttttctccattgcttcctgcatgcctttgtccataaaaatgtgcgatcaggcccagcaaggaaccagcagcatttgttgaatataacacatatgtgctttggcagggtgggagctcttgagaaaggaaggtgctctgacttcagatagtgttttctcactcccgaggaagcgagcgcctcaaaatgatttggttctttgtctcgaagtccccccagcatgagcaggttttgtgggagaagactgagcctcggccaggaatcacagccgtgagcctggctctgcgggggtggcagaagggccatttgtcatccccgtgtccaggtcatgtttttcctgtaggagatggctttgttcactcggggaacaggcgcctccccctgtggctggagcctcagcttcatatccatcgttgaacttaggatgacccctccacagggcctgccttctgctcccagccctccgcccctctgtcgctttctttgtttttattataaaaggaaaatattcaaatagcacaagaaagtatgggctgaaaagggccccttcccccacttggcctgattcccacttggtggatctgtccggaaatcttcctcagacttataattgatctatctattgattaggcagttggccaaggtctctatctaaaaccaaaagaaagaaaggaaaagaaaaaaaggaatccacttctctacatatttttttaactcagtgatatttcttacacatttttccatatcagcacttacagattttctaagttcttttttaaccgtctatgtttcctttccttccctcccttgacttccttacttacatccttctatttctccacccatccatccatccatctaattatatatggtaatacatgaaatccaacaaagtactgttgacactttggtttaaactcttgccagctttctgatcctattcttgacccattaaagagattttttgatttgttttaaaaaacacacacacacacacgcacacacaatgccactggctaaattaactccctgggctgcagcgctgagaatgccgttggatgtgggagcctctgagagctgcccctgcccagatcaggcacccggcattcagctgggccctttccaggctagaaacacaggatctctttcatgtcttagctaaagttctccgacctttgaaatcggtgtcagcagcgtgcttttgaggattacaaaaagaagaattaaagcaacccaaataaaattcacaaagtagctttcaaaaatcacactgctttgttgggttttgggttttgttaggcaggaacaaaggaaaataacatgtactgaatctttactaagtgccatgcctgccccaattgctttttgtactttttctcctttggtccccacaacaaatgctgttcagtaagtatcattatactcatttcacagatgagaatctgaggctcaaagaagtgaagtgcctttttagcccaaggtcacccttgggctagctggtggcagaggaagaattctaattagtctgtttataaagctctctaccccaaggtctcccacagagctttgctgaaggccagcacctcagttccttattgtgagccttctcacagtctgaaggtaaacccaggcagttttgacaaggcctaggatgagtgaaaggagcaccggtattagagtcagaacatctatttgaattcttctcgattatctgacagcggccttaaatgattagacacactgcctttgttttcatatctgcaaaacgggcatcataattgctgctcagcgtgtctcacaaggcaaagctgaggaccatagagatagtacagggcacatgagcttgggaagccacaatactatgtgagaacagggccagggcctgtgatacccgagactgaggggcatggcataatcacttatgatggccaggtatttactgaatgaattacagctgtttgtttttctgaccaacattgttcctccacctcccacccaagagaagcactgttttctttatggtgggaattactcctcctcaaccttttgggtcctggtggggctgcaaatcatagtaccctgtctcttctgggaagagcaccttctgatagggtgatcacagtgtcccgtggcctgtcacatacttgtgtatgtggcccaagctgggccagtcaccatttcctgggagttaatttaggaaccctgagagacaggtgagttctattccgttaaaggttgatgagctgttatgatgtaagcttggtgttctctgaggccagtccccttaccccaccttccttagctgcatggaaaaatccaattgaaggaaagtaaaagatgaggccaatagagacagagagaatgcaacattagagggttactagagttcctgacgcaccattcctagattttccatgtacttcaaccaatacattttttttctttcaccttaagttatgtgaattggtttcctgccacttgcatctgaaaacatcctaagacattcaaactccagatatcaagcgttaagacccacataagtagttagagcagtggttctcaaatttgagcatgccttacccctagaatttctcattctgaaagtctggggtgaggcttgagaacttgtttttctaacaggttcctggatgatgctgatgctgttggttcaaggaccatgcttttgataactactaacaaagaaaaacaaggaagcaggctggcctgtgcctagtttcctgtgatttttctcatcatgattcaatgtaataagcctgtgctggggtaaaatgtgcctagttctaggggatgaatgagaataggtaggtgtagctccatcccaggatcagggtagtgggggatgaagactgcctggggacctcaatcttgcagcagcccacagtggtttgcaattgagggtccaagtaagtgataccaatagtgtgtgcagctggacaggtgtgaggtacaacagagcaattaggagctttgactttgagatggacctggatttgaatcctggttctgccgtacagctgtttccttggcaagggtactttatccctctgagcttcaatgtgctcatttgtaaaaggagccaagggtaatacccacctaatggagttatgtgagaattaaatatggtgatgaattatttctgtttcctgttgctgtgtaacaaaccactctgaaacttagtaccctaactcaacaatatttattttgttcacaaatctgcaatttggacagggctcagtggggatgccttgtccctgctgcctgccctgccagtggggaggtagaggatccactttccagatggctaacccacacttactctctgctgggtgcctgggcttcctcactacgtggcaggtagtttccaagaatgcaaacaccatagggtgccagctacctttaatacagggattagtgcgttcttcctttcttccttcctcttcccaccccttccctctttcttccctctgtctttcctgaactgagggtccaaggatagcataggaatactctgggaaagaatggtataaacaagatgggtgtgaaggtggggatggcatggaacccagtctccaaaacctacctttgccagctttacagtggaactggtcctgcactaagaaaataaaaaataataataataatcttctcacaatgtgcaataaatcagaaaatcatcttactctttgactcagggatcccacttatgggattatattccaggaaaatcactctatttgtacaaaggtatctgttagtcactctgtgataataattctcaacaacccacagaagcataaccactatctcagggcctactatgcggcaggccctgccctgtcattttatgtttatttaatctcctaacaatcctggataggaggtgctactctcccattttacagacagggagccaaaggtcctgcccaggttcacattactgattaaccatagatttgtgatctcacttcggatgtctctgattccctactttgtatggtttttatagaacaggctgtctcctgctggtatacctaaatatcaaataactatgggtggttagaaagactggctttttaattccatagaccactatgtagccgtgtaaatgatcactatgaagataaatgaaaagtttttataggcattcagtcaccaagttccatagattctgcttcttaacgtctcttcctgtttttcttcattcccactgctctgaatatctcgtgccagtaataataataacaattaacatctctcgtgcttactgtgtgccaggctcagcgctttccatggattatttcatttaattactgcagtatcttcacattcatctccattttaccatgctcaacacttcagcccatccctccctttctaaaaagggaatctgatcatgctactccccagctcaaaattcccaagggcttcccagtgctgatgggtaaaagccagatggcactcaggctcttcagatcatggccctgcctgtctctccagccctattccttccctcactccttatgcttggccccatcccatcatttgtcagtgccttcacttgccatcctctttgcatccctctactcacttctctgaggtatttctttgcctcttcctctaggaggagaattacccactggtcaagacccagcccaggcttatctgctctgttgatcccatcctgattccccatcccaccactgtgcccttcctttgccttgcagcctctctcttcaggtgctgcttttagggcacctgtgatgctagttaatgtgtctgagattctacacagcagcagccacaccatcatgggctcagtgggctccaatgtgttcattaaatgaatgttaagtgaaaatagcagaacctcagaaacataaatggtagtcattgaccatatcactgcaagatgcaattgccatttaataatagctcatgtttattaggtattccatgtgctaaaaattcttctaagcactttccatgcattaattcttttaatcctcacaataattctatgatgaagatgccaaaattcttcctatattatacatgaagaaaatgactcagtctgactgagttgtaactggttctgctctagagctagaccagccggaccagccagactgtcatctttgggatctcatttctgccccttacaaagtgggtggccttatgcaagctacttcacttctctgtgcctttacttgtctgcgaaatggggataattatgaaataggggatacctgctttgtggtgaggattagatgaacggtgtgtgggaaaacccacagtgcaaactgccccatcagtatgagctgttattattaatcctctcacactgacctgtgacctccagaagacaaattctgggggtggtcacatgtatgaagggatacctggcaaaccagagaagagctagcaggattatgagagtggaggctggcctgaaaaggcacctgcctctccatacccgcagggaacaggatggactaggccaagagcagagaggaattattgcttactgcacattttgtgtgtcctgcactgaaataggtccttgaaaccccttgtttcatttcatcctgatggctctgctctgtggctgggctcactagccccattttgcagatgaggaagtgaaggctcagagaggtggagtaaattgctttggtcacccagcaagaacaaggtgagaacctgcagttcaggtctgcctctacccaaggctatcattgggtccctcctgaatgcccagcttggcaggcaggcagctgtcccatgactgagccagaccaggcccgcagcctgccaggtgatattcaatggccataatattcatgccagcaaaatgttcatgtgggaacagtaggcagaccatgggctcagagctaggcagaggggatttaaaccatgtcttatactattcctagttgcgtgcctttgcatatagagcctaagcactctgagccttagagactcagggtcaaatcactccaatggttaacccctttctataaggcttacctgtgaggaagaaacagccacattgctcagagaaagcgtggtgttcactgcaagagtgccactagaatgctttctgctattcattcattcattcaacaaatggtaatgcacattttctctgccatggattctaacatgggggctggtatcctgcagtgaataaaaggatcccagaccccaaggagttcttcatcaagagatcctgacatgctcactcttccctggttacctggttactgatctagcacctcttatcttctgggagctatttatttctatttgccttgagatatatatatatatctatttatatatatatatattttatgtatatatataaaatagaggccagagattcccatggaagggatgaggccttcagtgcccctcctaagcactctctgacaggatgtcccctctcttattcttattctcccaccctacccccaacttccacacccctgcctttgctggtggaactaataacacaccaattgcttgtactggccccaggtagcagatccagcacggcctgccaggtaagcaagcatctggattttccatggcaccaggtttggccagctggagcacgaagacatactgtgaggaagaagagaggctgtgagcaatctccccagtaaattctgggtcagaggtacagggtcagccttcatggggaaggtcaacccacagagttaagctgggcaaaacctatgtagaaacttccctcatgcagaccctgctgtccctgattttcctgcaactgcctgggcttgttccctttgcctgggactcccttgttcctcttcttcctctttccacttttttttttcttttttttttgaaacggagtttcactcttgttttccaggctggagtgcaatcgcgtgatctcagctcactgtaacctctgcctcccgggttcaagcaattctcctgcctcagcctcccaagtagctgggattacagtcacacgccaccacacctggataattttgtatttttggtagagacagggtttcactatgttggtcaggctggtctcaaactcctgagctcaggtgatccatctgcctcagcctcccaaaatgctgggattacaagtgtgagccactacacctggttcttctttccactgtttgctaactcccatggtgttttctggcatcacttccagcattatttctagccttacctcttccaggaagccttccctgatgggcctctgtctctaccttaaaggctgtcgaggtgccttctgacttccataacctccagcatttgtctaccagtacttaccattctgctggaattctctgtcttcttaccttcttctcagataatctgtgagccctcaagagcaggccactgaccttacttccctctctccagcacctacagctggtgcataggaggtgtgaaacccatgattgctgaatgccgttcccttgcacagaaccacgtggtgaattcctattgctcagtcaagggtcagtttaaagcagggaactgcagagcacagtcatcaagagcatgagctctagagccaaatctcatctccccacttcacggctgggtgaacttcaggcctcagtctccacatttgtaaaatgatgagaagcatacctgctctaggaggttgtcaggagtcaactggtatgacatatactttgcctagtaccctgcccagcacataatgttgggcattatcattatcataacaacacatgttgttatgatattgattatggtgactgataatgacagcaatgctatcactcccaccagggagccttccctgaccccccaggctgggttgcgggccgtcatccctcccagcatatagcacagaggtgtcattgccttctctccaggctgagctaccccatgacagagcttctgtgcagcccagccttagggccaccctaagtgctaggtccctgggatgaatgagtgcagttccacagggccctgtgaccttctccagtcctgttcccacctccttatccagaaccttggccttgagcactccaatggtttaaactgactctaggaactttctgaattgtttaaggaaaaataactataacatgtcaagtttattagtcttaacattttctcattttgtcttaataattgtgttatcatttgctgttagctttttcatggtattagaattgcattctttcatgctcacaaaagctttgttgtggctatactatttatagtgattgctttgaacatctattatgtctctaattactcgttcacattttaaggccttattaatttagttttaatctgcttttagagtgaaactggcttttcctcttgaatgtgctgacttttgattccagccccccaggaatggatcagagaagaggagccgctacccacccactcatcagcctggcctcaggggcagctcatggactttttagccagagagaaccgggttcaagttatggctcaagccctaaccccttggtgatgggctggttacttatagaagcctaatttttatcagctctaaagcttgaagatttagtgaaacattgtggaaagctcccagcacagtacctggcacctggcaggttctctgtcatctcccctacttttccctcctgatcacttatttaacacaagcaccagatgctgaaaaccctctaattgtcccaggaacacacataccctcaaagggagaagcacactttcaaatcaaactccaggatttgcatcttttagcaatttccattatgcggagaaagtatctactcactgtctggttttgaaattttaccccaaatcgaaagagcatgggttttggtgtcagacctgggtcggtcctggctctggcctttgcaggcagtatcaccacgggcaaggcttcacctctcataacctggctgtggaaccacagaaacaacagaattcagtcccagccctccagaggtggatccgtaaacagagggactactagggctgggtggagggctgtgagtgatccaacatcccctgctcttgagagtggtgttttagcatgggagtgttaatgaatgtcacaagtttcttgataccaaatagagttcctaccatttgcaggtcataccggtcactgccaagagatggcttatttagtgggaattgtctggcactcctagtataagtcacctaagtggggcaagtgggccttgaaacatccctgggagacactcactcaggctgcctgtgggagctgggctttttgtgtcactctcccatgcagcagtgacggctggggtttctaagtggtcagaggagctggaaaatggcttctgaagtaacagtcccttgtcatagtggtacaaagatgtcttcattcatctgttggcacatgtctctgggtaaactgccggcaaggccaaagtgatgggggttattattagtttttaatagaaaagttagactggcttcactttccaaccagcttccctagttccagcccatttgcagacttttgggtggtctgtgggatgaaaatttcttgtgaggaggtgagctgaagatggccatccctcctggttgctcttggattgtctgggcttcatttctaaggcggtcccagagcccatgtgggggttgggggaagcagcattgtctagcccctttggtttgtacccatgttcaccccacccccacagccacctgccttttctgtgggacttgaaaagcatcaggaatatcttcctacctgaaattcttccattagaccctgattaattggattaatctaggaaaccagattaaatgaccatttaacgaccctttcagatctggctgaatccttgtccccgaatgttcactgctcctgatctagcaaagacagctggctgctgacttcagagggaggtcatggaataagttattgggtcctagggaaagttgttttcataagttctactttgtgtcacaagaaaatgaattatcattgtttgttaggcattcaccttccaacattacttatttccttttccctgtcatttgtgtttaagtgatagtccccctccttggctccacacctcctttttctgttcttatgacaaatcagattctctttgaaataactagtctattcccacaagataaaaaacttaaaatgaaaaatccagtcccaccaaaagttaacatggggagagtgggagaattaaatcacactgctgagccatcccagctatcagtgggggtcttcaaacagatcttctgcttaaacaaagaccagttaacatataaaggaagcaggcatcgtggtgctcagcaggcagcccctgcaggtctcctcatggatcccagtatcctagaaagagaaggagcttccaaaaccttggccatgatgaatagcatgtcagtcactgcttcacaaatctccaactcttaaaaaaaaggctttcattattgttcaacattgacaaggaaacccatctttatctaagctctgggcatcatgattaccattacctagtgcctcctatatgccagccctatgcattttctgtatattttctcaaatcctcagaacaacctggtgaagtaggtgctttgtttatctaatgccatgtaaccagcccaaaacttaataggttaaaacaacaaccttatattctcatgattctgttggttaattgtgcagttcagctgcctgtggctgtgttcagctgaaagctcagttggggcgcctcagctcttctccaagtggcttctttcccatcctccagggcttctccttgtgccctttctctttggcagaatatcctggactgccttaacatatagcagctgggtttcaagaggggaagattccaagaggacaagcccccagcatacaagtgtttataaaggcactacttccatcatgcttgttcatgtctcactagccagagctagtcacgtggccaaaccaagccgatgtaggaagagacttcacaggggtttgaatatcatgagactcgggagtcaccagtggaagagtctaccacagtaggtatcgtttagccttcttttgcagttgagggcacagagactcagagaggttaatccagttgcccaatgtcatccaacatagtcaggaacagaggacccagctctctctgataccatgttctttgctgcccatactaagtcaacctgatataggttgaggtggtatagtaggaggcgggcagggaccaggagccaagtataaatggccagtaagcttccaggattctttaacccagagtacaacctgaccaattccctggcccacctgcccgcctggatggttctacccaacagcacaggcagcaaagacaggcactgaaaacatgctccaggccacagtctgggtttttcagtctgatattctggccccatctccccaccaccccccaacaaccttgttcctcctctccttaactccaggatagtcttctacaacactggcttgttgtcatttctccctcatcacctcctacccctttcatcctttttcactctgcctagaatgcccctcccatttttagaaactcctttgaggccatgacagcctgggcacttctctgtggggacctctacaggcagaaatctttaagacctctttctgactcccagcacccatacccccacaatggttggaatgaacttaagggtgttcctccaggagtctgctcggagtcttagcacaatgtccatgtgtttttctgcagcccccaatgattttagccaccatctcgtgggcacctggcaggtgccctgccctagactgggaaacaagtgggcaccaagtcatgcaaagcccgtgctccagcccagattctttctctcatttactaggtgaccagagaaagtcatggaacctctctgagctcagccacccctctacatccaatacagacaagaataatctctgctttgtccaactcctagcactttaggaggccaaggcaggtggatcacctgaggtcaaagaaaataatctctgctttgtccagtatcagagtcaacagaagcttggggttaagaaaggctttctgggagactgatgcagtatgcatgtgatagggatccttccctttaagaagcctggtttgtagggctctcagaaaggctcctctacaccccaacagacttctgctctctctatccctcaatctgtcaagctgcctgaaattctgccatctgtcattcttttgggctaaggtattattattgtttatatccagatggcccctgttaaaagatgccagcgatctggaaatggtaacacagtagccccaggagcaaaagcatgctttaccattaataaacatctctctcatggtcattctctgaccctggtgttggaaggtaaataggtgtgagctttctggagataaagttggcaatactcatcaaaagctttacaaatatgcacactctttgatgcaacaattcctcctctggaaatttcttctaagggaacaatgtgttcaaaactatgtatacaaagaagtcttatttatagtagcacagaattataaataaataacttaaatgtccaaaataggtaattggctaaataacagtatgtatgtacaatcaaatactatcagggactgttttgtgggcctgtgacaaaggcagtccatcagggccccaggctcagaaagcccctcacttggtttaatgctctgctgtcaccagcttaaaaatcttaatgattttgagcaaagaatccctcattttcattttgtggtggaccacacacacactatgtagctacttcctagaatattacgtagcaattaaaataatgcttatggagaatatttgttgaaatgggaagttgcttcaattaaatgaagaaatgaggatatgaaaccataaatgatgcaatcctaattttgtataaaacagaaacatgtagatagatagatagatataaaaaaaaaagagtggatggaaatttaccatacattgtaacatatacaatgttagagcaattatctcttttttttttttttttaagacggaattttgctcttgttgtccaggctggaatgcgatgacattatctcagctcactgcaacctccacctcccgggttcaagcaattctcctgccttagcctcccaagtagctggaattacaggcatgcaccaccacgcccagctaattttgtattttcagtaaagaagtagagacggggttttaccatgttgatcaggctggtctcgaactcctgaccccaggtgatccacctgcctcagcctcctaaagtgctaggattacaggtatgagccaccacgcctggcctagagtaatcatctctaaagaaacaaaactacatgtatcatttttattaccattttcttcttcggtgtttttttttttaattttccaatacaaagactatgactatacttcctgactaatatttccagaagaggcaaaaatgtatgtcatagctgaaaacaagcaattgtctcttgtgcctctgagtgaatccggaacccttcatatgcacagtagccttctggataaacacatgaagagaagatcagttgatgaggaaaccaagtgttcttatgagcttcttgaagctgaggactgatttctgggtccccacttccctctacaggcctgggatggaaggagcacggataagtgaatgggtgtcctgtcttatttatggcatgaggtcatgagtagtctttacccatgacatgtctcaccacacattaaccacactatgttttgcgttctctctagcctgggactagactgtgccctgagtgaatttctggatcagagagaggatctgccccccaagtccttttatgccccatttctctctggagcagagagcagacttactcctatgcaaagctgggggagcacatgtggctccacctgcctccctcgtgcatgtgtcgcattgcaggcttcaccccaacagcagggggcagtagtgatcagcaggcccaggtgggaggcctggggtggggaggtcctcctgcagggagtggccccactaacgccacacccatctcccataagtctcctctcccaaatcctttattcggctgttgctgactgtcctgactcagctgagcatggcaaggaacacaaggatcctagaaccttagctctctacattcaaggcctgagttaatgtccccatgtgacagatgagagcacaggggccctgaaaagggaaggatttgctgagagccacacagtgagcaaggggcaaacagagtgctgagcactactgtggggaggccaggctcataacacagaactgccccatatgggacggctattcaaaagaaggtgggcagccccaaatatgagtgatgcccactgcactttctgtgtgcccacatctgcgacatgtgtcccagtctagggcacactcatggctatgctgggatgacaggaccaccttgcctctgaagtccaacacttttttcagccccgtgttgctaggtgggccttttctgctccactaagactgaaatctccccaggacacaggctgggcctcctcctcctgcctgtcttcccttcagcatgcccagcacatggcagggctcacagtgctcagggaagatgtgggggctcaaatgtggggtgtagagggtgtcacagtgctcatctgtgctctgccaagcccaggctgggctgtgggattttcctcgccttcctcctcagttccctggtgccctcctgatgagctcctaagtgtacttcccgctgtcccacctcaggccttcaccgggtggtgggctactgggagctcttctccacagcgcctcctttcctctccttcagctccattcttctctccttagagcccagccctagtgaatcccactccctggactctcacctgggctcccacagcctctggcctataaccctggtgaccatgaacgcttcaagaagcaatttagtccattggggtggggaccttcagagccccacagatctgtgttcagacctggttcttctactgaacaacatgggtgaacttggcaagtcccttaagctgatctgtgaaaaggagatgctaatccctgctcacgtggataggcatgaggcttcagagacagcacagagagtgcctggcagagcaggtaggcagctaacagctgccatttgtaccttcactgggttatttatatctaaggtcattctccctgtgagatgaagagcgctttgagggcaggggtggggtctttttggtatcccaggacttagcataggttgaaacaatgaatggatgaatgaagtgtctggggatggtcagggtacactctgagaagtctgcccctcaccataagattctggaaaacatccttcacccctcacacccagctgtgctcagccctcaggccctcctctccaccttagccccattctcagtgcttgcaatgacagccccactccaatgactttttccctcctaattacccttttaaataaaatttatgaaggttttcataaattttaaaactgatttacacactttaataaaagcatgtgatggacagggagtattaggctgcagattttctacaatgaaattgacgtgagcacatcccagattatcaagtttgggagctgccccctcccccagcctccaggagctccccgcttgctcaggattgacaaatgtgtctctttcttggcagacaacagtgagctgggacggagacaagctccagtgtgtgcagaagggtgagaaggaggggcgtggctggacccagtggatcgagggtgatgagctgcacctggtaggttcctgggctgggtcaggccgggtccccagaggccctggtcattgttgaggtccagatggaccttggaaaaaggcaccatggatgggccttggttctgttctaaagcttctcttccaagggcctggaaaagatgcctgggtgactttaaaaaccaagcaatgtattttcaaggtctaggctgacccaatcatctaatcagagggaagaggtgaggagttatatccattaagcatcagcaatgagctaagcccttttgcattctataactctattctctcagaataggaatatggctcttattttagagatgaggacctgggggctctgaaagattagattacatgtccaaattgcacaactagaaagtgacagaacaaacatttgctcccaaatgatgtatatattcaccatgccaaattgtataggccaaagccaagaaggattctctaagcttctctaagatatgatctcaatctgggtcagcgggaggtgattcgggaggggaagcgtcaaggggtcctgttggtcagctctgagccacatccattcctctcagccagctctgtctgtagggtgctgcagagcactccactatacagtttaactgtctttccaaacaattggttacttaaaccaactcttggggaaaaataacagccaatgagtatttttagagttcttgccgtaagtgtgactctgctctggccaatgaccaacatctgcttttgtttcaggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaa

SEQ ID NO: 36412 - DNA, 9247 bp, Homo sapiens
ggcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccaggtaggcgccgactcgggagcggaggggctgggcccgccttccggctgatttgcagtgaggccagcgggtcccatagagttaagtaaaaagtacagttttttaaatggtcccagtccctacccactatgctacgcaaacgagaaaccccggtcatttagctctaccctccccgctacccccagtgcaggtcccatctcaatttcttgtctttgcggggtggtggggcggggaggaactggttacgtcccagaacgcgcggtggaaccctccgaaccgagggggtgtaatagatgcttgtctgaaagtgtgaatcgagtccccagcgtgtggggttggggccgctgcggtccctaatcgcaaggaggggaacctcgtggaggggaacctcccagacctaaggagcggggacctcaggccggaccccggggcggtgcagcccctagacaggacggctccaggtcgacccgagatcatggcaccggtatttttgcatctcactcctaccctcttagaattgcttctcgaagttttctctgttccactttagcccggaagttatgagatccgacactatggaccagccaagtgggtcagcacgtccgtggagtctatggactgggattcagccatccagacgggctttacgaaactgaacagctacattcaaggcaaaaacgagaaaggtaaaagcagttttccttgtaattatgcatattgtgaaagagtccccgggcttattattgagttttagcttattaaagaaatatcctttataatggaaaaataagcaagtcatcaaagacttgtcttgttttcagacaagactcctcaggaccagggttacactgggtattacttttcaacctctgttctctgattttgctggatgaactggggtttggtgtaactcgtgataagtccttttctatggctaacacctcaagataatttggtgactggtaggatcagagacgtcaggaggcaagaaggtaccaagattagaagcatcaagtcatagcttttggtctggctttgctgctatttatattttagcaggtctcttagcctgtgggacctcattttctgaatggtaagaaaaaataatttactgaccatgtaatctctaatttccccttttatctctaaaaattaagaatttattaacccagaatatcagtattacagaaagtggtttaatgtgggcagtgagcaattgagtaattttggccttactgttttaagatgaaaattatcttaaaggtaaatatgtcaacaatgtgaagtaaatcaaggaacccagatcaaaaaagaataggttaaatgtttaaagctgtcaaaaatacactaaatttgctttcatttttatgtcacagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtaagtggtagataatttatagccttgctgactgctagttttacttgcgtgcactcacagtttagctccaatgcaatttcaaaaggctttttcacccttccataaaatcaggtctaatgcattttgtgatgttttcctactggctttgttgtatatgttactgaggtctgtcacaagataataatcacttcatttaatgagtctattgcatgcccttcatataagacacggtgcaaattatatgctcccaaaacaaaagactgcaatatagttagacctgaacaaaaataccttaaaacagaagtcttagtttgttcaggctgttgtaacaaaataccgtaggctgggtagtttatgaaaaacagaaatttctctctcacatttctggagacaaggaagttcaagtttaaggtgctggcagtttcagtgactggtgagggcccgtttcctggttcatagatggaaccttctcagaaatgccctcatgtggtggaagaggcaaggcagctttattggacatgttttacaaggctctaccctcatgacctaatcactttccaaaggcctcatctcctaatactatcacattagtgattaggttttcaaaatatgaattttgaggcccagcactttgggaggctgaggcaggtggatcacttgagcctgggagttagagaccagcctgggcaacatggcaaggccccatctctaccaaatgtatatatatatattagccaggcctggtggcacatgcctgtggtcccagctacttgggaggctgaggtaggaggatcacttgggcccaggaggtcgaggctgcagtgagccgtaattgcaccaatgcactccagcctgggtgactgagaccctgtctcaacaaaaagaaaaatgtatatatgaattttggggagacacaaacatagagttcatagcattctgccctgatcctgtaaaattcatatcatctcacatgcagaatacattcattctatcccaatagcctcaaaagtcttaattcattccagcaaaagcctaaattcatctaaagatcatcaaaatcaaatctgaggctcaaggtacagttcatcctgcggccgattcccctccatctatgaacctgtgaaatcaaacatattatatgcttccaaaatacaatggtgggacagacataggataaatactgcattccaaaggaagaaatgggaaaaaagaaatgggtaacaggttccaagtaagttctaaatcttcagattaattttctttgactcaaagctcttccctctgggcccactgggatgaaggtcccacttgtgaagctctgctgaacagaggttgggcccccaaggcttcaagtggccctggccatggctttggatggcccaaccccactgcagctctcacagttggagggaccccaccctgcagctctaccaggctcgaattgcacaccggtggccctcccagtctggtgtgcccggctcccatggctctgttagccatttccctattggggactcactgcagtagcttggtctcactgtggccctctgcttgggtcacatacccaaggccctgggcagctccatccttcaaggtggaggtagccacacccccacagctcatgtactgacagaggtcggcaccacatggatgctgctgaggttaactgcctgtgccttccggagggacagacatcacagcccaggccacacctcagcccactggagctgaacctggggcatccaaggagggctgcactggaatgcaggaaacagattggtgaggcagtgctaggcagtgagttccaaggccccccaggtgcccaaagaccctcctttgaaattgttctgccctccccaggcactgaaacttggcatgtgatgggagaggcagctcataatttctaaaatgcctttggcatcgttcttccattatgctggagaataggtcctggtttctgtttagatggcagttccacattcatctccttatcaaagggttgcttggccttacccttgttctctcttgaacaagctttctcatttcttttaatgtagataggctaagaattttccagatgtttaagttctgcttcccttttgattaaaaatttactctttaaattctctcttcttgtattttactatcaagagaagcgaagccacatcttccattcacattttgcttagaaaatgttcagccaaatatcctatttcataactcacaagttgtactgtccacattacactgggacacaaacacagtttctttgccatgtcatgacaagggtcacctttcctccaagttccaacaaatgttcctcatttccatccgagaccttatgagaatggcctttaccgcaaatcaccatgatctggtatgactcccactctctccttagactgccgttgccatcctcagcagtgcctctgtatctgccacgtggttactgtcctctcccacatgacccttacagcagtcatgtgtggacgaatctgttcccttaatacttgcttatcctttaactttcagagtgtcactctcttgtcatttctcctgtcccatttctttacctccgttggctcctcagctccctaccctaggatcactgtcgatgcctgttttagaccctcatttcatagccgacttgttctgggcaatccattcatattgcttcaactccctcagtcgaatgattctcccatctattaagtgtctccagatctgatttccctacttgttggacatctctctttggggttgggggaatcaaactcaacaaccctaaaaatgagcctttgcccaattcccacatctctgatcttatagtgcctgtctcagttgagggcctcatcagccagataggctcctctttttttttttctttttttctgagacagggtctcgctctgttgtccaggctggagtacagtggcatgatcatagctcactgcagcctggaacatctgggctcaagggatcctcccacttcagcctcctgagtagcatgtgccaccaccatgcccagctaatttattattttttgtagggacaggatctcactatgttgcccaggctcgtcttgaactcctgggctcaagcagtctacttatctcagcctcccaaagcattgggtttacaagcatgagccaccatgcacagtcaagacagcttcctgagcaaggaatttacagtcaccatcagcacaatgttcctgacaattgattgtcaaatctggcccattcacctcaaaaatgattcagggttttgttccctcctctctatcaccattgtgacttactcgggtcttcctcttctagggaccgcactaagtcatctttgtgtaccccagttcttggcacaagcctgacattcccaatagatactgggatgttgattgatcttaactgaattatttcttgactatttcacttcagtagcctgcaagccgtcttccctgccaccagtcttttcctttcctcttccacactggaactgtcatctttcttaccacaatgacaaaagcccaaaatctccgttggattcctcttgcctccccagggaagctcagattgttcacacggtgcacagtgccacatatgacctggcccagccctgtctcagcagctccccttcccaccacttgggcttctcacccttcatgtaacatgccatgttcttccacatcttgttacctttgacctcaggcacgttagtccacttttccttgctaaaatttccctgttttaaaatgcgtgtgatcataatacttactatctcatagggttgccatgaagatcggatgagttaatttatgtaaaacacttggaacatgagcatcaagcattcctagctctagtactctctttttcctcttcctggagagcccattgccaccctacaggacaaatgacaccttttctgtgatgccttcttcaatttctccacctagctaggtactctgtcctggggcccttctattcttcttcttctaagtaatagtggcttatttatagacggaaatttcttcaagaatatgacagcatgttactatgtccatatattccagcccctggcaaggcaggcacgtgggggtgagggaggcaagcaccatatatgttgtctgtgttctgaataaaacagtgaatagatcattgtgaaacaacacacagtcagagaacaaaagcttatttctaattagagggttcagtatttgattttaagggaaaatgaatttgaaaacaaattccttttaggcagaacatgctaagcattggttattcatcaaggaaataaataatacatttaagagccaaaatgtttctttctttttttttttttttttctgagatggagtttcactcttgttgcgcaagctggaatacaatggcgcaatctcagctcactgcaatgtccgcctcccaggttcaaagtgattcatctgcctcaacctcccgagtagctgggattacagtcacccctcctcactatgcctggctaatttttatatttttagtagagacggggtttcaccatcttggccaggctggtctggaactcctgacctcaggtgatccacccgccttggcttctcaaagtgttgagactacaggcgtgagccaccatgcctggcccaaaatgtttcttaacccatggttcagaattatattcaatcgacatgaaaatgatagaatggaagagttatatcaactcacctgcagtgttttattttgcatacatgtgcatgcagagattcctacacttgacaggattaaaagggaactgcatgccaggaatggttctgggtgctgggtagacattgttatataaagcagacatggtttgtacccttaaaagagatgacacctcagctgaagcgtggtaggattgattttttgcactggcacattgataacagaacttataccaaagaaggcatattaggaaaagttttgtttctcagtgtttcttattcttaaccctcaaaatcaaattcatcatgcttgcatgtcagcagctcagctaggtcagtgctgtcatgatttaatctcaggatgtttttgtttatatactgtagaatgtatacttaaacttttattctcttttcccactttttgttttaatcttttgactgtcttttcttccacttccccacagcagcctcctgactggatccttcctcaccagtctattatatgtctgcctatattctaatccagatcttatcaagttgcacatttcagctcaacatccttggaaataacctcaaaaggccttaggctaatgcacagggttcttccttctagttctgactcaccttcctgacctcattttatgcctcactatgaaaacacttggtatttttagatttatggtctctttcctatcactcccctttctttgttcagcaaaaccatcctccattcaggcccaactcagatgattctccttaccccagatttaatcaggtcctcaacgctcccacaacactttgatcctgtccctgtttaaaacccttctcagaggccgggcgtggtggcttatgcctataatcccattgctttgggaggccaaggcaggtggatcactcgagctcaggagtttgagaccagcctaggtaacacagtaagaccctgtctctacaggttttttaaaaaattagtccgatgtgcacctgtggttccagcaacttgggaggctgaggtgggaggactgcttgagcccaggaggtcaaggatgctctgccaccatattccagcctgggcaacagacagagtgagactctgtctcaaaaaaacaaacaaacaaaaaaacctcaggatgtatagagagagctgccagaacgttgatctcttccattggatcataaattcagagaggtgaaaactgtatcatattcatctgtaatccagtgtttattcttttccttaggagagggaaaaaggggcaatgtgcaagtgaaaatcgagtctggaaaaggggcttctacaggggtgttggtgtagttctctgatcagcagcaccggcatggatgtgggagctcggaggaaatacactctcaggccccaccccagacctgaatctgcatcgtagcaaaatccccaggtgacctgtatgcacgttaaaggtttgagaagcacagggtagagcacttgagattgtgtaggttccaaatccacctgtcaacagatggaaggaggggatgcatcctcctgggtttcctcagtgcttctgaggtcacatggagactgggaatcacaggcaggagtggtcagttcatctgctgagagggagtagctttttttatttttattttttgagaaagagtcttgcactctgtcgcccaggctggagtgcagtggcgtgatcttggctcactgcaacctccacctcccaggttcaagcgattctcctgcttcagcctcccaagtaactgggactacaggcatccgccaccacatctggctaagttttgtatttttattagagatggggttttaccatgttggccaggctggtcttgaactcctgacctcaagtgatccgcccaccttggcctcccaaagtcctgggattacaggtgtgagccacctcgcctggccgagagggagtaactttggagctgcacttcactcagcattcacggtactagcgcccgctttttgcttcagactgacattcacatcagtattaaaatcattcacggttatttcctttctcctttgtaggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaatt

SEQ ID NO: 36413 - DNA, 104034 bp, Homo sapiens
gcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcaggtgattcaaagattatattgttttgatgcagcttctgtcactgtcttcatttctctgtaactgtttctgcaaacttgggtgctgacccattaagagcccagctgcttcagtacccagtctcaagggtaaggaggagaagccaagggaaagtaacttacagggagaaagaaatgcttatccactagctttactacaccacaaggcatggagtttccacagagcacctgtaatttaaccctgaggctgccctggttcaccccttcgctttactttacagggacactgactgtcatttctaaggaagaactaagaaaaaaaaaagtccttttataccagtaaaacatttctctacattgtcttctgacatatgcggggggaacaatattcaggaaagggaaatactttagcaaatgtgcttaacattcaggtgttctttaggacagtcatgaaacatggggagactgggagaattattattgtttacctctctgtaaagtgtccagagtattattaaatttgttcccctctttcctttgcccaaccaatacactattaaaataggactacaatcaatgcaattccatatcataaccccaggggtggtgagactaagccagcatgccttacataaccattaagtaagacattttaacattcaggtacattacattccacttttatttagcagacacggttttcattgtgtaataaaatatttttatttgatagtctgtccttgcttatagcctcatgtaatcaaggggacagcatgtttaagactttgtatccagaactttaaggtctagctgtggttcgcttattaataattcactgggaaggttaatttctagttttctgctgggtctcccagaccatacttcaaatgtagaatatgtttcttctttctcctatgcctcagtttccacaaaacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcatccataagtgcaaaagagaaggaaatcttcctccatgcttttaccatctatccaacgaatgtgttaaggatagaggcacttaaagactgacaaagagattcatttataaaatgtaacatcaatatgtcaaaataattaactttgaagtacggtgccttttatgtttgagctaagttattaattgcaagtatatttagtgcgctcacgcttacttatgaggaatctaaagtatggttttatttgattaaaatatacacaattttatggccagctttagtaatagtcattagtcaacttttgttgtgtcattgaaattctaaacggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttggtttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaacccatctctactaaaaatacaaaattagccgggtgtggtggcgcatgcctgtaattccagctactcaggaggctgaggcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatctttgattctttgaagtcaaggaatacagaagtcaagccataccaagacagaagtaaaatattgcagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatattattccagcatcactattcttatggtttggggccattattaagtaaaatagggttacttgaacacaaacaccatcatcctgcaacagttgatatgataataatggagaaggctccttcgtgactttcatcatgctactcagaatggtgcgtgatttaagacatatgagttgtctgtttctggaattttctatttaatatattggactgtagttgaccatgggtaacaaaccatggaaagtgaaaccacagatatgggggagactactgtacgcacatactgatttaatcagatttgtgtgctttgagctatgaccctggaactgaaatgaagcttgcaaatgtctgcaagggccagatcatggtgatgccctaggtgatgcatcttggcaacagctagccttctcctggctgtcacaaggcatctctgccttcttgcctgttaacaccttgaaacctccatgaaggaaaacagcacaattaggtaaatacaggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaaccaccacaggctacagtgaaaaagatagttccaactgtgagtgaggatgcggagaaactgaaccatcatacattaatggtgggaatgtaaattttagtacatctggatcaacatgttagaaacattttgaaaaacagtttgataatttttacaaaatgttaaatatatactttccatacaacccagcaattctactcctaggtgttacttaaaataaatgaaaacacatatcctcacaaggacttcattacagcataatgctgtttttataaataatttataaaagccaaaatatggaaatatcccaaatatgtattaacaggtgaataaacaaaatgccatatagctataaactacgataccacacagcaataaaaaggagcaaactactgttatgtgcaatggtgtagataaacatcaaaaacattatgctgagtgaaataagccagacacaaactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggtcaggagttcaagaccagcctggccaagatggtgaaactctgcctctactaaaaatacaaaaactatctgggcatggtggtggacgcctgtaattccagctactcgggaggctgaggcacaagaattgcttgaacccaggaggtggagtttgcagtgagctgagatcttgccactgcactccagcctgggcgacagagtgagactctgtctaaaaaaaaaaaaaaaagattgaaaaaaagaaaaaagaaaaagtcaagaaccaaatttgaatttaacttgaaattgtaggacttctttgtataaacttgcttcatcagctttattcctattcctcttttctttctcatacaatgtatattagtttattttatgtatccctctaaggccactttgaattattttaggaagaatgtaggttaataatcagatgaatagaatataaattccaacaactgatatgtgcaggagaagggctgttaaattataaactttatttcaaagagatgcaagtgttatgagtaacggaggcacaatttttggaagcttactgcttctttttccactaagccaacttttagcatgggagatctgggatgtaagttttggccacatcctgtgtgattggtatgagatcctaattaagtcagttcagctttctgcatttcattttcattatctacaaaattggaattgaaagtgtctcattttacagggaaacagcaaagactaacgacagcctatttcatgttacacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttgaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttcctaaatttccccagtgtaatgcaggcatgctatttctgtagagacattagaacaactttttgcctcttccattcattcatttattgatttatctattcattagttaattaattttattttttattttttttagaggcagggtctccttatgttgcccaggttgacctcaacctcttgggctcaagcaatccacacgcctcagcctcccaagcagctagaacaacaggcacatgccaccatacctggcattcatttttttttccacaaaagcattaatcaagcagcttctaaacattgaacactagacattggaaatatgaactaaaataccccctgccgtcaggaaaatgaaaacctggtcagtgtgacagacataaacaacattaccatatggtttgataagtgctatgatggtgataagatttgtgtgctacaggtgccctgagagaggagcacctaaaccagagcgggtctgggagtgggcagctaaagtgatagcaatgaggccgggaaagcagtcgcacttcaccagctaagttctgaaggataattgaattgcccaaccagtgggagcagaggagagcatgtgcatagtctgtatgcaagatggaggcaagagctcaggaagtttaggacctactagtggttcatgatggctgggatgtagaagctagcaagacttgatactagagaagtaaccagggcccaggtcacacagggtcttatatgccatgataaatgggttgcattatctcccgaagtctacagaaaatgaataaaattaaaatgccgcaggggacatctaagggattttaaatagggatgtgtgacattgtcaagattggctgctgtctagctcaagcctggtaaagtggaggcaaagatttacccaaacaaaggaataacattttggtgcccctggtgtgtgagagagcttggcaatattgagaaactgaaagaatatctgtaaggctatcatagagggtgtgtatgaagatatgagagtggaggcaaggagaagtgttcactattggcaaaagaaataagcaggaattggattttgtagtctgtgttaaagtgaatgcacttccttctagtagcggtgggaggtcacagaaggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccacaccccgttaagttttgtaattttctgtagagatggagtttcaccatgttgcccaggctaagaaatggacagatttgagaaatatttactgggaagtagaattcataaggcacaatgtttctgtaaataggtgaggttgtgaaaaggaagtgaggaaaaggtaactcaagtttctggcttggtaaattgggtgataagtcagctgttcaccaagctagggagcactgaagcagagcttattgggtaataggctgggaccaatgcagtgaagagttcactgtgagatagtttaaatttgagatactggtacatattcgatgtggtagaattcagggaagatggtgttggaaataaagattcgggggtcatcagcatgtggatgatatggttgagatttcttagggaggaaatggagaagagaacccagaattgcatcacataaagcaacatttaaaaatgagaagaggaagaaactccaaaagaaaccgagaagtaatcagagaggtagaaggaaaatcagcgaagtgtaaaatcaccaaagcaaatggaggagcagctgtccaaaattagagagtgatcattggaattaagcacagctgagaggttgagtaggctaaatgttgaaagcagaaaggaagacattgaagattcaggtgaagatcaggtggaaaattgatggattttgtccagaggaagtaaaagaggatgtatatccagagaaaagaatataggatgattccgagataaaggatggcctcctcctcccccttttatttaatactagggagaaagaagccaagatggctgaaatgcaaacatgtttggaagctaggagggacaggaagttgaatgggtcatcatccagttgcctttgtgaagtaacaaacaaaaatctccgcctgggagtgagctggtagagaaagtaagtaaggagagtatgaagactggaaagtgtccatgtgaggagtgggccatgcacacagaactgatggctctgttgaaatggaaggctataacttgaaatggcattaaaccaggcagttgtggggtttctccagcatcaccgataatggcttcaacagatattgtcagcactgttttagatgctaaggatacttagcacctaaacgcagagtgagcaacacaatgtccctgcttacaggagcttacagcagtaaaggagacagtaaataaacacacacacatataaaaaaacattattagatagactagagttggaagggaaaaggaaggcagctggatcaattcagggtaggctcatttgcagggggcaagggaatgaaatactttggtgagatgatggtttcagggatggcaccacaggatgtacactggacagaagatataaaagaaaagtaaagtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagcaagccaagtattaaatggtggagctcctgacaacacagcttcataaaaaagaaactgcttgactcaaggagtgtgtccttgcgatagtttgccgagaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgagtagtgctgcaataaacatacatgtgcatgtgtctttatagcagcatgatttatattcctttgggtatatacccagtaatgggatggctgggtcaaatggtatttctagttcaagaaaaccgaggcaataccattcaggacataggcatgggcaaggacttcatgtctaaaacaccaaaagcaatggccacaaaagccaaaattgacaaatgggatctaattaaactaaagagcttctgcgcagcaaaagaaactaccatcagagtgaacaggcaacctacagaatgggagaaaagttttgcaatttactcatctgacaaagggctagtattcagaatctacaaagaactccaacaaatttacaagaaaaaaacaagcaaccccatcaaaaagtgggcaaaggatatgaacagacacttctcaaaagaagacatttatgcatccgacagacacatgaaaaaatgctcatcatcactggccatcagagaaatgcaaatcaaaaccacaatgagatatcatctcacaccagttagaatggcgatcattaaaaagtcaagaaacaacaggtgctggagaggatgtggagaaataggaacacttttacactgttggtgggagtgtaaactagttcagccattgtggaagacagtgtggtgattcctcagagaaataattttaataatgtttgagtgaatcaaatatacaaatagtattgtgatgcagtgtacccacaatcattaactcaactatgaattactcaaagcactgtagataatagtctagcaaggatctgacaatatgttgagaagaaatgatgcacatgaaaccttgaaagtcaccttaaagaaactcatatcatgcaaatatgaatattttaatagctactataaaatagtagagctgagtgctgtggcacacacctgtagtccagctactcaggaggctgaggcagcaggatcacttgagcccaggagttggagattagcctgggcaatgtggcaagaccccatcttcaataaataaataaataacttagtagcaattggtgctatgaaactttttgatgtagcttggatatttgtcctcgcccaaatctcatgttgaattaatcctcagtgttggaggtggggcctggtgggaggtatttggatcatgggggcagatccctaatgacttggccctgtctttgcaatagtgagtgagttttcatgagatctggttgcttataagtgtgtggaacccccccacccactctcttcctcccgttcttgccacgtgagatgcctgctcctccttcacgttctctcataagtaaaagctccctgaggcctcccaaaaagcagatgctggtgttatgcttcctgtacagcctgcagagccatgagccaattaaacctcttttctttataaattactcagtctcaggcatttctttatggcattgcaagaacagcctaatacattttgcatggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattctatggattaccttgaaataccctttgagtcatttctcaaaaattgtgcatatcataccgatctgataactcattgcactgttgatctgaggcttcatcccctcacctaaccacatggtcatccattttgcagtccacaagagcccttcctggattcatggaaagaacttgctctcacttgggcttgagaaagcataagtcaacttggcagggcatgtgttaacaagatgatttagaactttgcgaccagccagaaccataaagacagcttgtaataaaagtaaagctgttctcatgagatgcccatgatgagggcttctagggcaaggctgctgtttcttgctacctcagcaagaatgaggtctctttcccatgatcatttccctccccttcactgggcagggtgacaaagaccaggcctctgctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttctgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaccctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttattagtgctctctagaaaagagcctttttagaatttgatttcattttaggcagcattcgagaagcactgtcgactcagctttcctctggctgttgtctttttgtaccactccctaaccaaaattgatgcaaaggcaggatgctttgagttactctcagtaatcacatattattgaagtcagctggttattcttgacagacaatatgatccaaaataacacaatgtttaaacagaaggaacatgggtgtggacccccattgctccctcttcagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttcggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagactgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtggtatgtatgttgtaaatagatgcctaacctatttaaaacgtggctaatttatagtgaccaagagtttttaaaatagagtagtaattgagaaagaaatggtttgtatctttttcccacttaattttctttcctgttttgtacatttttctagatgcttcaaaaagacccaaagaaaagaggaatataagcacagtcattactcattatttgtggattctctgtttgctaattcacctactccctaaaatgtatttattacccccaaatcactatttgcagctctctcacagtcatttacagacatgcacagactggtgaaaaaactttgagtctttctacacacatgtactcagctgagattgaacaagggaactatagacaaggatcctttttgtagtccatttagtcaacgttttttgcatttttgtgctttttaatgatgatttcactgttaaaatgctccacaaccatagtgtggaagtgctatgtagtgttttgaagcacaagaaggctgtgatatgccttacagagaaaatatgagcaatggataaacatcgttcaggcatcagttatagtgctgttggtgtgagttaaatgttagtgcatcaacaaaatatattaaataaggtgtctttaaacagaaacacacataaaacaaggctatgtattaatcatctgtgtgtccagaagcccacaggaacctaaccttgtatttcccctagggtcaatgattcagtattcactaattcagtgtagtagggactttatatagaacaaaactcatataaataactagaataaaccacacttgttttttaattcctgtgaaataattcatatgggaaaccatcaaagacctgctaagtaatgatgaacattaaaaaaattaaactgggccgggtgtggtggctcttgcctgtaatcccagcactttgggaggccgaggcgggtggattacctgaggtcaggagttcgagatcagcctggccaacatggggaaaccccgtctctactgaaaacacaaaaattagccaagcatggtggcgggtgcctgtaatcccagctacttgggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcctccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaacaaaaatgtttcttggccatcagaagagagaagtgattttgaatatagtatagtttttgctattataatcactccaaaaccaggcctgttggtgcttgtggttcttgagagaggaggccatggggggtgaaattcaagagacctgtttacctataggcacaagagccctcctcaagacttgagacaatgaaagatgaggaagggaggtattttccctgcatcatccagcttcagcacccagcgggaactggatcatgggtggtgtctgggtaggaggctgtggaggctaaagtcagtggagcagagtggaagccttggggtcgtgggcttatgcatgagacacatgtgaggttccgtgcaacactttaccagccaattataagggactgaagtcactgcaaaacataggttgccatgatgtaagcccatttgcatttgcagactgaaaaggcaaaaggaaatattcctgattcaagtaagtatgggactatacttttttgatattggatctgttggtcctcatttctatgtttctcgattgtctaatgtggtggttccccctgactgcacattagacccactctagaaaaccttaaaaaaatgtctggaccccctccaaagattctgactgaattgatcaggagtagaattctgggcatccgtgtgtctaaaaggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatccgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttttcagtgaggaatacagtaattaataacttcccagatggtagttgaacttgcttttaaattcctatagtcaaataagttgggagaatgttacaagaagattagttagaaagaaaatggtgtcatttattatcagctcgaaacattcagaattgtcatttgtaagaaataagctcattattaatagaagattacttctcttgtctttgtgtgaccattttcttaaattaaaaataacttttttcccttactgcaaaagtaatgcatgttcatctaatacaaattggaaaataaaggtaagcaaataatacaaaattaaacacactcttaatccctccgcccagatctaactgctgtaaatatgttagtatatatccttctagattttctgtgcttttatacagattttaaaaaatcatagtatatgctctttcactttacaatatctggtcaacaacattccatgtcaatacatttgcctttactacattattttttatatctgcttattaaggtgaacaatttagtctgattttaaaccacatttgtttactcagatgtcagagatccacagataaggaaacatctgaagagcccaggtgtggctatgtggagaggttgagtaattcaaaacaaagtacaaaacataaaaacaattacgaccagtttgacagttgtacgtctgtttcctacggccttctacccacaagtctaccgctgacttcaaagaaaagtcagcacagaggaggtccagaggataaggtgcaaaacgagaatcaaacccacgataagagattaaaggaaggttgatcaaagacccagcataaaagtgctagcccgtgacttgccttggcccatggccccaaaatattcatcagaacagagagcgctctttgaagtgattggatgcatccatgctcagacaagctcggtggtcaaagggaaattttaaagagtggccctggaaggagttagcaaagttgcctcttcctctctctgctctgcacatccctcacaaactgaatgttatttctttggtttgttgtgcagatgcaagtaatttaactgtactttttgccccctgggagatgtgggaagtacagttgcttttacaggatggagaatttgcactcatgatcagagaactgaaacttccagccatcctttttattcagagtgtttaaggaccggtggtatttccaaataggcagtagggcttgttcatgctctgcttgttcattctgcttgttcattaattgttcactacttttctgagtagagttcattgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgctttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcgaaaaatgaatatgttgtgagctgatacagacttttgtcaggccagtctttcataaagaagtatttggaatgggctttgaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatggaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctcccgagttcaagctattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagcaaggttgtggccagtgtcaaagagtctttcgggaagtttggtttgtggaagatgtgtagaatatatcaagatgaagaactgggtgacttctagtcaaaaaggaatgatgatataaaccaggtaccaatcagaatgagaggtatggaagaggggcaaaggaattaccagtaaaccaaggggaaatagaaatacagttttacccaaagtttcaaatccaggaggctatgatagcaactgtgctgtatactaaggcatacaactcatgagatgactggtttggtaacagtcctgagcgttttgttttaaagagctgggtcctgaggttccagacaagcaaacatgccaaaaaagtggttcaatgggggggcttgaggctcagctggaaaccatgtttaccataccaagtttaaaaaatccacacagctcagcaattgtttgaagtttttaattaattaattaattcataaagtgaagtattttcaaaagctcatctgagagcttatattctcttgatacagatgaattctcaattgctcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctatataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccctcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaacccaaatctcctgcagtgggctctctctcttctgaaactttctccttgcaggatcaccttgaggaccagggggtggggaaggatcagggcccttcatgtggagatatcttctggctctttccataccagttctttgggttatgttttcttttctattggcctaggctctccacagctgctaggattctctctttaacccagaaatgctctgtttggcctccacactcatgttgccatgcagtgagtaggaaacaatcttgcaaagctgcagtatgcccagatagctcccacttgggtattaaacatggaccagacacgttagcgcaaaactgagtttcctctttcacacccttaactgctatctgggtctactgaggttcttctgagcagagcagctttgaggagaaccaaggagaagtcgcctccattcccttagggtagagaatcttaaaaaacattttctggcacaagttacattagctaaaagattctggagttaccttagaggttttccacttctccccttctccccatccatccaaatcaacttgaagaatattaacccactcccaccaatgaaaggggatcccaactaagggtggaagcagatgagaatgttcccaggggagcacattagaatctcaggaagctgagaaatctgtgaatatgtaatttagaaatttccacgtcctagaatctaacatgtttttgttcacttgcaccttctgctctgcattaaaaatccctcctagtaaatcttttgttcactttcttttgttttccttaaatatctgcagcacagtcctccagattatctaactgcccgttagtataacacttacaagtagtgtagaaagcatttcctaactaggtatttattgagtgtctgatggtcaccccataaacagcaagagtaggatctttcacatacatagatagacatgcttgtatttttcaaacttttctatattcactgaatgatttattttcttttatgtatattttttatagattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgcagctaccttgtgactctaacattggccaggtagccagtgggcatcatatcccatagtggacgtttggatgttctggagtgctttcttattgtctcacaaccttgcctcccttgggctgatgttcacgtgctctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaagaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcttctgcaaacagggacaatttgacttcctcttttcctaattggataccctttatttccttctcttgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtaggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagttttttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatgtgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgttgttagtctgatgggcttccctttgagggtaacccgacctttctctctagctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtgttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcaagccttggttttcagctccatcagctcctttaagcacttctctgtattggttattctagttatacattcttctaaatttttttgaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtgcttttatctacttttggtctttgatgatgatgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgccctgcccccagaggtggagcctatagtggcaggcaggcctccttgagctgtggtggactccacccagttcgagcttccgggctgctttgtttacctaagcaagcctgggcaatggcaggcgcccctcccccagcctcgctgccgccttgcagtttgatctcagactgctgtgctagcaatcagcgagattccgtgggcgtaggaccctccgagccaggtgtgggatatagtctcgtggtgcgccgtttttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcacgcacggtgcgtgcacccactggcctgcgcccactgtctgggactccctagtgagatgaacccggtacctcagatggaaatgcggaaatcacccatcttctgcgttgctcacgctgggagctgtagactggagctgttcctattcggccaacttggctcctcctccttttttttttttttttttttttttttttgagacagagtcttgctctgtcctgtcacccaggctagagtgcagtggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaagggcatttattggctgggcgcagtggctcatgcctgtaatctctgcactttgggaggccaaggcgggtggatcacctgaggtcgggagatcgagaccagcctgaccaccatggagaaaccccatctctactaaaaatacaaaattagccgggcgtggttctgcatgcctgtaatcccagctacttgggaacttgggaggctgaggcaggagaatcgcttgaacccaggagataaaggttgcagtgagccaagatcgtgccattggactccagcctgggcaacaagagcgaaactccatctcaaaaaaaaaaaaaaaaaagaaagggcatttgttctccaggtttgaacagttttgaacagtcctcatcaacatgattcatcgatttatattgacttatcggctcctgtaggcacttgattttgcatattagtctggtcttggctaagccacagcagtaaaaacacaaatacagtagctcaaacaagaaaaagtttacttctgtctgtcatgccagtctggaagtaggcaggccatccagatgaggcaggaagctctgctccatgggaatgtctgggagccggctttctttgattttttgctctaacatcaacctcctctggtgtttttcttagtctatttggtcaaagttggttcaccagtgccctattcacatgtcaggccacaggaagaagaaaagagagaaagtggtagacaaatagttaacctttatgtaaatggcgcagaacttgcatacattccgttgcttaaaacattgtcatgtggccacaactaaatataaaggaggcaggaaaatgtagtcttgagcagtggccatgtctgtgtcttgttaaaacttggttggcagagaggaaggtcgtatcatttaaaagatgaggagtacatataccaatgtcatttagcatactctgccacagtttacatccactgatctagggaatactgtatttgtgatcaaataacacagtggtgatcaaatctagaatcagtaatatgtttatagagtttatgagtgagaaatctgagtctcagaagtttgctgtcaacactcagcagaacagtagtatagtggcaaactttggtccttctctcttcttcattctactacattattacaatttcttaagagttggtacttcatactagtagagttctttgaatgagcaaatgatagaagaaactaacctgcactggcacttacagcccggaagttattctcagcttaattaggtgctcttcaacgatctgaatcagactagcaaacacgcagcatgcttgctgccttgctcctcttccataactatgtacttttggtgacatccttctttcctgctaacctgagatctcagaattcttcttaaggtagtgcttcaagctgtaagcaatctcctttcagtggaagggagttgcataaaaataaaagttacatgtcatcccagaaatgggtaattatctgaatatttctgcaccctctccctttttttaaatccattcttttgggcatgggggtgagagcgtgtgtagttacagtaagaattccaatgttacccttatttttcccatgatattttctactctctcctaatccctaccacctgcaatccctcagtttcccctgcatttctggcaaaattctagtttttccactactctgctatctttgaaagatgtcaaccaccttaagtatttctgtcttgtgtcttattgcttcatgaacaaaaaatggtgcgaagtgtagaataacaagtttaccttcagtagaggagttataaatctggaaggaatgttaatgtcagtgtatcattggccttcaatgattttctcccttataggcttttatatatgcttttccctttgcctagaacttgccccccacacacaccacctgcctacactctttcctctaatatagttttcctagcacccaggtttctgtatacttcttatttaatgtctttttttttctataaaactgtaaatgaagtggaagcaatgctgtgtctcattgccctttgctctttttctaatacctaccaaagtttctggcccttaaatactacagaatcagcaaatgaatgattgagggggaagatagcagggaagagaggaaacaaaagaaagaagaacccaatcttttggaagccctccttgtttccttcccttgattccgggaaacatgagctctagggcatcaatagctaatagcatacatttctttagcattttacaaactctgtgttctcttttctcttttcaatccccagttacttctttgctaaactcagtttgcctgaggtatatttatacaatcaatgggtatcatacatttgcagtttacattattttattggaaataatcaagagaagttttgagaattggcatagggtcaccaactttttttgtcaaagaaagatggtcttagaccagagaggtctggcttccttgcccgtcgctttagcctataattttaaaactttagtgtggggtctaccttctgcagatatgcctcagaggctgaggatcacagagggtcacattccctcttcagtcaaaagtactctaatcgtaggtctcctttatcagattattaactcagcctgtttccccaggtcttctttgatccttccttccaggatatccaggtcatccagaggtatcatctcccataatcttaaaaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagccccaaacagtccctatgctggtccaagtttgggtcctcttaggtcccacgttcctcctgctctagcgtcctgctccactgggggctattttttatttccagtgcccagaaatggctgtgtgactatatgtttgcagtctgttggagggaagcaggtctctctgctaacaactgcacactagctgacatgctgcttaaattgagaaatgtttctaagcttttttggtaggaaataatctttcctgcttagtctccctctgtgttcccccagcaaacttcttgtgtagcattattaaatattccccaacatcagtggccaagaatgacacaattctgtgactcctcagtcacttcatgctccacattaagtggagtttcttcctagaatggggaaggcagaacattggtaagagctaggtgtctcagaatctttggaaataaaatccctgatccataggtagttggctcgctaggttacccagatatcaatctgacaggacagttttctgttcctccctgggtcttgattgtcattcattaggaatgaaattaaagtttgaaggacagtagtcaaatggcattcatttgctctcttcctctttggcaaatctaacaaacatcaggctttttccaggcaggaagagcctcatttctaaagagccaatttataaatatcattacctgattctgcaaaatgaagatagtcctaactagagtaactatccatggtgttgggtgttagtaaatatcatctcattggtagtgtgtgattttaaaacccacaaaactgctattatatggattttatctaactgtttaaaaccgatgatcacctttgaaactactgttacgagtactaggacttacaattttttttttaagaaaagctacataaatgttttggtggattcttcttcacgtaaacaatcattgatttgctatctcagagcttcaagaaatctaccttatgactgtcaaaaatgagagctgactctggcctctgttgtaataactaattgctctctcagtcacacacacacaaaattaaatttgggtttaaaaagtatcctggccaatctactttttaagtgttaaaatacatgttgatttgcctgacgtggtggctcatgcttgtattcccagcactttgggactcagaggtggtggatcacctggggtcaggagttcaagaccagcctgaccaacgtagtgaaaccccgtctctactaaatacaaaaaattagccgggcatggtggcacatgcctataatcccagctaaggcaggagaatcacttgaacccaggacgcggaggttgcagtgagccgagattgcaccattgcactccaccctgggcaacaagagcaaaccccgtctaaaaaaaaaaaaaaaaaaaaaaaatatatatatatatatatgtataaagtttcttcccaaatcatgacaattatcatcatttcacattttccatatctggaagtatcataataaagaaaattaaaaccttaaggtagaatcacatctcgtacaatggatttagcacggcagtaaccttaagttctgacaccagataaatttggaagtcaggaaagatagtcatgatactaagacatatgttttaatcagttacattggagtagttaccaggtaatggaattcattaaaagaagtggtatattccatgtagctatattaaatactcgagcatcccagaagctagtgatactatatgcttccagttttctgagaaacttgaccagtttagcagactagaagcatcatccaaagttcttgtgcttgccttatatcaaagttctatagtctttaaatacatcggtaaggataaagagactggagcagaatcagtttgctgagtcaacaaagtgcccaagatgattactgttattgttttctcacctcatcaacaaaaagcatcccatatatatatatgtatatacaccatatatatgtatatatacacaccatatatatacacacaccatatatatatatatatatatatataccatacatatatagtgtgtgtatatatatggtgtgtatatatacatatatatggtgtatatatatatgtgtatatatatggtgtgtatatatatatggtatatatatattttccaatatcaattttccaatatcaatctactgagatatatctcagtagattgatattggaaaattcgaactaccattttgtttatagtcagtagtaataccctgctaaaggtcgattgatttatatgctttgggaatacagttaattcaaaacactgcatgcttgtactttggaatagttggtcccatgaggtatgaactcagacatactcgtttacttcaaagtgaaacaaaaattctgattaccttaaatagaaaaaaattgagttgctgagaatatacgtaaaattgtcttttcatttctgttactttagtgattagagttttttaaaaatataatttcaagttttattttagattcagggggtacatgtgtagttttgttacatggatatattgcatggtactgaggtttagaatatgaatgaccccatcactgaggtagtgagcatagtacccaatagttagtgtttcaacccttgctccactctctccctccaccctctattaatcctcagcatctattattgccatctctatgtccttaaatgcccaacatttagctcctacttataaatgagaacatgtggtatttggttttctcttcctgcattaattcacttaggataatgacctccagctgcatccatgttgctgcaaaggacatgatttcattcttttttatggctgcatagtattccagggtgtatatgtaccacattttctttatccagtctaccattgatgattctctaggttgattctacgtttttgctattgtgagtagtgctgtgattaacaaatgagtgcataagtctttggtagaatgacttattttcttttgggtatatatccaataatgagatttctgggtcaaatggtagttctattttaagttctttgagaaatctccaaactgctttctgtagaggctaaactagtttgcattttcaccacagtgtataagtgttcccttttctctgtagcctcaccagcatctgttcatttttgacttttgataatagccattccaactggtgtgagatggtatttcatcgtggtttagatttatatatctctgatgattagctatgtttaatgttgtctcgtacatttgttgaccacttgtatgttttcttttgagaagtgtctgttcctgtcttttcctactttttaatggggctatttgttttttgcttgttgaattgtttaagtttcttgtagattctggatattagacttttcttggatgcctagtttgggaatgttttctcccattctgtaggttgtctgtttactatgttcatagtttcttttgctgtggcagaagctatttaatttaattaggtcccacttgtcaatatttgtttttgttgcaattccttttgaggacttagtgataaactctttcccaaggctggcatccagaaaggtatttcctattttgttctaggacacttagagtttgaagtcttacatttaaatctttaatccatcttgaggtaatttttgtgtatgatgaaagttaggggtcccattttattcttctgcatatgactagccagttaccctagcaccatttttgaatagggagtcctttccctgttgcttatttttgtcaactttgtcacagatcagatggctgtaggtgtgctgctttacttctgtgttctctatcctgttccattggtctgtgtgtctatttgtgtacccagaccatgctgttttgactactgcagcattatagtataatttgaagtcaggtaatgtgatgcctccagtcttgttcttgttgcttaggattactttggccatttgggctcttttttggttttatatgaattttagaattgttttttctaattctgtgaaaaatgacattggtagtttgataaaaagagtgttgaatctgtatattactttgggcagtatggccatttgatgatactgattcttccagtccataagcatgaaatatttttgtttgtttgcttcctctatgatttctttcagcaatgttttgtagttctccttgtagaaatatttcatctccttagtcagatatactcttagatatttatgtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgctgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgttctattgagtagcaaatccatggatagcaatcacagctagatagtcacagcattacagagtatccatgaaaagaactgtttacttagcatttagtaaaagtcatagaataccagtatataaacctctggacttacaaattgataataattttgtacatttttcttaagttcttgcttgatcgaatatttctattttcctattagttttaggtttgattaatggatcactgtaaattcagatgcacctttgcactcacagtgaatatatggatgttccttccacttctaattgttccataaggatgtaaaatattcttaaaactgtgaaaatgttaaagcacattatagcacactttatagcctttctttgtatttaccctgcaaacaagtctttgaagcatagaaatctcacctatccataatcacaattgactgctttactaaattttaaaatgaggtggaatcgtaatgtattttaattgctaataggtaataatggctaataaatagcaattggttcaaacctaacaaaagtgggactccatttcctagtgttcttgccactgtgaacttgaatgaggcatttatatattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataactttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttactgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctctgggtttttgccacttgcaccttcccagaccatgcgctcctttgaccagcatcagctctgtagtgttgtgtcttacctcagcattatgtgtctatattctcactcttgtattagattcttgtattagattggcatgaggccttagacgtctttgaatcatttatgcatctctaacaaaatccagcatagtattgcacaaaggacatgctcaataaataattgttttcagtaaatgaataggtaagtgacctaaaggggaaactggagccattgtcactgagaaataattccaattttaaacctttaccttttgtctcttctcacttaaaattgcttttactcatttcagccactagttggggagttgttattgcaatttttctttttaattcagtgaaagaaataaaattggatgctgctggtctggcaggataggagaacagtcacaaaggtccatgatgttgccattctcagataacttgcaaccaaattgtgctctgtactaggaagtttctctgttacttgcgataaattcttatagaaactcttgcacctttttttccttgctgaattttaactaggacaccgaatggtaatggtgaagatgggagagagagtatttaagagagaaattggagatgactatatcaaagaaagttaaaatatgaaacattcacagacacaactgaactggccattagccatagctcataaatattgcttatatggcttggcagttgtcaaaatatagacagattttttaaaaattttaaacttgaccccacagccaaatctcaataattcttactacttctactccaaaaatctcttacatttcactttttttgaaatgacaaaacaaattacaaaaacaagtacagaataggacttaaattatgttgtacctatcctatatttttaccctcatatgtagttatatttttctaaagaattcttaattctaaaataatgattaaaaattaaatccataggctacggctaaacctgaagatcgaaatgatccaatgcttctgtataacaagatgacattggcccagatccaaaataacttttcactagagatcaatgggaaggtaagtggtaagttttttgtgctctcttattgtgccgttttctaaattataacattgaaatactctttctaaaattcgtcaagtttttatttattgaagtaaatgggacttcaattccttttttttttttttttttttttttgagacagggtctcactctgttgcccaggctggagtacagtgacacaatcttggctcactgtaacgtccacctcccaggctcaagcgattctcctgcctcagcctcccaagtagctgggactacaggcatgcaccaccacacctggctaattcttgtatttttagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccgtgttctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaaggagttacatttggttatttaaccagttcatgaaagaatactgtctggattttttgttgttgttactgtgttaaaagtaatttcggggttatctattttaattaatttgattttcaggtgctcattgcacactggacatatacacagatggacaatattgatgtgggcagtctattgaaagtacccctacctggagttaaataagaccttttcttagcctatacctatattatttaaacaatcactgttttggtactatggtgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaacatgctttatgagcaacattcacatgcatcctgactaatctctgtagttaggttggcagaaaaagcagacgatttggattgatagaggagacaataataaatgtattttaataagataatcaaccttggtctagttttcttttagaattaaatcacatggaaggactatcttttttcagctctcaaagagccctgagtgggttaggcctagaacctctgcccccagtattgctatctttccatcactctggccagctcttcagacattcaggttggatttgctcctttcatgtcacagctgtgcatgacatggctctgcttggtaaagccagttggattgttctggatcggcatttccaaagtggtgtcacaaaatactggacatgcaagttattccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggatatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctccctggtgtaatcccagcactttgggaggccgaggcaggcagattgcttgagcccaggagtttgagactagcctgggcaacgtggtgaaatgctgtctctacaaaaaatacaaaaattatctgggcatggtggtgcatgcctgtagtcccagctatttgggaggctgaaatgggaagatcacttgagcccaggaggtggagattgcagtgagccctgattgtgccactgcacttcagcctgggcaacagagcaagaccttgtctcaaaagaaaaaaaaaaaagatagtagtaaatacataataaatatgagctggaataacaaggaaaacctcgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattccagatcccagttccaccactcatttaaacttggtcgagtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttgatgttttcttttgaggttaacgtagtgccagtttcataatcattttgtcatataatttacactgttcattccctttcatcatatgggctgattttctctgcattcttctctttttaagatagataatcaaaagccaaaagtgtatacaatattttaatgaatgaatggtcaatagcacacatgcttcagtagtactttttggtcctccccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcattcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaaggctcttcataccccacactagcactccagagttccttcacattcaccctacacctcaccattgtccaaagctccaaccatatgaattacttccaaatcctttctctgtctttcttacatccttgtctcttaccctggaccaccctttatgccctggttcatctaacagaaacctacacatgatttgattaaactttaagtgtcacctccttcctcacagcaccccattgcatatttctcttcaccttgggctgttctacactttgcacattttggtcaaagtaccagtacattttactacgtttagttggactagcccctattgaaagcaaaaaccagatatttgtgtcaccagagcttaaacactaatgaacagaatgtagctctttatgaatgtttatgggaagaataaatgataaaattgccaatttgtaataatgataataaaactaactcagctgctaaaataaaaatggtcacatctggctgggcccagtggctcacgcctataatcctagcactttgggaggtcaaggtgggcggatcacttgaggtcaggagtttgagaccagcctgggcaacatggtgaaacctcgtctctactgaaaatacaaaaattagccaggcatggtgccatgcagctgtaatgccagctactcaggaggctgaggcaagaaaatcacttgaacccaggaggtggaggttgcagtgagccaatattttaccactgcactctagcctgagcgacagagagacactccgtctcaaagaaaaaaaaaaaatggtcacatccaaacatttcactatcatggctggggaagatacacaacatcatctttaacaaattcaagaaattgaggaagtcaggaagtctgcatgtgagacacccaagttaataatttagctaaaagggcctccctctgctcttatgagtggctggcacctgcaaaggacagggatttacttttttttttttttttaagacggagtctcactctgtcacccaggttggagtgcagtgacaccatctcggctcccacctcccaggttcaagcgattctcctgccccagcctcccgagtagctggaattacaggtgtgcaccaccatgcccagctaatttttgtagttttagtagagacggggcttcaccatgttggccaggctggtctcgaactcctgacctcaggtgatccacccaccttggccttctaaagcgatttaaattttaaaagctcttgattcatgtggtttctgatgcctagtatgtgtttccaaaatcatctcaaacattatgtcttttaaggattttgcgccagtttgtaaagaattttaaacatgtcattataacatagaaatagtgctgaatcgggaatataataccctttggttacttaacaatatttctaaaatatttacttctagtaacatgaattttcatttagagttcatagagcaaacatgaatctctaaagaaaaagatgtacaagaacaaaacaaaatgagtctcttgtttttagacttgatgttattttgttagtttctcaggacagaacttcctgtgatataattgtgatgggtgttgctagtgtttgtgaatcataactgttgagccctggagttaactttttataaagtacaaagaggaatctcattggtgcatctctcttgctgttctgcatcaaaatgaaagcatactgacattgacaggagccaagtcaataaacatttattgagcagctagcttgtgcagagcactgtgctaaacaaaatagatgacaaagaggagaacaagatgttgccctttactcgggagtctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcgagggtgggcaggcggagcaccggacacttgagacaaatgactctccataaatgtagacggagatgatttgtaaaaaggactatttgactcagcaagtattagccagaaagaagagatacactaaacttgaacaaatcagtttaatttcccaaggcagtatctgccatggcatcctcatgttttgcacatgttgtaacagatgaaaattttagatttttacgttttatgcttccattaagccaacagagtctttgcagattttcattgtgttttggggttgttagcaaaatgtgttctattggcaaaaagatttctgctttttagtcagcatttgatgagggattctgttttgtttcgttttgttttgttttccagagggggaaggggaattagaaaaggaagccgaataatttaaaggctgaaattttaggtagttcttttttaaaaacaaaacgaaacaaaaatatcatcttcaaacaacacaattaaaaggtcctaaacttccatttaaactgaaagaactttgcaaaagaattctgatacatttatttcagtgtcatctcttgaaaggacaacattcaacggtgcacagtttctgacagccaccactctctatgacgtgcatagcaatggtgccctctgccctcctagagtcacaggatgaaatgggtcagcactctgggagcttggaggacccaatgctataccaaggcccaaatagccaagtgcctactatgctcccaccactggtcttagccttaggattcaattaagaacaaaacatggaatattcttgccttcatggaattaccttctaatgagctaggtagacaatagtcttatgtcaagttatgtaagtactgagggttatacagtatggaacaggtttcagttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgattacaaggtaagaattctttccacccaggcgactggaggaagacacagaaaatctatcgtattgcactgctgatttcaaaggagttgctttgagactactaaatgctgagaaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatcagaattacctttcagaagtcatgcaaggaacaatgtttccccctaggagtagtaagagcacattttccattttgactttcttgccagacagcttggaatcgtatctgaacctgaattatagtaactgtctgaatatatataaacatagtcataatatatttcctaatcatgatttttgtttattttcttttataatacttcgtagtcacgtcaacgcaatctatttgttctacatcgtttctgatctctcaattttagtctaatatccctgggtttacacatacatgtttttcttgtgagtcaacacaaattatgtgggaagcaaatagagtttaattaaaataaataaaattatattgttgtaatcatcaacctgcaagaaatactaaaatactgatgactcggctgtaatgaaattaaggaggactgatattatcagtccccccccatcctgtttaaaaatgctttctcgatttaaaacaacagcagtaacaaactaaggaagaaacatgttgatcaatcattcttccccatctccaagctttttttcttcctaaagaaaaattaacagaaatgttaactaaatttttttaagtcccaaatcctttatataaaaagtcttgataagttgttgtagacaaaacccattcttagaatttatcagtcagttgttatatattgccctgtgctagttatttttaagagatcaaaataaaattcacttctgacagcccaaaatagttactgacattgtaactaaagcaacattgtaactaaagcctactttgtacagctcacctggcagagcagggtctagaaacagttctgatgtaacctaattgtgctaattactgtacaccccttctgtgagtaggataattgtcatactaacagttgccatgaaagtagaacaactgcagtgaagccattagatgatgatctctgactaccttaaatgtatgcatgtatgctgacatttaagaggttatctgaagtcaagcagtatccatttttccaatgagcaagtaacgatatatgtagtagtctactaagatgagaactttagtcctgttgcgcaaaatttctgaacacatgattattaatatgcagtcttcataacatctgagcagagagacatgggaactttggctcctatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctacagtttcttctagtatttttatgatttctatttttggagtaaaacctgaatccatctggaatttacgttggtacatgacctgaaactgaattatataaagtaaccagaaaagactgttttgtataacatataaataataagtaagatatgtttacttggcttaaaattacttagctcaaagtctaagctaatgctttctggctagggaaatgattacccaaacccataccagaacgtgcttaataatcaactcctcagaacctttgcagtcagtcctttataatatattatttgaaaccattcaaatcttgttttaaaatgcctttatctctagagagtcttcactttgaagccctctttttaatattcagtagttctgtcagtgtctagttcatttggtactgagacaaacgtaataattaactttcaatggaatcccaagtcaaagcaaggcaacttagactccttagtgctgcattagagcagaataagggatgcagcttcatttcagtccagcccagggaggaccctggatcctatcggagctcatgctggtgcatcctcagtaggaccactctggcatgttcagtccttcagcccttctctagagtaggctcaggcatttatgccaagcaggaccttgtttgattctgaattaccccaagcccctggaggtggctccaaattggcccacttcagggattccccgatcagagaagagctgaaaatattttcattttgagtataatgtcttgaaaccaaagaagcacacagaaaaaggaaaaagaaggtaaaagtggcccaatagtggtctatttcacaaaataaacaataatcctctggtaaatcaagaattagctataataacaattctgaatatataaaaaagaccttttccaagatccttaaaataaggatccaatggaaatataaaataagaaaacttgttaacctcttttcatatgcttgcctggttcttgaacagcagaagaagggaaatccttgaaatgtacactttttttctttcacaatttaaatcttcaaagtggggattgtcttaactaaaaatagttgaagagtcaaatctccatcttttttcttgataggaatgtttatgtgggctgggtgtggtggctcatgtctgtaatctcagcactttgggaggctaaggtgggtggatcacctgaggtcaagagttcgagaccagcctggccaacatggtgaaaccccatctctactaaaaatacaaaaattagcccagtgtggtggtgggtgcctgtaatcccagctactcggaaggctgaggcacgagaatcgcttgaacccaggaggcagaggttgcaatgagctgagatcatgccactgtactccagcctgggtgacaaaacaaaactctgtctcaaaaaaaaaaaaaaaaaaagaaagaaaaagaaatgtgtatgtgtatataaatacacacatacctacctatatacatgtcttctgcaacactgtcttaatggatttgggataatgtccattataaaattagggttggtatagagtaatatgtgccacgtaagtgagcccctccctccatacacacacatagacatacaaatactccaaattagactgcatacactttctcacgggattggtcattttatgttgttatgttaaaaaaagaacttgttttgttatatagagacttactcatatcaataatttctacttcttaattcagttttcaccattttgttagaactcacacatgtaggctacattccaatttgtatgcattcctactcttcatatcaacaaaaaagtcaatttccaagaaagaaggcaaactaaaagtgcttaatccactgttcctcttccttgcatgtttacttcatggagctctagaaggcccctgtgccatgacattaggaaagctgcgcttcaatgttttgtcatatggttctctgtaagttctaggtgctgttcagtcatcttattaaaccttaaaatcgcagtcaaggaaataatttagtgtattctcctttttcattaaaattgcagaaaggatcttttaaatcaatttttttaatttctcaaatgtgtaagttcttcagtgtgttcagtctgtgtcgactataaataccttgagatagttaaattttctaaattgccttatttattcttaggagttttattttcagacttgaaaattaagactgtttccaaacatattgttactccatttaatataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtcataattagcaaagttgaacttgaagactaatatttaataagaaccataaaatcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggtataactttcataaaaattctctaaagacaaaagtacttttttgttgtcgtgtcatttgaatgttatggcaactttccaaatttttgtagaggtctggggagcaattaaattgctcagatgctttttgaagtcttctctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaataatgccatggtggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaaccagaaggtgaattcaagtaggttggctacatagcccttttcttaatcactacgtcataggcaaatatgaaaaagatggtaatattgtgtcaaaacacatgatacatataaatgcaattggagctcaaaagggagaaagatcgatgtagtttgtggttggcaaggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaataatttttttagaagaaatgtcccataagaaggattatttcagggtctttgaccaatataagaaacaggaccttcagttttgtagcaggtgaagtagcatttgggaacaaaaatcaatgtaaaccacaggcatattaaaccatagttcatatatgatacagtaagggactgacgtgatatggttccagcacatggccttgtagtcaaccacactattatacacagaggactattaacagtggagcatccgttagaatcccatttagccttccattcattcttgcattcaatacatattcattgaggcttaataggtttggcagtattcaaagagctggagataaagcaatgaatgctttatgaaaggtcattatttgaggatctgagcaagggttaaaaaatagtctggtggatgccatgtgcataagaaaaagcagggaatttcataaaagggtggaggaatgatggtctaggaagcaacaaaaaggaatgaagatgattttgagtgtttttctcaactatgaagtagcccatatgtaggagaaagagcagcatctacttgagatgtcacaaggaacaacttgttcctaggctagaactaggcttctctaagacaaggatggatggaatgatcagtggagtgaatgaggatgtagaatcatttgttcattatagaaatgtttggattagagtggaggaggtgaacatcaatggttggatcagggaagaggaagcaccagagaagtggagaaagaggtgactgatggggcctgcagtttgtcagtgaccaaagatgatcagagtgtgaagcttgggagattaagtcagctacaaggtttccaaaagaatgagtccaaccagttccagggacatgggagattgctgctactttgaatgtttagtaatttttttgttcgatgccagacattatgcattttacctcttttttttgagatggagtctcattctgtcgcccaggctggaatgcagtggcacgaactcggctcactgcagcctctacctcctgggttcaagcaattctcctgcctcagcctcccaagaattgggattacaggcatgtgccaccacacctggctaatttttgtatttgtagtagagatgggatttcgccatgttggccaggctggtctcaaactcctgacatcaagcgatccacctgccttggcctcctaaagtgctgggaacacaggtgtgagccactgtgcctgaccgcattttacctctttgggtctggatgttcttttgttcctgtaaatattcttgagctttattctaggatacagttaaattccttgaaaatggtttgatctttttgggtcttccttttgtaacttttattggttgggatggggacagtgttcagtctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattcaaattacctaaatattttccttcaaatgtacctgaggctcagtccattttgtcctgtcttcaaaagaccagaatagttgcattttattatcctcagactcattggagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcgaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgcttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagaacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagattttcttggcaaaaggttgagcttacatttagttttggaaacaggccacttcctggctgtacaaagtaaaacatattttttaaaaaaactttaaaaattaatagatatcgagttgctatttaagaattgtgcttggtggttatatagaaatatttctgaattagagagagatttgtaaccttatgtttaaatagccatagtattaaaacaaaaggcaaaatacacttgatacaaagctgcatcataaaaccatatttgctatgtctaacctattgttgttttattcttcctgactaaagctttatttatgtactttaaaataaactttagaagttaaggtataagaatctaattctaaggatagcagctagcatttataagctcataaaaaccaccatgcaacctaatttgtcaagggtttgccctgcatatctccataaactaaaacataagtcataaaaacctaggtgaatttcagtaatattattgtaatacctagtatatctaccatcctcagagaatgagaggttgcaaattaagttttgataggtaaagtttgtctcttttaagtattaacatttttatcttaaccactggattaaaaattatctattaaaaacacatttctaccttcctgccttaaaacaatatcctgaaaaaaaaagcctaaccttttttaaaattttgatgacacagactactttatgattattagttatggttttactgtttattaatttagtctgtggagctatttattcttataccaattgtgatgctttttgacttattttgggtttttattagggtttttctgtgtgtttgtttctttcctagttttctttcctattattgtattgcctgcctttagttccctaattcctccattttgattagctcagaaaacattttgttaaatttaaatggtatttaatccaaaaacattcttcttttaatagtctagaaattgaatctataatttaaatattgacttcattttggaaatccagtttttggttagccatctatagtcatttcagggaatatttattataatatttatatgtaatctataaatatgtttctaaaattatttagctgtaattttctatataatatgtaagggtctgataattttgtaaagcaagtccaaatagacaaaatgatttaggtgcttagattactcaacattatcttccagtcaggaagaaagggcacttttagaactgacaccactatcaaagcaagaaatgtttctcacagcttaatttctaatattttgaaggaatattttgtctagtgttttatatagacatgtcaactaatatggctattttgttccttcataactctgtaatttagcatgctaataagccctctttgaaattcttctgtttcttccatttcccttcaatattagcattggttcctgatatttatagatatcaatatagattttagtgagttttgcagaatttctgttagcccctccaatctttagctgataactagaaatctattacagcatttatttatttatgactgtatagcagaacatacactcatcaatatgactttgctttgaaagaatcataaaaattagttaatgatgaagattggataccttattcctgaatgaaggcagttaactatgtagccaagtcattcatttacaagaattaacaaaaggttgtctgaggacccattaattgcaaacagtaattcagaagtccaattgtagtaggcaggaatagtcagataggatataaagtccattcttggtcccaatgccaaatctcttagatgtttttaatgcaagtaactgtttgccaagggaataaacatcagcagtacaataagttattttacataataaagtaaaaatttcaagtaaatcaccttaagaaataattaataaaagctttattatcttctgttattagaaacacaagcacacagttttgtaaagcatgaaaatcatgtacatatcttctaataacagaggataattcatgtaatgtgatctcactcttagaaaaaaagtgttttattaataatggattcacttttcaaaatagattatctaggcctggcacagtcactcacacttgttaattccagcactttgggaggccaaggagggaggatcacttgagctcaggagttcaagaccagcttgggtgacatagtgggacctcgtctctattaaaaacaaaaaaattacccaggcatgctggtacatgcctgtagttccagctacttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgcccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaatgcccaggatgacaggatgactgtctttagccagtagctaggcatcctgaattgggaagaaggttgcattaatgaatcaaagctcctctctaacataaagaatccttgagtcccgcaacctgaaagactaaagaccaatgcaaattcctaatttctaagctcttttaattcctacataaacagtcacttttgactacattatagaagtgatttttttttggctcatgaacaatggaaatttgtttctcacagttctggagaccggaagtctaagatcagggtgccagcatgatcaggttctggtgagggccatcttctggtttgcagactgcagacttctccttgtactctcacatggtccaaatagtgaatttgtttttcaatatttcagatgtaagaaatggacatttgtttttttcaatcaaattaagccaaactctgagctcttagaccaagctaggagatgagccatttactttcagtggtttttcaacgtactctttcagggttattcaggaatctgatatcatcacacaggcatagaaattagagaatagcctccatcttcagcccaccgtggtcactgctgagatccctacagtccaaatgctccagctggagtcagtggttccatttccttccaatgctcatgagctccagagcctccactcttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacatacacagtacagcatcttccctcagcatctgtgggggtttggttccaggctccctgcagatatcaaaatttgtggatgctcaactccttgatataaatggtgtagtatttgcatataacctatacaccttctccctcctatactttgtcacctctagattacttataatacctaatacaatgtaaatgctatgtaaatatttgttatactgtattctttagggattaatgataagaaaagtaagtccatacgttcagtagacaaaatatttcccccacatatgttcagccgcatttggttgaatccacagatgtggaactcaaggatacaaaggctgtattttgccctcatagaaattagtctagtgggtgtgtcaggaagtaaaaaaggagaacaaatcattgtaaatgtggtaagtgctttgatagggatagtccctgtaagaggagttagtttagatggcattcaaagaagggggccaaggaaggaatatttaagcaaaggcatgaaggctgaggagttagccatgtactgactggtgagtaactttccagggagtagggtctgcaggtagcaggaagctctgaagagggacagggtttggctggtttgaggaactgaaggtaggtcagcatagtttgagcctaaggaggaacaggaagagaaatgtaccacgaggaggctatagaggagactggagccatcaggaggacattggaagccatggacaggagtttagatttccttcaagtccatggaaggttttaaatctgagattatggaatctgatttaaattttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatact

SEQ ID NO: 36414 - DNA, 104034 bp, Homo sapiens; identical to SEQ ID NO: 36413

SEQ ID NO: 36415 - DNA, 55507 bp, Homo sapiens
ggccccccccccaccctttttgttgctgccgccgccgccgagtgtcactttcagcgccgccgcctgcggtctcccaggccgtaactaccccaccgcctgccgcctgcgcccgcgctccagccccgccgcgcgcctgacctttccccgcgcgccccggcccccgccggcgccgcgccgcagccccgcgcgcagatggcgcactcggctgccgccgtgccgctgggcgcgctggagcaggctgccccatccgcgtggagcacgaccgccggcgccgccagttcactgtccggctcaacggtaaggcggccccggcccgccccgaccttttgtctgcgagcgagcggggcccgccggggccgcccccttgctgggtgcctgtcccccgcgcgcccgcggcccggctccggcccgccgcccgggaaggctgttgcaagcgcgcgccgcggggtggtcccgggcggccggagctccgggcgcgggccgggttgtgctcggggccaggtgggggcgcggccggcgctccgggaagtggaacgggctgggcgggggcagacttcccgggagagcaggggccagggcggacaggggcccctggaaaggcagaggcaggagctggggcagcgcgggtcccctgtctcagccgcaggggacccgcacctgctcaggcccacttgttcacgactgttgggcacccactgaaggctcctgtttgagatcctggaaagttggtcagccgtgacctgtccccttctgcgggtggtatatggcttcctgctgcccctgggaatcttagtctttctacacgggggaggcctgcggacctggggctgaccgcgaaaggggcttgtggtcccctggggggagtgaggggcggggggatggctatcactatcaagacttcagtggctctgggactggccatttgcctcacttctgtgtgccttagtttctccctctctgcaatgggaataataccagtgcacaccccattggctagttgtaaggatgaaagactgtaacaaatgtaaaggatcagaccagctcatgggggattagtaagtgctggtaaacgtggcccgatcgtgattcgtgaagccagaaagcaagggcaagttctcccttagtgtagagaagtttttgttttttgagatggagtctcactctgtcgcccaggcgacacaatgttcctgtgacacaatctcggctcactgcaacctctgcctcctgggttcaagtgattctcctgcctcagcctcaggagtaggtgggattacaggcacccaccaccatgcccagctaatttttgtattagagacaggctttcaccatgttggccaggctggtcttgaactcctgacctcaggtgatccacctgccatggcctcccaaagtgctgggattacaggagtgagccaccacgccctgccagtgtagagaagttttgattagcccatcccccctcaggaggtcccacaggtaggaaatagaactacaaaaacaagggctatgaactccctgtggcccacctcgccccagtgggaatgtccaagctggaccggtccttaggggccactgtgcccattttcaagaagggaaggtggagggccaggaaagggaaaggcttgcgagaggtcaggctgagagttgggcagagctgggatggcgtcctgactggtctgactccctgaacggtggggctcctgcgacccacatttggcttcagccaggaggggcctctgccagatctccgatgccatttggaatgtgccgagtgtcgagccaggccccactacagcttcgtggatgggactgtcacaataccctgacaatgttgtgacataccaccccgtgttacagatgaggaaactgaggctagggaccttaggaagtgattgcccagcatcacccagaacttcaccattggcccaaccaaccctacaccaccaggcagaggcaagtcctgctactgctgtggtgctggcagggctcagctggccaggacactcggggccctggcgactctgggagagaggcctcatggctttcaaatcctctcttctgaggttccagagcggcctctggttcccttgtgggctcgggagggccattatactcagagacagaaagaagaggggatacgtttgttttttttttttttttttctttttctttctcttccaagtgggtacagccaaaggacagccctccagagctggccgtggtcagggctggacatgcccagccgtatttctaaacttacccccttctggaattcactgcccagatagctgaccacagatgtggctgggcatctccccagccaagcccaggggagaaagaagagagaggccagaggcccccaagggagtggctgtgcagcacagggtggggctcttctgggcttccaggccccactgggtttgggtgtgtgtcttgggaccagagaggggtcgtctgagtctgagcccaggcctccctgagctgaggaggacaacaggctgtggtgtcattcccgacctgtaaggcaagcctggaggctggtgctgttgtgcccactgagagatataaacactgaggctgaggggtcaggtagccccaggctcctggtgcagaagtgttcctaggctgtccacatagcacagctaggctgattctcttcctgcgagctctggttctgagtgagggaaaacgtttgagcacctttgtttattaagcatttacagtgttctaggaggccctgggcacctggagtcactttatttcatagccacacaccacagggagaggggaaactgcatttcccatatacagatggggagactgaggcatggggaagtgaaatgacttgcccaaagtcttgcaccacagaggtggaagagctgtgattcaccccgcaagtatttgttgagcacctaccatgtaccaagcactcttttaggtgtcggggtctcctggggctgacagtttagagagggaaatggacaagaaatagagtcagttttaaagtatcctggaaaacaagggctttcatgagaggtgcagggggcagaggggaggctgtgttgggcagggctgctatttacaatcatgtgtctaggaaggcccctccctggagggtggcatttaagtgaagacctgaaggaggcaagaaacagagctgcaacagggaagagtgttccaagtggagggaatagcaagagcaaaggctctgcagtgcctgcgatgccttgtgtgtgcaggatgggtcaagaggtcatggggagcaggtggtgcagggcctggaagccgttgtcctatgggctcggctttgactctgaggctcccaggagggtcctgagcagaagacagatgggatgccccagctccctctagctgctgctctaaggggagcaaactgtggggaccaggacagagcagggaggtggttactttactagtccaggcactgcaaacaggcgtgggagaaacgtctagatcctggacagatgtggaaggaagcatggctgtgacttgcttgtgggtgatgagggaaggcttgagctcaggcttgtctgatgccatatcctggttctgaaatgcaagcttgtcattactttatagatggggaaaccaaggcgcacagcctgtaggcagctaagccagaatcaagcccccggcctccatctgaggacggtttctgaaggttggaggcagctggaagagacccccacctcctgggcagccccttccttagccttccctttccctcacaggcagggctgagtgtcccacttgctgcaaggaaaggaacacttgaggggtgcagaaccctggaactttctgcgtcctccctaacccccattttgcagccaggaagactgaggccccagagagtcagctgctgcccctggcctccctcagcacccctggatgcagtggagctaagatcacagccccaggctttgggaggtgctcagatcacagccccaatatgaggccgctggctgtgttgggctgggctggaccagggtcctctggggaggggagggacgtatggttgagcttctccaggctcacagctccctctgcctaatctaccaatgaaccaccaacatgtggcacctccctgatccaggctctacttacagaggtgccagaaaagccggccagggtgtctgcttgtccttgtcccgtgccacagctctggcgcctgggctctgcctccgtctacctcagtctcctcatctgtatattcgcgttttgatctgccagctctccttgcggggtcagtgtgggccgagtggagaaagcagaggtcaatgtcttctgcagactccacatctcccagaggtcctgcccctgtcccctgtctgcaagctttggtctttctctgtgatcgcctcccctgacaatttcctggccccctttggtcccgaggttcaggaggggcagagagagcatgggggtgcagagacccagggacgggtcccccacgagcagtgtagctttaacttttcccaaaccagtcacgtgatgctggtggggttctcaggcccaggagggaggagggtggtagtgatcatccagggacaggtgaggtctctggggcagaggggtgtcaggactggcataagatcacctggcagagttgagactggaactgagggccctgccctgccctaggcttgctcctgtggctcccaagtgacaagtcttgcccccctgtgctagtctgaggtctggagttctcaaggcagctcttagagctgcccagataagggcctgggccaggcccagaggctatgcctatgtcactgtgagccgagacagcaggatccacagtgcccagaagtgaaagcgtggctgacagtgctaccctggtgtcctgctgtcccatcatgggggctgcgggtggtcaggggaggcttctgggcacgtgacctttgggctcacctgaaatgagaaggaagggtccccggaggccctgggcagaaaggtgacaggcaggggagcagccaccaaggcagggaggccagagaggcagctggaccccaggcatgtttagaaagccatgtccacggtcctgccgagggtcaggtcagatgagaaaaggtgaggaggagccaaggaccttggtcaagctttggggacttgggcattttcctgggatgtccaggcaggtttggggcaggacaaggagttgagcgtgaggaccggtattgcatttgtggcctgtgtcatgggtgtaacacttgtgactgggtggcctttgaaggccctccaaggtggggttcaggtcctggccagatgctccgaggttgctgcccaggagcctggctcctcgctggcccagtgccatgtggtctggcccatgtagggtgtccatttaaactcggtcttttcctcacatacagccccaccaccaccgtggccaccccagatgccctctgttcccctttcagcctgaagaccctcctttgactcagccctatccccagtcaactccatacacctccgtgactctcattccaggtgagcccaaacgtcacctgcccagaggcctcccctgactgcccgcagcacccatgacgggacagcaggacaccagggtagcactgtcagccacgctttcacttctgggcactgtggatcctgctgtctcggctcacagtgacacaggcatagcctctaggcctggtccaggccataggcccttatctgggctaggctctaagagctgccttgagagctccagacctcagactagcacaggggggcaggacttgtcacttgggagccacaggagcaagcttagggcagggcagggccctcagttccagtctcaactctgccaggtgatcttaccccagtcccgacacctctctgccccagagaactgacctgtcccgggatgatcaccaccaccttcctccctcctgggcctcggtttccccatctgtacatggggctgtgagaatcgtgtttagtgggatggttgtgaggatcgttgtgtggagagagcagagcacgagcctgccctgtgctggggctgcacacgcttgggccaccaccgcttctgtcctgctgtctcctgggagccacagcctgaggtgcaggcctggctgtgggaaggccagcatgctggtccagccagttgtccacaggtctgccacaaggccctagtgtgtgtctggcaaagacagaaagcagttgttttagttggacaaacatttcttgggtgtctacgccgagctgggtgcctggaatatggtagtggctgagctgtgcgatcactgagggtcaatgggaggcagagaagttctgaggactcccagggtcaggtccatccatggcccaggtggctactccagaaacactgacgcagggtgtgcacagaggagtagtaatgagcttgccaggcttcttgtatccacctccctgctctgcagagactgctggagcaaaagctgaggtttttttggtggcttgcagggccctgtgtggtctggccccaggatctctgacttggtttcccaaccctcactcccggcttgtttgggcccagccactctggcctccttgctcttccttcaacctcctaccccagggcctttgcacgtgctgttctcaccagtgggcggctcataccccacatgtcctttggggtccttgtatgccctctttacagtggcagccctgcccctccccacccctcctctgctgtatagtgatccttggcacctgtcagcttatcacctgtgtggcctctgtgatgtatgtatttatttagagacagggtctcactctgtcacccaggctggaatgcagtgataacaatcatatctcactacagccccaaactcctgggctcaagtgattctcccgcctcagcctcccaaatagccgggaccataggtgtgtaccaccatgctcagctttttttttttttttcttttttttttgagatggagttttgcccttgttgcccagcctggagtgcaatgatgcggtctcagctcactgcaacctctgcctcccgggttcaagtgattctcctgcctcagcctcccaagtagctgggattacaagcacccgctaccatttctggctaatttttgtatctttagtagagatggggtttcaccatgttggccaggctggtctcgaactcctgaactcaggtgatccacccacctcggcctcccaaagtgctgggattataggagtgggtcaccgtgcctggcccctgtattatttataatgatattacttattgtgtgtcttcatcagtacgtaagatctccatgaggaagagtttcatcagttttgttcgctgctgcctgccctgcagcccaaaccctactgggacacagtaggccctcaatgagcctggggtaattaaatggccaggctaggtaggcagctcccttggtgacggagtcagtcccagaatagcctccgatctctgctctcctgtcctgggtgagttgaattaaccccagcaggtggggagccaagaaccacatcccttgctgtgcagccaggacaggcggcagtggccacagctgggccttggccagggtggcaggcatagtccacagaaggacagtcaggcccacaaggaggaggcagcagggctggtgtgggggcggggctgcaggcatgaggggagtggggctggggaaccctcagctgggcctggcaggaacggagaaagggcatcaggcagagggaagtgcctaggcgatggcgggtgcaggaagtagcaggtgtgtcggtggagcagaaagaatggctgtggctcaggacctgcaggcctgggctccagcgtcatcttggcctgctgtgtgacttggatccctgcatctcagtagttcctcatctggaaatggggagatgaattgtagccactctcctgaggctttggggagaatcaaaggagataccaagagccagaaggcctccttgctgccgttggccccagttccggtggccctggactagtggttggacctcttggcctgtcagccttcccctcgtgttgcccagcacaggctttaagggcagattttctggggctttgaagttaaaactcatgaaacacagcatgattttaaagagtgaatcacatctgtccctttgctgagggccttctagtggcgcccagctcagaaggcttaggaggctctgcaggacctgccctatcacctccctgcccccatctctgcccttcccctcacccaccccactccagcggcccctcattcaggcctactcctgcctcagagcctttgcactggctgttccctctgcccagaacactgttccctcagaatggctggtgccctctccttcctgtcttcacctgcccccattccctggcatcctacacatcacttgcttttcatgtttattctctttctccccttccggtttcatgggggtaggactccatgtctagcttgtttgttgctatactcccagcatctgaaacagtacctggggctcaggaaacatttggtggatggataagtggatgggtgggttgatggatgggtaggtggagagacaaatagatgagacactaaaaactgtgattaggaaaaagttcagttaattgtttgcccagcagcagtttggggtggactggtgagctccaggcttggcaggcctggtggagtgtgaaaacccgtttgttcctgcctcctgtgcccagcgtcagtttctcatgaactctaccacaggcctctgatctttcctgctgcgtctctctcagggtccagcaggtggtcctgatgcgtggcgcagcgctgcctctctaatctcttcatgctctgccttagttgcagatttgctgagccctgttctgtgtccagtgctgggttctgggactcccagatccagggatgtggtggggtggggatgcagggagcagggctacagaaaggggtggcagggccctgggatgctaggactgacgcagtagcaaaggttcatgtggggctcaagtgttctaggcatggctgtaagcacgtcacagaggttacctcatttaatcctccaaaccaccctatgaaggacattttattgtacctccactttatggatgaggagactgaggcactgagaggttattcaggattcagctgtagcagctgaatgactccaaatgcctgtccctccacccgtcttggtgcctgagtccgctgggatgggagtcagcataggcttacctgtctccacaacccccaggatgtcatgaccgggccgtcctgctctatgagtacgtgggcaagcggatcgtggacctgcagcacaccgaggtcccagatgcctaccgtgggcgtggcatcgccaagcaccttgccaaggtagggcaggcaggtggcagggccaagcggggacggggacatgggggctgccaccttcgctccgaggagacggtggccctggtggccacttcagcctgcttcttggccctgggtcctctctgggccagtggccgcctttctgggcccaggctcctgttctgcaagaccctggcgtggctgagcctccaagatcctcacacacctcctgtgtggcaggtgcttcacaggagccccattcctgcccccaaccccttcatcctcagggcatcccaaaccccaggctgcctggagagcaggtttgggcttaatgaagggagttacagccagagcaaagaatgaccgtcactcccctgagggctgctgctgggacttagctgggccgtctgccggcttcccctcctccacccccaccccgccaggagaattgcagggcaacctttgtcctccatgctgcctggggcaagggggcttgtaggggagaggtgatgtgttttttccttgtgtaccggaccagtctgtggggatcatcccaggtgacactgaaactcaagggagttactgacctgggcaaagtggaagggtggccagggagccgggcctggggaggcagcagacaatgctaccttctggtgccggctgcaggccctgaccactctcctctctgcccggctcccaggccgcccctggacttcgtggtggaggaggacctgaaggcccatctcacctgctggtacatccagaagtacgtcaaggagaaccccctgccgcagtacctggagcgcctgcagccgtaaccctggcctgcaggcgggagcgctccctgccggactcttccacgtggcctttgcctggccccacgtgctctcaggaacctggtcccactgggaacagactcagagttatttttgtaaggacactcatctgtgccccacgtccagatccctggaggcagctgaccaatgatgggcggtgacccggtaaccgaggcggcaaggaggccaggtagtcccggcacctctcactctgcagagaccagcggcttcgtgggaggcctgtgggtcacacgtaggggctagagccagcctgcatcctgcccaccgggctccacttggagatcagcaggagggccagtgtgggacccctgctgccacctctcctgggcctgtgtcctttctggaaattaagaaggtgtgctccagagccaagaggagcaataagaaacctcgtgtgccagcttctgagggtggcagtgccagaccccacctgccagcggtgctgcccctttctcagacccccatgcccagtgcaggcagggccctggaaagggtcagctctccctgacagagaccagcagagtgaaggactgagcactggccaggctcaaccgtacgtgcggttcacacatgtgaacacacaggatgcagtctacaggcgggctggtggtgggtgccgggggtgttttcctctccttggtacccccatcttttttttggcctctcgtgtaggttctgcaggaaaccaaggccccatccccatgggctgctatcccctatacccctgtctgccaggaggagatccaagggggcctgagcagctgcaggcccgccccttgctggccttggccacctgcctgagccttctccgaggagatgccttggggctggggtgggagtgaagctgactattctccaaaaaccaccctcagcatccaagaggaagaaacatcagccacaggggtttctgtgctgctgccagacatcagtgtcctcttttgtggctggctacagccggatacactttgctgcccatctggccctgggctcctccccaacccagccttcctgggtgcagcctgggagacacactagcatgctttggtgggaccagcctttccagggcatgctggcttcccctggggctgactcaggtcccgccctcttgtgtcagtgctaacaaggatcagattcgtccctgcccttctgtagagctggagggtgacctggagccaggggccctttagggctgagacatttgttagtcggagtgatgcatccctacccggcttcggggggagtcaggctgggctctgggcagtacagggagaggttcaccaggacccccatgccttcctcccccggtgcaggggcagtggtcaccatgctgactcctccctttgactccatgcacgggcgctggctggcctgtggttgcatttcccactcacctccttgctatccccagtcttggcaccgagaccccccacattccttctccagcaacagcagcccaggggccttcctgcctggacgcaggaccacggagacctgcatgtgcagggaggcctggcagcctgccgatgggggtccccgagccccggagtctcctcgaaacccctgctgtgggtcacagcatggaccaggaggggtcaccatcctgagtacccccgacatccctgccccttgacctgtggcagatgctcctgccctggcctccaggaagtcagctcttttgcaaagggcttgtgtgagaggtcggagaaagccctgggcctccagggagatgcagctggcaggaggtgggctgagctgctccggggctaggggtggcccattgctggcagaatttaaggaaagagcaggttgtaggcacagaggatgggcagccaggcctgggccttccccttactgtcccagggcagcagagctagggtcctcttttaccctccctaaggtcacccccttcccatctacacgtccctccccaagttcaagcacatagtcaatcatgaccactcaggagctcagtgagctggggccatgtccctgtggcctccagcccatccgcaggagggtcccttgcagtgacagcacaaagagtcccccacaggaagcccctgagggccagcatggaccttgagagccaggagggaatgggcctggtgccactctgttcccactcccacctaagattcctacccctgtgttctagcaggtgactcttgatctggccagcccacaacaaatacttgaactaggcagcatggggtggtggaggcctgcagaggccccgggcccaggaactgagactagggctttctcatgaggcctcatcaagctcccgcaggtatgacctggcctcctcgcctcgggctgccttaaagcaccgctaacccacgccaaggggctaggcagggcttcgcggggcctggcccaaggtctccagcagagcaataacatcttcccaggttgggttgccacagacaccgtgccctggagcccccagcccatcccatctggtgctaccctgtctgcctggcagcctagcctcacccctcctgtccggtcacctgggggtccttggtaaggatgccgccacatggggccggtttatgcacctgggcgagaacctgactggggcaggggatgctcaggggcctgcaggtctcccacagagctgcttttctgcccgcctcaccctgtgggtttgtatttcttgccgggtcaaaataggcagtgactcgtgccttccctcctcagggccggcggcagggtgtggacccagctggccgctggaccgtccccttcctcattctccaagctcatcaacaggtctcagaggaacatttccataaaaggtgtggcctggcatgcagtgctgtctgcacgctgtcgcttcccccacagcaacctgccggtcagccttaactggtgtggaggtcgaggtggggagggggaggcgggcttccctccctggtgtctggcctctttttgctcagccctcagcacagccttcagcgtggagagcgagaccctgcgtgtcactggggcttggctgaggtctccctgcaggataacagtgacttcaggaacccagaccccagtctgggcggctctaccttcccggctggcccagcccccacaccacagttccctgccacctccaggcacaaaagcctctgaggccacagcccagctatgaagctgagtggctttgtgcggtctcctagggaaggggcagtgatgccatgcatgagatccgctgtgccataagaagttgcttcctttagaatttctggtccaatgcagggaggtgaggcccagcctcatgataacacatgcccatcaaggaaaagctgtggctaatgcttccaaaacaagtgaaaatcttgcaccaggcccagggccatatctcattccgccccagctactgagggaggggacagactgctggaggacaatttctcctagttaccactaggggttacatggctactcagaatgaaagataaattgccaggcctgttgcaatcttttttttgagatgggagtcttgctctgtcgcccaggctggagtgcagaggtgcgatctcagctcactgcaacctccacctcccgggtcaagcaattctcctgcctcagcttcccgagtagctggaattacaggtgcccaccaccatgcctggctaatttttgtatttttagtagagacggggtttcaccatgttggccaggctggtcttgaacacctgacctcaaatgatccgcccacctcggcctcccaaagtgttgggattacaggcgtgagccacctcaccaggccccgttgcaatcttactccacttcgttttcacagcagtcccgggacatgcccattattaggcctatttgatagatgatactgaggctgagtcgggggtcacaagccaaagccacaccgctagaagggctcaggacccagcccagctcccgtcctcttggtggcatcaagcttgtgtgatatgaggtcttatgtctgctcatgacagccttaaaagcaataaacagatacaacttccagcaacttcccactcagctgcaaggctgcgggggggtcctgcctcgagccataaggtgagcagctagccagtgccgggccagtgtggagaaggctgaattgcctgtgaagctggggttgcaggcaggaatattcatggagcccctgaccatgtactcacactgctcttcctcagttcagggttcttggatttgctcaagtccacccaaatatccctttacgattctcagggtcccactccttccagatccaatgccctaaactttacataagagttccggcaaggctgtgacttcaacttgtgttgtaactgcaacctgcagaatcaaatttagggttatgttttcagttgtatcagtcttacggctacaagatattaaagagattcttttctggttatcaaagatgctctctggttttctgtccatgttttgagctgggtttatcacttctgactccagtgtagtcagaagccaccagtctctccagctgtccccatgacatgaagggctgcagccatttggtctctcaaactttgccttcaagagacacttcacgccaggcacttaacataggtgatattgtgaggactagttttgccactgaatgctgtgactttccagggtaccacatcccctctgacagtgaggtcattactgcgttccagcccaatccaggcagataaccagtccccgatttccagcattaaggctctatttctaggaagtcattcctgctaccaaggacattaccagtcagtgaagagtcaggaaaatggaaattgcccaggcacttcagagtggatttaatgcaggggactggttatgaaaactgttggaaggatgagaggagtgagagtggaggtgagattgccaaaatattggtaagtaagtgcaggaagctgcttttacatggaggctggaggaacaggtgtcacccagaagcgtctggggatcacagggctgctagggtactcctggtagaaagttgatggctgaacaagacccaggtgtgcatgcctgctgttgccaccactaaaaaaacccccagatccaggaactttactgccttctgattgatcagtgcttcctaccagcagaaacaaattggaagcccactggtaagggctctagcaaatgtagtttgcaggcttccagcttctctgtgatcagagaagggaagggctggcaaccaacagacaatcagggcaaggagaaatattcttgcctgcaggggctgtggcatatgacataaatgccagttcattgataccaaggctgaggcaaagcatctagaggatgacagaccccagaaccaggcagaccaagaatggatggatagtgggtagatgattgggtgatagatggaggggtagatgagtgggtggatgggtaagtgggtggatggatgtgtggacgggtgagataatggttattagcaataccagctcatctgccatcactaataccagcacatcatgcactggagtgctaaaagtaaaaggtcccttgtcttgggaagagcttgtctgagggtcgagggagacacttgtaggccattaaacatggagtcaggtgggagatctggctgggtgagattctatcattttctgaattagggagagggtggaacccaggagttgaaagacggggccccttgagcggtttgttcctgagagttgtcctgattcaagaggaaacttgatggggtcatacattgggtgtggaaagacactgagactgcaggaataagcctctgcatggccattctggaatctaggaaaggagagccagagcataaaaatgtattggtgtttcatctgccaactaagacaaaaagttcaactaggtgccctggactaggtcgtctcatttaaacttcccaacaagccatgaggagagaacctgcatcctgttcaggtggagccactgccctttggagatatgtcatccacaccgtgctcagtgagggtgacccaggcagatggggctctatcttcacaggacccgagttcaggggagggggatgagaaagtacacacgtagcaagaaactttgtgaccagactattggtgcacacgcaggcgacgcacccagtcccaatgcggagaacttgcaaggctctcttgaagaaggagatgtgggctggggcctgaaagatgagggagctttgcaaggggcacagcctgcaggccccaagggatccaggcctcatggtctctgacctcatctcccactactcttctcctttctcactccaccccagccacatgggcctcctgctggtcctcgtatctgcaaagctgctcccacctcagaggctatgccctctgcccagagtactcttcccctagatatgctcatgactccgtccctcacctccttcaggtctgtgcccaatgatcaccttctggatgaggccttccttcccagttctcccctgcctaacatttaaattgccgcctcctccacttctgatccccttaccctgccccatttttttccagccattgattttttcttacacaatgtatgatttatttattttatctggtttattattcattgtctctcccagctagaatacaagctgcatgagagcaggagtttgtttgttttgttcattgcagaatcccagcatctggatcagtgcctggcacacatttagtgctcaaaacatttgttgggtgggtgggtgggtgaactagtggatgggtgtgtggataggtgggtggatggatggatgggtaaatggatgaatgaatggatgagtgggtgggtgaattagtggataggtgggtggatggtgggtgggtggatggatggatgggtggatgggtgaatggctgggtggatgggtgggtggatagatggatgggtagatgagtgagtgtatggattaaagggtggatgggtgagtgggtagatgattgggtggatagatggatgggtagatgagtggatggatggaaggataggtgagtgggcagatgagtgggtggatggatggatgggtgtgggtggatgagtgggtggacagatggatgagtggatggatggattggtggatagatgagtgggtggatggatagatggacgggtggatgagtgggtggatggatgggtgggcagatgagtgggtgaatcagtggatgggtgtgggtggatggatggctgagtggatgagtgggtggatgggtgaatgagtggatgtgtgggtggatgagtgagtgggtggatgggtgggtggatgaatgagtggatgtgtgggtggatgggtgagtggatgcatgagtgagtgggtggatggatgggtgtgggtggatgaatggctgggtggatgagtgggtagatggatggaagagtggatgaatgggtggatagatgggtgggtggatggatgggtagatgggtggatgggtggatgggtggatgggtgggtgactggatgaatgggtgaatggatggctgggtggatggctggatgagtaggtgggtggatggtttggtggatgagtggatggctggctggctgggtgaatggctagaacagtgagggagagagggctccaggtggactaaccaacatgagcaaagacctagagatgagagagtcatgccatccttgaggaatcgaatgaagatgagtgaggctggcagggggaaggtcaagggatgagactggagaggtgggatggctggatgatggacagccctgaagtgtgggagagattgttagcagttcaatgggttttcactcatgggcacacagctgcacctcctgccacccacacagcagatggggcctgaggtctgcattctgcaaggagtatggatatgggctctctccaggctctctctttcccgttccaccgctgaataccattggttactaggccttgggaagggtgaatctactaactgtaaagaacacgggtttccgaatcactgcattcagcttttcaggagaaaagccacgtgccactaatgagctctcactctggcttgttatgtgagaaacacatctctgtggtgttttaatcattctgcattttggggtctatttgttacaggagatagtgtgcactaatgaatacctcaaaatagagtgccgccataacttgaaacctaaaatatgtaccattggcttagtggccaggcagcagggaacatgaaaatagatgttgcagaatggaaagtgggagacttatgtcatgcagaggtgaaatgtttgttagacctgtagcctacaatagcttgaagggaagactgggagaagtaagcctgtagctccagaagaaggtggctgagtgagctgcaataaaaatgtatgttgggctgggtgcggtggctcatgcctgtaatcccaacactttgggaggccgaggcaggcagatgacgaggtcaagagatcgagaccatcctggccatcatggtgaaaccctgtctctaataaaaatacaaaaattagctgggcatggtggcatatgcctgtagtcccagctacttgggaggctgaggcaagagaatcacttgaaaccaggaggcggaggttgcagtgagccgagatcgtgccactgcactccagcctgaagacagagcgagactccatctcaaaaaaaaaaaaaagtatgttagtcattcctttggtgtacagtaaggtattgtgagacagagacgcactcaagcaagatataaacagtgtggaaatagaagaaagggaaatatgaagagtttgaggccttgtagtgttggaaaagtgaactgtgaatggatctcaaatagcaggaaataaaaataaaaaggttttaagtagcaaaggctcattaaaactctcaggtctacaaaggccttaatcctgcagcaaggatcaaatgaagtgggtggtcttgccccactaactgttgagatgttctcaaggtcagtgtcagtacacagacagacagagacagcagagacagagacatgggaaataaggaagcaaagaaataaagctgctggaagatgacagtagaaaagtacctcgggtgtggtcacatggaacttattggaaggaaaactccctaaaatctggagggaattgtattgccaaagacaccacaagcctgtcattgtagaacaagccttgggcctccacccttgtacaggcaggaaaagagctgcaaaaaccatgtggtccccacctcagatgttgccacggagaatactggatgaggaggggcctcccagaaagcagagatgggaaatccctccacgagtaggacagggagcttcacaacaccgccagtcagattctgcaattgtggtgtgggggctgctgtgtgtccctgttcccccttccctaatgagagctttaactgcccccagtcagttcagagggagcaggaactggattttacttggagatcacgggatggtactagcggagagcatggaatgttccaggagatgcagggccacaggcagagacagatggagtctggggtcatccctctgggggagggtgtgatagaagaaagagcacactgctatctcgttgccagaaagaaagactgttgtgagactcatagtgaatcattaaaaatccattttctgacctccctggatacacagactatttcatagtctccccctgcagtcaattgtgagcagaggtggactgaggcttctaagagtgggagggctcctccctcacctctgcttcccttaaactggctggatagagaaggggaagaagacagttggagcctgggtccctgaatcaccgcgtggaggaaagctatccactggcaagagacacctacttcacaccacagtgaggaagaaccagactgaactgcatcttaactatgaagcatttctcagcccatttgctccagcagctgacaacgccctgacaaacacacaggccatggccagggatctagacttgacgctgaggctccactagaagattctaagcagagaagcagtatggttacatttattgttttaaaagaattattgtggctaggccaggcacagtggctctcgcctgtaatgccaacactttgggaggctgaggtgggaggattacttgggcccaggagttggagaccagcctgggtgacacagtgaacctctatctggaaaaaaaaaaaaaaaagagaaaagaaaaaatatataactgtggctgggatgtggaaaaaggatgggagggatgaaggctagaggtaggaaggcagattagaaggccgtggcagatgctaggtgagagacgatgacgtcctgcactatgattggggcagtaaggagagagaaaatgggtaggtttgagagctgacaagtggcagggtcaggactggaacctgggtctgcctgggcagaagggggtgtattgaggtgtgtgtggtgtattatatgcgtggcccccagactccatctctgctgtggccgagtcaggccagagtccatcactcctcacttgaccttttggcctgactgctgtcttgccccctgtgggctccatgcagcagccagaaagagctttctaaaacctcaatcacatcgtgtctctctcctgctcaaaagtccccaatgccctcttatttactgcatgaaggataaaacccaagggccccaatgctgcctctgcttacctatgtccctccacttcatcacacttcagctgcactgacgttatgttcatcaactctttcaagctcattcctgcctcagggcctttgcacatgtgttccctctacctgaaatgttcttcttctacatattctcctagtttgctcttccttgtcgtttaagtctgttttagttaaagacatgtttagctgctagaaaagcctaacccacagggcatttcatttatctcatgtatcatgaagcctggaggatgaaggtccagagtttgtgcagtggtgcaatgatgtcatcaaaggcctaggctcttctcaacttccctctgcagcatcgttgctatgttgttttttgtcctcatgcttcttgcctcatggtcacaaaatggctgctatgtctccaggcatcacacccatattccagacactgccttccctgacctccccatctaatgctggctccctaggcactctatcctattaccccatcttattctgatcccatatcactacttggaagtttcctacttgtttccttgtttgctgactatctcctgtcacttcaataaaagccccactagggcaaggggtttgatttccatcttgttcattgccaaattgccagactgccaaattgccaaagcaatttcatttccatcttgtttactgccaaagcccagccctggcacagtatcaggcacacaggaaatgctcaataaatatttgtagactgcatgaataataaagtcccccagctggcttggtgccaaaggcaggactcaaacctgggtctcccaccttatggttctgggaatttcctggtgtatcctgatgcctccttgccactctctgtgaggaatccaggcggtcctgagcagcagccaaaccctcggcagtctccagccatgtgaacaaagagcctgtgttttgaggcccagtggagagagggagaatcccaccactagcgtttagggagcgctccctgctcacaggtgagcatttcttcagaggcacgccggctggcaggccttcctagatagagcaaagccccaagttcaatggcacccctcacctgctgggaaagagcctccctcttcaaggatcttccagtcacctgtgtaggtgaagtagggctcagctccaggccagcacgcccctaactccaacaaatgcagagcccaggcaccgagatgtagggaggcagccaagtctatctggaattttataatattttggctttggtcttcattgtatttacttttgcagttacctgcacatgatacaggtgttccatttaggtggctgcacagagcttccttttctaaataaaatatttattttttgagatggagtttcactctgtctcccaggctggaggatggtggcacaatcacagctcactgcagcctcaacctccagggctcaagcaatcctcccacctcagcctcctgagtagctgggactacaggcatgcaccaccattcccagctaattttttgatattttgtagagacagggtcttcctgtggtgcctgggttagtcttgaactcctgggctcaagcaatccacctgcctcggcctccccaagtgctgggattacaggcatgagccaccacgcccggccagtttcccttttaaataatatgtttcagtgttcaaagaatgaacccacttaagaaaaatattgagtggatgaagggtccagcgtgatggcagggctcatttctaagcagagaaagaaggcgcagaagcaggggtggctattcagggccactgcaagcgcatgatgtcactggggccagagcccagaccaccacttactcttcatccagcgcttgtcagccctaagatcagagatgcctgggccagtcttgcgccagatgacccatgcagctgaccaccatcataccatccatggcaacgtgttccatgtggacaggctgcctcccagaaatggcctgtcctgctgaggtcatgttagtttccaggggcagggaggagggtgctgctgcaacaagcttccatgcctgccccactgggtgccctggcgcaagcatacaagtgacaagtgacagcactcatagccctggaaacaggaccctttgcactttccacaggagctccacctgcactggagagtaaggacagccaggccccacagctgcacagccaggagggaaccaggcgctgctcacaaaatgcctgcatttccgtacgagcgttgcttttagaatttaatgcacaaggcccggcgcggtggctcacgcctgtaatctcagcactttgggaggccgaggcgggcagatcacgaggtcaagagatcgagaccatcctggctaacacggtgaaaccccgtctctattaaaaaatacaaaaaattagctgggcatggtggcgggagcctgtagtcccagctactcgggaggctgaggcaggagaatggcgtgaacccgggaggcggagcttgcagtaagccaagattgcgccactgcactccagcctgggcaacagagtgagactccgcctaaaaaaaaaaaaaaaaaagaagaagagagataatctggagtcttgccataacatgatcaacatattgagcacccccgccacactttttcctaagatgatgatgctttttacttttcttgaggtttatgatgggatcaaatggagatggaaggaagggtcatgactgggccttggccaggggtgaccagtaagactgacagtgctcctttcttcctttctgctgggattccccaggatggcattctgctaatccaaaaagcaatgtggtgaggcttccagattaacagttgactgaagattatatattagggcttcctcactccagcctgggcgacagagcaagactctgtctcaaaaaaaaaaaaaaaaagaatttactgcacaaataagcctagcacaaagcaggtgcttataagtattagctgaaagaaagatttttgaatgaaaaaaatggagaaaactacacttttttttcattaaaaaatggttagctgggtgtcgtggggcacacctgtagtccagtcactcgggaggctgaggcgggaggatcacttgagcccaggagttctgggctgtagtgtgctatgccaatcaggtgttcacactaagttcagcaccaacatggtggcctcctgggagcaggggaccactaggttgactaaggagaggtgaaccagcctctgctggaaacggagcaggtcaaaactcccatgctgattagcagtgagatcatgcctgtgaatagccactgaactctaacctgagcaacacgagaccccgtctctaaaaaaaagaggggaaaaaaaagaaaaatgaaaattaaaaaaaaaaaagaataaacgtatcagatcacacccttcctaaactcgttttggtccctgtagccgaaggatgtcagagggcagctcagtgcttctccctacaacacacactaccctgtctcagctgaccccaggatgggcagaaacccaatctgagcttatacctaggagagcaattccaccagacaccactgagaacattccagaacaaataaggataggagtttgctgggaggatacagtgacctgacaggcactggcccactctatagatagcagtcgctggctgggccttccctgctctctctggccctgggctcccctcatagtctctcaggaaacccctacctgccatcaccttccttttccttttccttttttttttttttttgaaacagagtctcaaaaagtcaggctggagtgcagtggtgcaatctcagttcactgcaacctctgcctcccgggttcaagtgattcccacgtctcagcctccggagcagctgggattacaggcgcctgtcatcacgcccggctaatttttgtatttctagtagagtttcaccatgttggccaggctggtctcaaactcctgacctcaagtgatccgcccgccttggcctccgaaagtgctaggattacaggcgtgagccactatagccagccaccttcctccttaactcttgcccaccacccatgcttggcacaatcccctgtacagaggaccaagctggaagaaaccttccataattcaactcctttttaaaggagagaaaccaaggccccaaggtggggtgacaggttaggggcaggtgggacagagacccaggtgtcctgagcctcaatgcaggactcctggccacaatgaatgcacgtgtgctagacctgggaggcctggagcagcaggaaggaagcaggaagagccagccgactggcaggtcagtacagaggcggccgccctggcctcactgatgcacaggcccaaggcagctcctgagggcaattccaggttgtgcccaacccaggctgctgtagacaggttcaaaaatgtgcaatgtcaacacagctctgactcctgccactctgagctgccagggaaagttccagagtgatctggctggggagcctgtgtctgggtgaggagagagtggcccccaggcaggagctgacagaggtgacagaggtggtgaactcccttctactgaactttcagacaatagagacacaggtgtgagggcaacagggccccactgctcccctccagatgggggtgctgaggtctggaagactcttggggcctcttaggaaggcctctgtaacctcctaatctcattcactcctaagccaggcaccaagggctcactacgctgaaactccctgttccaagtcacctgcctgaatgactccacaggatacaccgtctctgatggcacagggtctctccttacttttggactgatgttctcactctgtcactttgcagtgcgttgaatggtgaccctcaaagtgacatgcccacatcctaattcctagaacccgtgagtgccactatatttggaaaaatatctgtcaatgtacttaggttaaggatctttcattacgatgatgattattttgagacaggatatcgctctgtcgcccaggctggagtgcagtggtgtaatctcagctcactgcagcctcgacctcctgggctcaagagatcctcccacctcagcctcgcaaagtgctgggattacaggcgtgagcctccacacccagtgagattaaggatcttgagatgaggagatcatcctggattatctgggtgggccctaaacccaaccaagtgtctttatacgagggaggcggagggagagttgagaccaagaaggctgacgtgcaaccatgaggcagaggctggcgtgacaaggccacgagtccaggcaggccacagccaccagaagtgggagagggagggagcatctctccagagcctctcagggaacacggccctcccagcaccctgatttcattcttctgaacaaatgcttgctgtttgaagccaccccatttctggtcatttgctacagtggccacaggaagctaagacctgtcgcccccccaatccgtggaagcaaatcccaaattattcccatgccccctgctgttctccctcgctggcatctttcttgcctctcttcccgcataccatcctccttcttctgactccgccttcccaggctatgtaagtccaggaggcctggggacctgtgtcccctcatctccaccaattcctatcttctcaggcattttcttttttcttttttttttgagacggaatcttgctttgtcacccaggctggagtgcagtggcatgatcttgggtcactgcaacctcagtctcctgagttcaagcgattcttctgcttcagcctcccgagtagctgggactacaggcatgcgccaccacgcctggctattttttgtatttttagtagagacagagtttcaccatattggccacactggtcttgaactcctgacctcgtgatctgcccgcctcgggctcccaaagtgctgggattacaggtgtgagccaccacacctgaccttttctcaggcattctctcccaactccaaccccaaaccacaagatgagatgcagcctcaaaaggcagcttctttctccatccggaagagcagagacgccttgggccctagcagggaggcgagggctggtgggacaggcatttggtcctggctccgctgcaagcttacactggggccccagggtcatcttaggacctccctaggcttcgctgggtttcctctgtggaaatgggaaaagtcacaccagatccccccgaggcccctccgagctgcagcgttctctctaaagaattggagagaagtttctaggagtccctgggtttcaggatctgtgagatactctccaagtgcaaaaccccacagagaatttggaagagtcagtatgaagaaaaataatgttggctgggcgcagtggctcactcctgtaatcccggcactttgggaggccgaggtgggcagatcacgaggtcaggaaatcgagaccatcctggccaacatggtgaaaccccgtctctactaaaatacaaaaaattagccagccgtggtggtgcgtgcctgtagtcccagctgctcaggaggctaaggcagaggaatcgcttgaaactggaaggcggaggttgcagtgagccgagattgcaccactgcactccagcctgggcgacagagcaagagtctgtctcaaaaagggggaagaaaaggggagggaagagggaggggaggaggaagggaggggaggggagacaagggatgttggctgggtgtggtggctcacgcctttaatcccagcactttgggaggccaaggcaggtggattacctgaggtcaggagttcaacaccagcctgaccaatatggtgaaaccctgcctctactaaaattacaaaaattagccaggtgtggtggcttgtgcctgtagtcccagctattcgggaggctgagccaggagaatcacttgaacctgggaggcggaggttgcagtgagccaagatcacactactgcattctagcttgggcgagagagaaagactccgtctcaaaaaaataaaaaaaaagaaagaaagaaaaagaatgttaaaatatctcaaattcctttttaaattattatcatactttaagttctagggtacatgtgcacaatgtgcaagtttgttacataggaatacatgtgccatgttggtgtgctgcacccatcaactcatcatttacattaggtatttctcctaatgatatccctcccactgcccccgactcccaccggccccggtgtgtcatgttccccgccctgtgtccatgtgtcctcattgttcaactcccacctatgtctcactcataaattctaattgacatgatgaaatgatactttttggatatatactgggttaagtaaaatatattattaaaattaacttcaggccaggcgtagtggtttatgcctgtaatcccagcattttgggaggccgaggcaggtggatcactttaggtcaggagttcgagacaggcctggccaacatggcaaaaccacatctctactaaaaatacaaaaattagccaggcttggtggcacatgcctgtaatcccagctgcttgcaaggctgaggccaaagaatcgcttgaacccaggaggcggaggttgcagtgagctgagattgcgccactgcattccagcctgggcgacagagcaagactctgtctcaaagagaaaacataatttcacctccttttactttttaagtgttgctactggaaaattgtgtttgttctggagacagtctcactctgtcgcccaggctggagtgcagtggcgtgattttggctcactgcaacctccgcctccctggttcaagcgattttcctgcctcagcctcccgagtaactgggactacaggcacacgctgccactcctggctaattttttgtattttagtagacacggggtttcaccgtgttgcccaggttggtcttgaactcctgacctaaagtgatccacccaccttggcctcccaaagtgctgggattacaggcatgagccaccatgcccagccgctgctggaaaattttaaaggacctttgtgagcagcacagtatctatcctgtggctctctgcggtggtctccctcatctctgtcccactcatgccagggcccctggcatgtgctctatggaaatgatgtgtggatgctgcccagatatctccaggacctgctatttgttggtctgggctggggaggtagaccagcaaggggccagagagttcggtttaagtgtacccaggtgagcccgggggtttccatggctgggacagattttgctctcatggtcacctttttctttaaatttaggtgaaattcacacaatgtacaattaatcatttcagagtacaattcagttgcatttggtgcatccacaatgtggcacagccatcgcctctatctacttccaaaacattctcatctcccaaaagaaacctcattcccccgagaagccatccccattttccctcctgcccccagcccctggcagtaacacatctggtttctgtctctgtggatgtgcctgttctggacatttccacattgttgtaaccatacaatattttattttgtgtctggcttctttcacccggaacaatgttctcaaggtgcctccgcaaggtccatggaccggagctccactctcctttagctgaatcacattgtatcatgtggctgcacctccttgtgtgtatccatgtattcatggacgcctgggtggatgcctctcctggcaatggcaagtggagcacacagtctctaagcaaaacctacgagaccgcctgggtgctgtctcagtgatggctggccctgcccattccttttgcaacccctaggaatccatcatcctactggggttcccttgtccctccagccatcacatagggtgggacaggattgaacatagcgtcagaccctcatttccatcgccttctacccagagtcagcaatgtatccagccccagctcgtatctgtgtgctctgccctctgtgtcttgggcctcgggctgccaaggaagctgctccccttcagaacccttgagcatggtcctccaccagtctgctgccccaaaaccttgggacacagagccatgtcctcaccctgtagtgtccttgtcccaaatcaacctattatctccagctccctctcagtcttgcagcttctcagaagagggacaggtgaggtgagacaagcctgtcttcattttgaggccttgatccaactgggaacgggggtgctagggactgaattgtgtccgcctagaattcctgtgttaaggacctaactcccaggacctcagaatgggactgtacttggaaacggggcttttaggaggcaacgaaggtgcaatgaggccacagggtggcatcttaatctgacagaaagggtatgcttataaggagagaactctctgtgtctctcagccatgtggggacacaagaaggcagacatctgccttcagccggaacgggatctgccagcaccttgatcttgcacttcagcctgcagaactgtgagcaggaactgtgttgtttcaaccacccagtctgtggtatttggctaggacagactcacatacctccttacctaggtagacctccttccccactcacccctaagtatgttcagtgatatcgcctgcctagcactcacctgaaaatatctcattcttgaatgcctgtctccccagacatgggttccttgcggatggggctgacccatgaggctgccctggctcccagcctggagcacacatgccctaactaggagtgggcagaaggatggacagaaggagagatgaaaaagtgtgatgcgatgcatgggcgcttcctagaatctgtttcccataacgttaactaccagagcaactgctgtcatctggccaagggttccctggaagtgtctggtgtgagcaggggccttgctgtggaaatgctggacaagaacagggccctgtttgagcaacaggagccgcagcctcttgtggccaccatgagacactgggcagcgtgggcaggcgcctccacccatgtgcgtttcccagttcatgaagtcaaaatgctgccagatgtctcaccttccacatcgttgttgtcaggatgacacaggctctgcagtgagctatgggaagtgaggggctgcaatgatcaaaccatctttgccttgcttgccacaccctcatgtgaccaacttggcccagtttgcccaaaactctcccaatattaaaactaaaaatcccatgccctgggactcccctcaggcccaggcaagccaggacagctggccacccttccacattcctgctctgttttggcccctgccttagatgaggggctggccacatgagctatggaaaggaggggcctcgtccattcatctctccaccaccagggttgtacaagcacgcgctaaggttctagtgacaaatgcatctccaagtctgcaccacaagctcagcattcttgctgtttccattctccgccaaggcggacaataacataaaagagggctcatctgtgctttcctagactcacattgtaaaactatgggaccagtgaggagttccatttgcatcttggggcaatggggtgtgcttggggttccctaggagtactgcccatgctcacaccttggtgcctttcccatgtctgaggtggaaatgttgatgtggtgggatagatcaaggctccccaaggacatcctggctgcatggtagccagtggcttttttggccaatggctgggcttctctgctgctgagccctgttaggctagctttggtctcaccaagtggagaatgtctgcagagaggcctttagaagggggttgatttcagtgatctactgctgcataacaaggaaaccaggggcatcaaatcacagccacttcattctgcttgtggattctgtgtgtggggaatctagagagggctccacaagaagcagagggccctgtccctgctcagctgtgatgctcactagagctttgacacctggcctctccacatggcttgggcttcttcagcattaagacttcagacttccatcacagcacagggagctccagtgacagagcctctatggccttttaggagccaaccttaaaagtcattcagcatcacttcctctacaccctgctgactgaagcagttataggcccactcagattccctgggaggggacttaggcaccaccctgaaggaaggaatgccgaggagtttgctgccatgcttttaaaccaccacaggggtgctgggggagagtcttcgcatatggaaaaggtgggacaggggaggctgagagagagcgagcgagcagaagaaagtgaacaggtgagagacagagtgtggccactgtggtaagtcctgggattttggagaaaaagccgtgctatgtgtgatgtcaccattctcatccatctccctgggcaacttccaccaagtccacaccatttgtcactgcttccagccttggatttctttttatctcaatgatgtgacatataggaccagcctctgaggtgcctgccaggtaaaggctacctccatgagggtggggcagggccagtccagagaggcctggggatgcccagatggcagtgtggagccctgaaatgaagtaatgatgactggaacttcgattcactgcacacacacactgcctcactgtatgctgaggctgaggcttcactttattttttgagacagggtctcactctgtcacccaggctggagtgcagtggtgcagtcatagctcactgcatcctccagttcctgggctcaagtgatcctcccaccttggcctcccaaagtgctgggattataggtgtgagccacctccccggacccgaagaatttttttaatcctacgtgttatgggctgagttgtgtgcccctgcccctcaccctcacttcaattcaaataacacaatcttaacctcccagtacttcagaatggactgcatttggacttttattaaagagaaaattaagttaaaatgaggccatgagagtgggtcttaacccaatctgacaagtatccatctaagaagagcagattagggctgggcatgttagctcatgcctataatcccagcaccttgaggggccaaggtaggtggatcacctgaggtcagttgttcaaaaccagcttggcatttagaacgaggaaacattttagaatgaggaaaggtaggaaaggatacacaccaacctttcaatattgttaggatcacagcagtgcagggtggcttgtggaattattaactcttatgacatgtcactgaagaacaagatcctgtaagtgaaattgcatatctgggggaaaacattgaagctgcacattaatggatggaatgagaaatacaatctccagtaacagaaattttaaatgtactgttaatgaattttttttttttttcagacggagtctcgctctgtcccccaggctggagtgcagtggcgcaatctctgctcactgcaggctccaccccccgggtttacgccattctcctgcctcagcctccagagtagccgggactacaggcgcctgccacctcgcccggctcattttttgtatttttagtagagacagggtttcaccatgttagccaggatggtcttgatctcctgacctcgtgatccgcccgcctcagcctcccaaagtgctgggattacaggcatgagccaccacgcccggcctgaatttttttaaagtaaataaactctgacttttttccttagtaaatacaaattattaaggccaccttttaaaaagagcatcatattcaaaacgttccatttcactcatgagaaattcaaattttacagaaaacaagatgtcattttttaaagaaacctttttaaggataattttagatgtacagagaagtcgcaaaaatagtacagttctgtatagccttcatcctggttcccctgacattaacatctcacatagtcatggtatgtgtcaaaactaagaaccaacattggcagttactattaactgaactcaagaccccattcagatttcacctgttttttgttttttttttcctttcttgagacagagtctcactccatcacccaggctggagtgcagtggcatgatcttggctcactgcaacctccgcctcccaggttcaagcgattctcctgactcagcttcccgagtagctgagattacaggcttgcaccaccatgcccagctaactttttttggtatttttagtagagacggggtttcactatattggccaggctggtctcgaactcctgaccttgtgatccgcctgcctcggcctcccaaagtgctgggattataggcatgagccaccacacccagcccagatttcacctgtttttccacaaatgtcctctgctaccatattgcatttagcgagataccacttttaaatttgcaaaaagaaaacacttgctaacagaccatgctggcacagctgtggggaaataggcagtgtcatgtactgctggagggagtggggtgtagtctggcaatatttatcaaaacaacaagtgcctacactctgacccagcaagttctcgtcaggaaattatcccagttttatttgcaatgggtaccaggaagtggcgcaaacatgtttactgcagcactccttgaaatagtaaaagactgtccagagactggctgatacaattatggcatatccaaacaatggattatcatgtactgctaaaacaaatcagatatatactgatacagagtgatctccaagatacaattaagtggaaaaaacaaaaacaaacaagaaatggaggaatgtgcataatatgcatcctctgggccaaagaaaacatttgttaatatatgtctactttatatctgcagaggatccataacaaaggtaccagttattgcctgcagagggttgtggacagagatggaaagagccaggtcacaagaagatgagcaaaaaaacccccttatttttcactgtatattgttttgtaatttgaattttataccatgtgaatatactgcccattcagacttaaaattctacttttaaaatgctcattttgatgcttttaatggtaaattcaaacctttatgtagaactattatacctaagatattgttttggaagatttgcctttccctgaatgctactacatgctatgaggaataaaaataggctgagtttttactcctcaaaacagccctgcaagataggcgctgtgtgaatggcatctattttctcccctacacctgcctttctatactctccatggtcagggctggaagccaaacaactacatttcccagactcccttgtcatctgactcagccagtgggaggcactggtgggagtttggaagatatgagatggggaaagcaattctaatctctggcttctggtggcaccccaggccacagcggtggttccagttgtgtgtcagtagtaccaggcagcaagtgtggctccaggctcctgctcagcagctgaggaatcagtctctggaaacgaattttcctgttgctcctctagccttgtgggggtcaggctttgggtgcccttgttctccccttgtttctcatgcccttccaacacctttgtaaacaataccctgtattaaatggtttttcctctaattacacactggctaatacagataaaattactcatattttacaggtgagaaactgaaattcaaatagagaaagtgacttaaccaaaggcaagctaagtaccacgcttgtctcatgatgctccagccaccttggtcctaaccttattggaccaccccaggcccatctgcactgcaaagccattgcattaattcgctctgcacagaacattctgtcttcagtccttcgcatgcacactctttcaagtcccactcaaatgttaccttttgatacagtcgggttttcgtttttaagagacagggtctcactctgtccctcaggctggagtgtagtaatacaaacatagctcactgcagtctcaaactcctgggctcaagagatcctctcacctcagcctctccagtagctaggactacaggcacgtgccaccatacttagttaatgtttaaattttttgtagagtcaaggtctccccatgttgcccaggctggcctcaaactcctggactcaagctgtcctccttcctcagcctcctaaagtgctggggttacaggtgtgagccattgtgcccagccttcaaatgttacctttttagagtgacctcttaccacctgtgatctccaagtcactccattatatcatcctgttccttttcttcttggtactcctctctgaaaatatttacttaagttgtttatcccattggaatgtaaagcccgttaagacccaggaacagtgtttgtcttactaaacaccgtatctctgtgcccaagagtacctgcagagtatgccttcaacgatttaagaatgaatgaatgaaaagtgtagtaagagaagtagcagattactttgagcaccagcgaggacatgcctttccactggctgccttcatacagcaggacagagggctcacgggagtctccaccgcaggacagcccccaggaactaattcccaccactcaggctgtgccctccaaaggtgctcagctaatacatactgagtcaatcaggctgcctatgaaccttccagacaacctccgtgcattaacagtaatcaggaggaaacaccgtgaggatcttagaccaagttggcagattagaagcagacggtcattcagaagttaaggggagagtaaaaagctggagaaatgggatgttcattagggccacagttgtttcagcatttacatttactctatgcactagacctacctccagtgcttctggagaggcacaatggcagagtgtaatctctgtaactggacagtctgggctcaaatcctagcactttcctggctggcagtgtgagcaagtcactcaggtcgtctgtaagttgatttcctcatttacaaaatgagattgttgattaaaaaaaaaagtgatactattattaagacagagtcttgctctgtcatccattctggagtgcagtcgtgcgatctcagctcactgtaacctccacctcccgggttcaaatgattctcatgcctcagcctcccgagtagctgggattacaggcgtgtgccacgatgcccggctaatttttgtatttttagtacagacgaggtgtcaccatgctggccaggccggtcttgaactcctgacctcaggtgatccacccgccttggcctcccaaagtgctgggattacaggcgtgagctaacgcacctggccaacagtatcacttttatacagttgttgtgaaaatcaagatgtagatcacttaaaatataaaacagcacttggcctccatacacgtatcacctcatgaaataccgcaatcctctgaggggagatactatcatcccatgatacaaaccaggcagctgagaaacagaagttacacaagcagcccctgagccagaagtgcgttctagaatccctagtataccctctgaatcaccacactgatacaaagaaaagacagccatatccgcagtgtcataccatggaactgttaagaggtctccagcatgaactacgctgacacttggaggcagggctgtatgactcaacaggaaggccaggtactttttagagaccagacaggtacaaggtcttgaaggacaaaagttggctgggagagctgggcaccgtggctcatgcctgtaaatcccagcactttgggaggctgagggggatggatcatgaggtcaggagttggacaccagcctgaccaacatggtgaaaccccgtctctactaaaaatacaaaaattagctgggtgtggtggcaccacctgtaatcccaggtactcaggaggctgaggtaggagaattgcttgaacctgggaggcggaggttgcagtgagccaagatcgcaccactgcactcaagcctgggcgacagagcaagactctgtctcaaaaaaaaaaaaaaaagttggctgggaggtaaaagcattttaggtaaagcatagaacatctacgtatctgcaaaccctctgaatttactagcctggcaagttccagacgggaaaggtaggcagttgaatttggagagctaggcaacttccaaactaaggaggggcttcttgattgtgctaaggaatttgaatcacacactgtaggtgatgagggacggtgagaggattgcaagcagctaaaactgtggtagaatgtcagctggaaggaaatcgaaaggaatcctcaacaaggagagggtcgcctttccgtctgctggccctcctgctgtggcctgcggcggggtgggaaggggggttccactacacagaagtgtgacgcgcagggctgggcttcttctaggctgaattcgggacagattttcgcatttgttttgctcaagtatttatgggaccaattaatatgtttagcaacgttgtctgtgggagcagtagaggaactgagaagttcacaaactgtaagagatcctccaaagagtccacaggtctgaggcagcagcacctgggaatctctgggctccagttagtccttcctgactttgactcgttacagcagtgtccagacagggatatgtcgggtcctgtggcagggttcccgtcaggtgggatggtttagccccgcatctgccttcaaagatcccgagattatgccgtcgcagcggccagggcaggagtgggtgcgtggcagggactgagtctaagaggcctggaggccctgtctaaaacagagctgtcgctgggccctctcgccttcaagcagttatcatacagctattcccctttcttgttttcagaccctctcctctaacagcctgcacctgcaagcagggacctccgtggcagcagggacagcgtgtctgtctcggcctccaaagtaccccggagtctaagagaactgggggaggatggtgcgggagcagcgcccgcctccaaggagggcccgggcggcgcctcccgcccctcggtgaccttatgggccaaggctgtgaagggcaggcgtggcgacgcggaggggcccggcgctagtagcccgcagacagcgcggcggcccccagcgggagaggcagcctggcggccaggacagcgcggccgggcgcctccgcgcagtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagaggtgagatccaagggcttgttgcccccagtgcaggcggctcagcggccggagagcccagcgcggcctccgagggctgcagcagccttccttccctggtttccccgcgctccccctaccctcgccgggcatactgggttccagttccggaggatccgggatccgggtgggagcgaggtcgaaggcctcggcggagagcttaggggaaggggcgttagccgggctgagtaaggtaggcagcggccatgcggggcggggcccgaggccgggccgtgctgaaaggaactggcgcccagcgcaggcctcagggacccgcctagctgcccgcgggccgatcggctgctgaagcacccttcccgcctgggcacgcgcgtggccatctcggccgcggccccagacgtgtagaggaaggcagggcccccggagagagaaagaaggggaagccttcacagagcaggccggccgcggcaggggtagtttgatctgcacgtttactagggagctttagctcccgccagatgtgtctcttccgagcccagagccggccacttcctcgagggaagattctgaagacttttggatggttctgtgcaagcgctcctgccgtagaagtcctttaaagtgacctttcctaatgaatggtgtgtgggcagggagctaggagcgtgtttcttccaacagggacctccatttgaataactgatttctagaagatgagattggagtagtttccgtgtttcatgttcaagttgcagtttttgcatctgggaagcagtttcagctagtggaaaccactagaagctgttcagccactagaaatttgggagaagatgtattggtggagccacctggattaactgtccgctaaagcttgattgttatagcagcggtcagcaaaaaaggaaaagtttttgttttgctggttctccccctccccgtctttttggtgaggattgtctaacagaaaagttatcttcctctcaactactctgcattattccttttctgtgactgattccatcccgtgttcattgctattgcttgcagatggctttcccagctgggaagattcttcctgtttggcagttgtgatagaatcctttagcttgcttgcactttattctttagcccagttatccagcgttgcccattctgcatttcctcttccttggaaaagcagtggtaaacacacttttgtttttctaactcccgcctggtattagattggaccatttaaataagttacctcaatggttttcagatgctcttaaaaactagcaaacattttcaagatattcaatgcaaacagtaatacgaaataacctgtttagaaaacaaagtattagaaacatacgccctcttgttggactaaaagcatctgaaaagagccgaatagggatgcctcaggcagggaacaggagccttgccagcacaggttaagcttttattgatctaagaaaatagatgctgagaattgtttttgttttggcttgagacaactgtttattcaaaatggatctgcaaattagcagtgcataggctggatccagtccttgactgttgaacctcaacagtttttaagagaatttaaattagttgccagcagatttcatataaaacgctccctgaaaagctgggtagtggctgactctttttggtcgggacaagtgcttggttccagttcttggttcctcacctgacagcttgactcaaatcacctgacagcttgactcaaatcacctgtcagcttgactcaatgcatttgcctgcttggtctctgtaggtgttcaggttgcacctttggcctggaactgaaggctctactcacacacgcagatgttgtgtgtcagcaggaatgtggcatttggttttgtagtttggatgtcaccatctactctcctagataacgtggtatgggtggagactacctgtctgtttgctcttgctgtaaacccctagccaggttctgttggaagagtcatttccccgagcccagcttccctaagctcttcccatgctgagcaggggatggaaacataacccgctgtggggctagcgagctgacttctgggcatccctccattcctgctcagttggtgatgactgttcaggtggggcagggcggattagctgatggcccagcactctagattatgagatctgagtgtattattggctcttatgactgaagtaggctgtttatggctctctaaaatgactttgttccatgtcacattcgtgctgactcaaatctcagctccatgttatacgagtgctctctcccgttgctgctcacacctggttagcatctgcttttgctgaagctgagggaaacattatctggtttggggaaggggctagaacagagtgacactttgggcacacttgccagatttgccagcggctaccaactctgaagcatgcattgtacttaaaggtcccacccagtgccagactgcctgcagtattactgccggcgctgtgtgttggatggtccagtttagcacgtgtagcgtgtgggttcttgctttaccttgttgagtctagaaccacagctctagaattagtgctgaattaacacagcagttcagtagtcaccagctacatgtggcaattacatttaaattcattaaaattaagtaaaatgaagaattcagctcctcagtctcactagccacatttcaagtgctcaatagccacttccggcctgtggctaccatattggacagcataggtggaggacatttccatcactgcagaaagttatgatatggacagtgctggtttcgactaagataggaggggtggaaatagcaaaatggtagtgcttgcatgttgatttttctctccactccattaaatctagggaaccaacagtgtttgtaatgaagaacatcagactctgagctgtaacctgaattcttgtccaaaattcagcacactggcaacgagcacatcaaacagattgccacttgtcctgtcggcgtctttgagacacacttgcccatctaggaaagcacagtgcaggtatctgtgttctgccaccgtgtgccagcccggaccagctcacagacagccctgcctgtcttacttgggctgctcggcttcactgtctcagggcccctgaacctcccagagccctccgtgattgttggaatgtgagtatagctgtgtgctcttgagttcctgtttttataatcacgtgaagatgtacttgatctgcttctgagcatgatatgaggcaacctggggtgtgcagagggccagatgcacggggctaaaagttcaggtttagcgcgaagttatttgttgtggcctgcccctcccctggcttgcgcggccatctgctccagcgttttataggcagccagttccctgggctgactttcatggctttccttgccatgctttattccccaggacctgtcctcttctttgtgaactcaggtgtgcctggtcccaggtggcccttacacgttcatccagtgagcagatggagcacaggccccgggggcaggttgggtcatggtcccggggtgacagcttccctttctgatctgatccttcccttttagactctcaggctttgggagtatttaatctctcttgaaagactccatgcttgcttttgtgtgtggcgggagtttttgtttccttctggctgggatgagatgagcagatacgggatctgcacccaagtgtgtgggggtttagccactggttgtgggattctgctcagctctttaacaaaggcaaagccacatgttctggccgcagaagttggattcgtaggtaaggatggggttcatcctcttcagtattgatgtgccttcaagttttcaagaatttctgttttccttggttcactcaagcagcctggattccaagtgcattaatttgtgtctcagtggttcagtcctttaggtcatgttccagggaaggctcccctttctgaagaggggagggctgcgcctgggtccacggaggtggggaggtggctcctctgccccggcttgtcggtgtgcacctgttcttcaatgagcgaggtgcggggggtggagttgggcagcactccatgaccgagcacacccgggaacctcctgactgccacggtgttccgccctggtgccagcagccactttatgggcacagttctcaggaaaagctgacagccatgtagtagtcataacagttcttcagagcagggctgtccagtaggagtttctggcatgacagactcctggcgtgtccctgcagtccattagggcagccattagccacgtgtggctctgaggaactgaggtttcatttatttatttattttatgagacaggtctggctctgtcacccaggctggagtgcagtggtatgatctcggatctctgcaacctccgtctccctggctcaaaccattctcccaccccagcctcccgagtagctgggaccacaggcatgtaccaccacgcccagctcatttttgtattttttgtagaggcagagttttcaccatgttgtctaggctggtcttaaaatttgtgggctcaaggaatccacccgccctggcctcccaaagtgctgggattacaggcgtgagccactgtgcccggccaggaactgaattttttaagatgtctaattttaattaatttaaatttcaacagccacatgtgtcttaggcagaggggcagtgcttggcgactgttcccatcttcactgcagtcctctgggagagccagggcctctggccccgtttgacaacatgggaaactggctcagaggggccgggtgttttgccctaggacacaaagccagtaggcagccgagagggaacttgaatccaccctctcgactcccacacttggtgcgccgtgttcctgctccccagatagaagggctgctgagttaccagtgcgcagaataggaaagtgtcctctgaagcagacgaaagggctgggtgtcctgtgaaagttccttggcctgtgggagccgtcctcaggccatggggccgcatgcccgtgcctttgagtctggggcacgggctttcactgcttcagtcctctgctttctgtgggtcccaaagaagcagggcttaattaggcagaagcgggtggaggtccagcccagcacctcctgtatcataggtgatcaagtgaccctttcactaagtgaaaagcagcctgacggatgggttgacttttctggtaccagttctcttaataaccataattgtttttctcctcctgtgactcctgtggctcatgtctgtaatcattacaaatgtccctccaacctgtgtcttttgggaacctgttacattcaggcccagtgctggggaaactacgatgaaaatgcagcctctgccctcatggagcttcaggcctgcctgtgagcccgggccccactccaagaaggggcctaatgtggatgcttccactcagatttgcctctgctgggtctctcagaactgggaaggtgattggtggctggcctggcagcttagccagtgtttgctcaagggaaacggagctggaactgccctcctctttttgggcaggactacaggtacacaccagcatgacacctcagccatgagaagctgcccgcgtccagacttctgcctttcatggacaccgagaaggttctggagcaggaagtgagccacctcccgctcttcttggcagtggaaggaggccctcccacgggtatctggtccctttacctcaagggatatagggttgaacagaatttttctttttaagaataagtttataattatttttcctgttataaaagaaacactttggccgggcgcagtggctcatgcctgtaatcccaacactttgggaggccgaggtgggcggatcacgaggtcaggagattgagaccatcctcgctaacacagtgaaaccccgtctctactaaaaatacaaaaaattagccgggcgtggtggcgattgcctgtagtcccagctactctggaggctgaggcaggagaatggcgtgaacccaggaggcggagcttgcagtgagccaagatcacgccactgcacttgagcctgggcgacagagcgagactccgtctcaaaaaaaaaaaaaagaaacacttttttttaaaaaatatagaaaagcatgaagaaattgacaagtcacctattaggccaccatccaaagaaaaccactgttgatctattttcttgtttcttttgagacaatgtctcgctcttgtccccctggctggagtgcagtggtgtgatcttggctcactgcaacctctacctcctaggttcaagcgattctcctgcctcagcctcctgagtagctgggattacaggcgcctgtcaccacacctggctaatttttgtatttttagtagagacggggtttcaccatgttggccaggctggtctgaaactcctgaccttaggtaatccgcccgcctcggcctcccaaagtgctgggattacaggcgtgagccaccgcgcctagcctgatctattttcatgtatagcacctttgatactttgtcttatatatcttgccttaggggtttttaaaattatattattgagacggactctcactttgtcacccaggctggaatgcagtggtgcagtctcggtttactgcagcttctgcctccggggttcaagcgattctcctgcctcagtctcaagtagctgggaccacaggcatgcaccaccacgcccagctaatttttgtatttttagtagggacacagtttcaccacattggccagcctggtcttgaagtcctgacctcaggtgatctgcccacctcagcctcccaaagtgctgggattacaggcgtgagccaccatgcccagccttatcttagattttttaaagttatatgttaaacacatcaaaagttatgtttacaatatgtgaaaagtaataaacatgccacagcatgatggcccttaaaaacataatgcaaaatgaaagaagccagttgttgaagaccacgttacaggattccatttaaatgaaatacccagaattggcatatccagagagttgggaagccgactggtggttgtggagggctggggagatgtgaagggaccactaattggtacagggtttctttctgagatgatgaaaatgcaccaggatcagttgtgctattggttgcacaactttgggaaagccacttcatcgttcacctccgatgggggagttgctctgtgaattctatctcagtaaagctgtgaattctatctcagtaaagctgccattaaaaaatacaaatcaggccaggcatggtggctcatgcctgtaattccagcattttgggatcacctgagatcaggagttcgagactagcctggccaacatagagaaactctgtctctactaaaaatacaaagttagctgggcgttgtggcacgtgcctgtaatcccagctgcttgggaggctgaggcaagagaattgcttgaacccaggaggtggaggttgcagtgctccgagattgtgccactgcactgcagtctgggtgacaagagtgaaactccgtctccacaaaataaataaacaaataaaaataaagaaaatgagaccaggtacaatggctcttacttgtaatcccagtgctttgggaagctgaggctggcagatcacttaggagttcgagaccagcctggccaccatggtgaaaaccctgtctctactaaaaatacaaaaattagctgggcgtggcagcacatgtctgtagtcctagctatttgggaggctgaggcaggagactcgcttaagcccgggaggcggaggttgcagtgagtcgagatagcgccattgcgctccagcctgggcaatggagcgagactgcctcaaaagaaaagaaaacggaaaataacaagtgttggtgaggatatggagaaatgggaacccctgtgcgctgctggtgggaatgtacaatggtgcagctgctctggaaaacagtatagagattcctcaaaaaaactaaaaaattgaactgctatatgatccagcagttccacttctgggtatatataccccccccccaaaaaaagcagggactcaaagagatgtttgtgcacccatgttcatagcagcattattcacaatagccagtggtggaaaccgaagtgtccatcacagatgaatggattaacaaaatgtggtttatgcatacggtggaacattactgagccttaaaaaggaagaaaattcggatacatgctacaatatggatgaaccttgaagactcgttatgctctgtggaataagccagacacaaaagggcatatactatatatgatccaacttgtatgaagtacttgtatagtcagattcattggggtagaaagtagaatggtagtttgcaggggcttggggttggtggggaatggggggatcatttcatgggtagagtttcagtttgggaaggtaaaggaatcctggaggtggatggtggtgatggttggtacatcagtgtgcatgtgcttagtgcctctgaactgtacacttaaaagtgcttacggtggtatattttacgtgtattttaccacactttaaaaaaggcaaagtgatagttgtgtgggctccccacccagcgcgatagagaactagcgttaccctggcctgcctcctcctgcagcggagaccctgtgccccaagtgcaccacagcacccttgctgtccttatagttggctttcagtggcacgtccctgagctctgccgccttagaatgtgtgagagttgtatccctggctcaggccactggaactgattcatgtcactaatggaggaggtgcgattctgctctccccgctcctgtcatcttttgctctcaccgaacagttctgctctgaaccttcttgtgcggctcttgccttttggggagacgcctccagactgtggctgctgggacaggcacaggctgcccacatcccagaggggccgtggagttgccctgctgagttttcactgtggccgccttttaactggaatgctagtgttgccaggggattcctttgctgactgcgagagctgattgagttgggctcaaaagtggagagatgagggcctgaaggctgactctggttgaaggctgagggaggaagttcaagatgcccactttatgagtgcctgcaagctatcctgaggcggcagagagcggtcccattcagtgtctgcagcagtccccctgaggtgctggaacgggctgacccctgctcccagcactaaaggctcagagaatccaaagcttcctcagtgctggcatgatgtgtttaggatcatgacactgatccttttacttttcttcttccatatgttaagacccacttccgacagtgatctttaagtaccagagatcatgccagattcaaaaggatcaaaagtcatttactagaaagagcctcccttccttttctttcctgagcccctcagttccctccctagtgaccagtcataaaaatcaggtctttgtgtatcctttcagaagtgttctgtgcatataaaagcaaatagagacttttaaaaatacactacgtatagcatactgtaaacactcttctgaaccctgccttttcccctgaacttgctttcagttggagactttgctgttactgctgctacctttttctcttttttttttttttttttttttttattgagacggagttttacttgttgcccacgctggagtgcaatggcatgatctcagctcactgcaacctccgcctcctgcgttcaagcaattcttctgcctcaggctcccaagtagctgggattacaggcacgtgccaccaaacccagctaatttttgtatttgtagcagagacagggtttcaccgtgttagccaggctggtctcgaactcctgatctcaggtgatccgcctgccttggcctcccaaagtgctgggattacaggcatgagccactgcacctggccactttttctttctttttttttttttttttaaacatagactctattaattgctctcttactggtcatttcacacctgcaatgaaaagcaaaaatacagtcccttaggaagcccagggctcaaaagattccaactagctcttacttaaaaaaaaaaaaaaaagtccatataatttaaaaaaaaaaaaaaaaaggaaaaaaaaagatctcccatgcaccagggttcagatcacccagttcctaaagcccatggccttaccagttagggggcagctggtgatgctctgcagtggtttgagataaccttctgactgggttctttccttcattaggttttgtttgacccacaagcagaagcaagccatatacgggtggctgctgggtggtcaggagctggctggacgtggctgtctcctgggagtacttggcagtttcttttttctttttttttcttttttttctttctgtcattcaggctggagtgcagtggcacaatcttggctcactgcaacctctgcctcccaggttcaagtgattcttgtgcctcagcctgctgagtagctgtaattacaggtgtgcagcaccgcgcctggctaatttttggtaaagacggtttcaccttgttggccaggctggtctcgaactcctgacatcaagtgatctgcacacctttgcctcccaaagtgctgggattacaggcgtgagccaccgcacctggtcatggccacgaatttctgaagtaagagaagtgcagcagtccctgtcagcagtgcagacctgaacccaagggcccagcagtggcagctaaaaaacctgtgtctgcactgacagcaccccactcccaccagtgtaccaggaagttggagtgctgactgcctggtcgtggccgggtgagctccaacggagggatcctgcggctttgggtgcgtctgtgtgtgttttggtttgaaccttaccgtctccatatagggtctgttgccttatagaatcctagaaatccacttccctagacttcacgtgttgtcctttcccagtggaaaccgagattccctttgcctaactggctttaaaagcagaattggtgagcctctggcctcagcgccgttgtgcaggaccctgcctttgtttgaaggcagtgtggcttatgtcctttgtgtttctgctgtggataggtgtcttagacagtgggcagcaacagtgcccagcccatatgaagacgccgaggctgcaggaggccggggccatggtttgacaggcaggtgggggcagacccacgccaccatctcaggatgtgtgctggcgagtgcccccatgtccacgtgcttgcttatggctgtgtcattcacaggactgcccacagccgagggcagaggatgcccagtctcctcactccctgtgctggggggcgggccacacctggcaacagcagtgaggtgggagggagcctggagggccttggcttctcgctgcttccaggctggttgggactcgtggacgcacccacccatccgtcccagcaagcgatggagcctgcagaggggtctgggtggatgtgggtgccagctgggcttgcaggggggccggagggggtgagggggtgggatctgcccactgctgtgtttccagatggggcagtcggttccaggaccggggtttccactggaatttcctctgtgggaccaacagtggttttcactacattcaggatggcgctggcctgctgggcagagaaaggtaccgcactagggtggatttgggtgttggcgagaacattgtgtaaccccagcttgacacctcccttttgctttgagtgttcctgagggaggaagcccgcctctggtgcccgccccaaggtgtccctggcctggctttgacagtcagtaggatgcacagctgacttggaagcaactccatttccgtctcaagattgggacacgatttggtcctccacccctaccttgttatctggcctctctgctcctgttgcctgatggacttgagaccagaagggagttctcttggccaggagtgctcccacctgagagtggaggccccgcccctccccgcacacccagggccacagccagcccattgcgccaccgccactcatttctcatctgagcacgtgggggcactgctcggccttcagctttccagcgccagtgaagaccctgctttgggtgtgcttgtttgctgtaggtagcttctaaaatgctgcatctggctggatgcggtagctcatgcctgttaatcccaggactttgggaggccaaggcgggtggaacacttgagcccaggagttcgagaccagcctgggcaacatggcataaccccatctgtacaacaaaatttttttaattagccaggcagccaggcgtggtggcacatacctgtagtcccagctactcgggaggcagaggtgggaggatctcttgaacccgggaggtcgaggctgccatcagcagagatcacaccactgcactcctgcctgggtgacagagcaggaacctgtctcaaaaataaaaactgttgaatcctacctggaagtaacagctggcctctcccttacctctcctctaagaccaaatggaaaaactccaccgagaactttagaaggaaaaccctcctttccccatttcataagctgctcgtgcagtcttacagtaacagctcatcatttcatccctggcgaggcagccgtgacactggcacagtcacaggtggcttggcagcaacccatgtttaggaggctcttgtcccaccctcagggcactgatttctccccagtgcatgccgtttaattagggcctatgattgaattaggaggctttgccttagcctggcttagttacagtgactttttcaggataaagagttccgtttgcccaagtccaagccagtgccttttatgaaagtggttcccacccaggggcggggttagggtccccatgcttgggggcacagtcagcccattaccaatgactttcatctttaatgtggccacatgagatcgttaactagttgtttatccaaccagaatgcaaccctgcctgttaggtttgcttatttgtttgctgaaagctttgagctgggaggagtctcagtagtaggaagaactacgattgcctgttctttttccttgaagtttcccgacagtccgatttccaccatccttcacttggaattgctcccatctttgaaggaggctggagggagttaccttcatgctgggctgaggttctggggtggcttgttatgaatgtcttcactcgtcactcccatattacggccaatggccaggtggctcagctccccatgactctcctctgcaccgcagccaggtgtgcctgccaggacaggctgggcggacgggaccttcgcgtctgtgcacactgagggctgtgcttctcgttagccatgaaaggaagctagttcctgtcaggcacattcggagcttcaggtacatgggccacattgacccttgtgttgcctggtacagtgttccagagcctcccagttggaagggcatggactccagcaggggagcagtgaccagcaggtccctggagccttgtgtcctttagtcagatgggtccgaccatcctggggaccagggtgtgctgagggaaggggcagcttttccctgaggcatgtgacagaacatggctctgtgcagccttgggagccatgagttggaaaacttgatccagcctcaagagctatgtctagcagtgtccccgtcaaggcccagataaagacttcttgcagatgagcagataacggaaaactaggatgtggggtgacggtgcggagattcagagagatctgtctcagctgaaaccagccaaggaaagatgacaaggcatggatagccctgtcttcaggcctgcccgccacaggtgaagaagattctgctttgggtgggaaatttgtaccgcagaggcctgaaaccaagaaaagcaagactgcctgaaatgcagcttggcccacggtcactgctggggctgcagccgggctgccgtctggccttgctgcagagctgagcgttccgtgtggtggattactctcctgctggttggggtcatgacatgcatccccagtcccgggggggaaagccccttgtgtggtctccgtggcagtgtttcttatgcaaatgagtggcatttgccggtggtgcaggggcctgggcctacagggccagaattggtggcattgctgggctggatgttttgaagcccctcagttgaccctcctgcttactaaatttggagcccactactgttcttgaagcgttgtcttttcctaattcaaggaaagggtcgcttttcctatgcagtgggctagtgtcctgggtctcctcttctcccctccgcagcggggaggagctgggggctgctgccggcccaggaagggcacccagggcttgtgcagcctggcctccaggagagccaaaggagtttggatttcattcgcccaaggcaaagctcttcctttctgcctctgttctgcaggcccaggatgactacttaggaaacgtgcggagggcaagggcttagcattatctgtcctgaggtctgtggtttccagtgaagaatcctcttgcagttgccctgattaactaagaatggctttcaggctgttggccctctgctgccgtgtgtgctcctgtgattctgtgccgaatcgttctttcccctttaggctcctttgctgactcagatcagttggtccacagccttaggctaaccaccaggcctgtgtttgtcatgttaaacgtcgaggcactgcttttcctgcctttttatatcttttttttttttttttttctgagactgagtctcgccctgtcacccaggctggagtgcaatggcacgatctcggctcactgcaagctccgcctcccaggttcaagtgattctcctgcctcagcctcccgagtagattacagggattataggcatgcgccaccacacctggctaatttttttttgtatctttagtagagacagggtttcaccatgttggccaggctggtctctaactcctgacctcatgatccgcccccccggcctcccaaagtgctaggattacaggtgtgagccaccacacccagctttatttcactattttcaggaaaaatcctttttactgattatcttgtgttgggatttaaaggagatgaggacccaagtgagatgtgctctccgcagtgcaggctcagacctcccccagcgctgaaacacagttaagtgctcctcagcctaatcatcctgtctctctctctctctccctttcctgccccctccatcaaaagggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttcaactcc

SEQ ID NO: 36416 - DNA, 38619 bp, Homo sapiens
cgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagagggtgagtgcagaccgcgtccgggccgggactacgcggggggcggatgcgggctccgtggtgcgcggcagagggctggttccctacgtcgccgagggaggggctgctgcggccgattagctgggagtccgaggctccgggctgaactttgttcgaatcccggttcgcccgttgtcagcacctgagtttttctcagattgatttcctcttcgataaaatgaaaataagaccctgtttaggtttgatgcaagcattaaatgagttaaaatgtatacagttccactcaacccagtacctttgtctcttttggcgctttctactcaggtattcctgtagtaatattcagcagtccctgtggcctccagtaacccccgaggcatcagtgttttatgttaatttgtgagctattaaatctcatttggcctgctggctctacagcagttacttttattctgtgtagtctcagaataaaagtaaatgttggccacatgcctgcaagtcccagctacttgggagcctgaggtgggaggatcgcttgaacccaagaggcagaggttgcagtgagtcgagatcgtgccactacagtcctgcctgggtaacagagtgataccctgtatgaataaataaatgaatgaatgaaactgttcatgaaatctgctgcaccccgcccccgtcccaagatggggtctcactgtcacccaggctggagagtgtagtggcgccatcacagctcactgcaggctcgacctcctcaggctcaggtatcctcccgcttcagcttctggagtagctgggtctgcaggcgtgcaccaccacccgcagctgtaagattacaggtatgagccaccgcgcctggcctagtgtagctttttgaaaaacaacagaaagatgttctggtacttcattcatagttggcgctaaaattactgtgcaagtatatatttataatactataattatgctatttaatagaattcttagacattttgacacatttcatcttcaccataatcctgtgagttaggcaaataatcttagttttaaggtactgataggttaaaagggagtgtttcagccccatcctttatcttccagttcaaggatctttcctctgtattgcggttaacactggagccagggataattaacattaagtagaaaattaaatcctggaatgaagctagttcctcagaattctcttagagttctcttagagttggagacatcagtatgaactgtttagctcatgtaggtatagatgacttagaaatatttgcatatgcatgtgtagacataggttactatacaaatatgtatttccttactctgtcagataaaagggcacagaagcaacctaactctagtaacaatgagtacacctagcaccccgatcttgtttacaactaagtttagtttaaagacctcacttggctttattgtgattctggattcaggtaatactttattccataaaataagtgctcaatgaattgagcagttgggggttggctttatagacagtaaggacttaaggaagctgaaacagaacaaaaagaagattggttatttcacagttacttgtaaggctgggacagggagacagaacaatagatacatgggatgcagaatggatgttgtgttatcaggcatgaaagcaacagtaatttccttgtatgtacgtctccctcagagctcttgagtggttaggcgcattatcaatgagcaatggtattttgaaaggaatcttttttccaagcagtagatctcaataatgggcttaaaatattcagtaaaccatggtgtaaacagaggcactgtcatcttgttccatttctagagcacaggcaaagttgatatatcatttgaagggccttaagattttcagaatgagaaatgggcaatgggtttaacttaaagtcaccagcagcattagtccctaaggagagtcagcctgtcctttgaaatattaaagttaggcattgacttctctctggctatgaaagttctctatgacatcttcttctaatatgaggctgtttcatctacaatgaaaatctgttgttggctggatacagtggctcacacctgtaatcccagccctttggaaggccaaggcagttggatcacttgaggtcaggagtttgagacaccagcctggccaacatggcgaaaccccatctctactaaaaatacaaaaattagctgggcattgtggcacacatctgtaatcccagctactcaggaggctgaggcacgagaatcaatcacttgagcctgggaggtggaggctgcagtgagctgaggtcacaccactgcccttcaacctgggtgacacggcgagactctgtctcacaaaaaaacaaaatcagttgtttagtgtaaccaccttcatttgtgattgtagctagatcttctcaataacttgtagcttttacttcagcacttgctgcttcaccttgcacttctatgtcacagagatggcttcttttcttaaacctcatgaaccaacaacctctgctagcttccaacttttcttttgcaattttcttacctctgtcagccttcttagacttgctctggattaggctgtggcttaaaggaatgttgtggctggtttgatttttttttttctatccaagtcaaactttctccatatgagcaataggctcttttactttcttatcatttatgtgttcagtggattagaacttttaatttcctttgagaacttttcctttgtattaacaacttggctgttagacacaagaggcctatgtttcagcctatcatggcatttgacatcctttcctcactaagcttaatcatttctagcttttgatttaaagtgaatgacttgcaactcttcctttcactgaaacacttggagggcatgtagagttactcattggcctaatttcaatcttgttgtgtttcaggagataaggaggcctgaagagagggagtaaggggaagggctggtcagtggagcagttagaacacacacaatatttatggaataagtttgtgtcttatgggcatgatttgtggtactccagaacctttacaatagtaacatcagagattattgatcacagaccaccatacagatataataataatgaaaaagtttgaaatattgcaagaattatcaaaatgtgacaggtacaggtactgttagaaaaatgagccagacgcggtggctcatgcctgtaatcccagcactttgggaggctgaggcgggcagatcacgaggtcaggagatcgagaccatcctggctaacatggtgaaaccccgtctctactaaaaaaatacaaaaaaaattagccagccttggtggtgggcgcctgtagtcccagctatgcgggaggctgaggcagaagaatggcatgaacctgggaggcggagcttgcagtgagtggagatgcaccattgcactccagcctgggcgacagagcgtgactctgtctcaaaaaaaaaaaaaggtgccgttagacttggctcaagctgggctgcggtaaactttcaatttgtaaaaaacatgcaatctgcaaagcacaataaaatgaggtatgtctgcacctatccttcgtggtactcattaaaattttaattagttacttacataactttttgtttaattgtgtcttctcagattaaaaccttcatgggggcagagactggctatctgaagtcatcacctcctaacacaggctggcagtagatgttcagtaaatattgaatggcttgtgtttaaattctatataaattttgtgctctcttaaaatcctgttaaattctattatgactgtgtatggtccagataatctctggtgtagcataagattatgttagaattgagggaggaaattgggtaaaaatatattcgtcttatatgcttaattgctacagaattgcttttcagtttgctagttatttaagttttttatatatacaccaaccaagccctgggttaggtataatggtagtagtggcaccttcaggtcttaggttagacattatttcctcagagaagccttccctgacacctcctctgtgcagaagatacttaaacacacagatttcttgttatatgcttccaaagcattctgtacttgtctttttaaagttttcacaacatttttacttcagtagttcaatcgcttgtctcattgctacatggtaaaaagctcactgtggtccaggagtatggcttacttggtattgtatgtaatcactgcctgactcaacatctgggtgggcattcaagtttggggaggttaatattaataggttttaaactttgtaagctaaacagactcacttaactgaaacctagatagaaataatataaaatattttctattatatgaaatgtttctaggtataagtttccaaccaatgattttacacattttacaatttgtatctaaatcttttttgttaatgtagactgctacttgtgaaagaattttcaacaatttttattctacatgtgaaagttatattttgtaagaaatgtcttcattgctattctttttttttgttctgaattttaatcagatcttaaatgtacaactctaaatttatgataatttttacaatatgtttgtagcctattactcaacaaaccacacagtggcactactggatcaagtttgattttaataaaatttactttttttcttttttagctattattcatggactatccagtctaacagcttgccagttgagaacgatatacatatgtcagtttttgacaagaattgcagcaggaaaaacccttggtaaatatgtttttttattttatattggaaatatttcaatctgtttctaatgtaagacaatgggaagaaacagacgtttttgggggaagtttgcctacaagtgtctggtgcataggggtgtgggggggtggtgtgtgtgtgtgtgtacacatacagtcatatctaaagcaagtaaaagaaatgtagtccctgtcatcttagaacattggttctcaaactttagcctgctccagaattacttaaagggcttattaaaaaaaaaaaaacatagtgctgagtctccctaactctcatgagtttcagattcagtaggatgggtatggggctctgaaatatacatttctaataaattcccaggtgattctgatgctactcttggggaagtgtgtttcattgactctatttgctaactttgtggtgactccaatcatacacactctgtttttactggcaactattatatttgaaaccttttatttgaacttgatgccagcgcttacgtaagaagtacagtttatagctgtaatctctctcccttgtctctgtagttccattttagattgtaatgggcaaggctgattcagtttatcagtaatggctggtatttacaacatggtcattttaaaaggctatttgatggaaataattttgtatttagattggtttttataatttacaaaatacttttccaacaatcctgagtagtgggcagtacttacataaaactgcttgcttattgaagtgttgtcttacataaaatcccagtgtattagcaccactgtcaaggccttcactaaagtatctctggctgatgtagtctgctttgtttggggggtgagggtaggtctggagttggtgccaggaccataaatggatagaactagatagaggcagaatagttgtgaaagagacagagccataggtaggcctgggccagttgctggagaagtagcaggctggagcagaattccagaccatgcagactataagttgacactgttgttaacagggttgttttctacattaaggtggaaaagtattctaaagtgcctggcagtgctttacacatagcagttgttcagcacatcttagttgcttcctggataaccttttctccaaaaaaggcaggggggaatccagattttatgtgtgatctcatggtttaatcttggaatttaccaggatactcttttggatatatcctagatataataggccagggtcagctgtcaagaatcaatgtatttcaccataatgcactaaactgaggcagcatttaaaattttatgtattggatttttggctatacataacccttttgcttttttttttttttttttaattttgctctatagtggcactgcctaatagagatatgtgagccacatgtctaatttaaaattttctaatagctatgttaagaaaagtaggccaggcatagtgactcacacctgtaatcccagtactttgggaggcctagacaggaggatcgcttgagcctaagaatttgacaccagcctaggcaacatagcgagaccctgtctctacaaaaaatttaaaaaattggctgggcgtggtgattcacgcctgtaatcccagcactttgggaggccgaggtgagcggatcacgaggccaggcaataaagaccatccttgctaacgtggtgaaaccccgtctctactaaaaatacaaaaaaaaataaaaataaaaagttaaccacgtgtggtcctctggagactgaggtaggatcgtttgagcccaggaggttgaggctgtggttagctgtgattgtgccacttcacttcagcctgagtgacagaatgaaatcctgtcatgaaatttagaaattcccattccagcaggtgtagctaaaaaataataatgataattaaaataggtggaattaattttgataatcttatttaactcaatatttctcaaacactatgtcaacaagtagtcagtgtaaaaaatgttagtaaggccaggcacatggctcacacctgtaatcccagctctgggaggctgaggtgggtggatcacttgagcccacgagtttaaggctgcagtgagctatgatcacaccactgcaccccaacctgggcagcacagcaaggcccccatctcttaaaaaaaatcaaatgagatattttacctttttttggagtaagtctttgaaatctcatgtgtactttatacttaaggtgcatctcaattcaaactagccatattttagctgtgcagtaatcatgtatggctagtagctgtgcagtaatcatgtatggctagtagctaccatattgggtttagtctcctaccccacataggtttgacaagattggacatgtttggggtgatgtggctgtagacccccacgtagctctgaaatacagcagatatcttaaaggggaaatgcttgtcatcctcctcttatggaactttaagcttttttttttttttttagccagggtgtctctctggcccaggctggaatgcagtggtgccatcatagtttattgcagactcaaactcttgagctcaagtgatcctcctgcctcagcctcctgagtagctaggactacaggtgcaccatcaggcccagttaattttttaattttttgtagagacgaggtctcatgttgtccaggctggtcttgaactccttgccttaagtgatcctcccgcctaggcctcccaaaactctgggagacttaatgtgcctttccactgcagcctattgcattgccgtggaactcagcacatgtcctgtggagaaaagccaatcatgtttgcagtttctctagtttccagtcgacgtgccagccccaaggaaaccaccagaagctgttcttatttgtctttctccagtaaagtctctctggctggagtgcactggatcctcagccttatccaaaatcagcaaatcggcagctcacctcagaagggattctctctggaattttagttcatctcattttcattgcttccatggctatcccatgtctttagcaatgtgattttggagtttatctaactgttttctagctgtagtgtgagtgttttgtttgctgcagtatactacatcccacctggaagtgaatgtctatactgtaaattttttgaagctaagatctaacatacatttttctctatgtcacatttataagaaggaaggcagataagtgagaagggttaagtaatgtcagtcaagaaatacttatttgaaaatgtgtgttgaaattagctcttgaaagaaagcaagcagatgaaaaatgaggaagaaaaattaggcagtctacctttgcattttcatttcactacttttgaggcacagtaagtgatatttaagtgtcttggtgtctgcttgtactacttgcttggtgtgtgacctctctagctctcagatcttactgtataaaacaagtgccacagtgcctgacactcagtgttagttactagcatgaatatcttttgtacacctctttcttaccttatgctgctccattttcctgaagtgttctccttcccatccttgtagtctacacttagttatcatctgtttatccttaatgccccaatttggatgacttctgtttcatgagggattcacttctgctattcctacttagagttaataccatgttcctcaaatacactagactctgcttgagaatttaatctctgggagatgggtataggcatcaatattttttttcttttttttttttttgagacagagtctcactctgtcaccaggctggagtacagtgacgccatcttggctcactgcaacctccgcctcccgggttcaagcgattcttctgcctcagcctcatgagtagctgggactacaggcgtgcgccaccatgcctgactaatttttctattattagtagagacagggtttcaccatgttggccaggatggtctcaatttcttgattggcggatctcgtgatccgcctgccttggcctcccaaagtgctgggattacaggcgtgagccaccgcgcctggccatgcatcaatatttttcaaaagctcttcagatgtttctgaggtatagcaaacattgagaaccattggcataatgcacaattccattaaagtaccagttatattggtttgtctgcatgtcttcttccatagctaggatgtgagttccacaaggtcaggaactttttttttcatgtttgtatcttaagtacctgacacagaacctggaatataaagagacttagtatgtgaatgaatatatttttatatctaaaatgttggaaaaacaatttggagaggacaacaggaaataaagtaaaaatatttgaaactacgaatatttaaactgcatgctcactctggtttttcaaggaaaaaaggatgtgctatttaaaattctctttattcggtcgggcttggtggctcacgcctgtaatcccagcactttgggaggctgaggcgggtggatcacctgaggtcaggagttcgagaccagcctggccaacatggcaaaaccccgtctctactaaaagtacaaaaattagcctggcgtggtggtgggcacctgtaatcccagctacttgggagactgaaacagcagaatcgcttgaacccagggggcggaggttgcagtaagccgagatcgcgtcacttcactccagcctggtcaaaagagcaaagcactgcctcaaaaaataaataagtaaaaataaaaataaaaaattctctttattatgcttatttgttgcatacttgctatggaactacaactgtgctaggaattacagggatttagaaaaatacacttaagtggcttctgccccccaaaatttgaaatatgcattatagagtaagaagttttttgtcttcaagacactgtaaaagctaatagggttgttgaggtaagtataaagtactgcaaggcattaaaaaatgaataatgatacaagagtttctttttaattaatgcagtgctcatgaatttttgtgtcatccttctcgaggggccatgctaatctctgcattcttccaatttttatatatttgctgccaaagcaagcacatacaggagatttagagaaaggacatttcctagtctcttagctgctggggtaaggacagcattcaagaaagaggtgctgtttgcactatgcctgtaagaattgctagattttgtcagaaagaaagtataaaaatggtagtctatccacatcctcagatgtggtgtgggggtggggggaaggtagtctagataaaatgaaaacattagcattattttgaaaataaactatagtttacctggataatagactcttgatttccatatacaacttcataaacttggtcctcacccaggcttcctatgatagtaaatgttagcaccatttatccaattattaaaacccaagagtcctccattttttcctcatgctctacatgcagtccattagcaggttctattctacattcaaaataagttccaaaacagacaactacttgccttttccatcatctttctaagagtatgcatccaacttgcccaccgaccttcctcctgccctttgtatttgttttttcaagacaaggtcacgctggaaggctgtggtgtcatcatcgctcactgagcctcagactcctggctcaagcagtcctcccacctcagcctcccaagtagctgagactacaggcacacgcccccacctggctcttcctgccctttgaacatcaaactcctcctcaggacctttgcacttgccattccctctggaatgtttttcttccagatctttgtgtgactgttccttctgcttcacattacgctgttctcagctccactgtcacttcttcagagaggtctttaacctgtctgaaagagcttccctctcccctaccattcttcatttccagaaccttttttctttcttctagcccttactactctgaaactatattgtttactactctgaaactgtattgtttactactctgaaactgtatttatttctcattagcatgtgcgtatcataagagcaggattttgtcttactgagccattccaagtttttaggcgagtgcctatatatactgagtgatcaataaatatttattgaatgaattgtagactgtagatgctagacatgtaagacattatcatgaaggctcttgaatgtccgaatgggttgttgctgtgtaatttgctaattagttatcagctgttgtgagtctttgttctgaataacttgatcacaactcttttaggaaagcttaataatagtacaactattatctcattatatattcacataaattctgtgagatagtatttattctcaccattttataggtgagaaaactggcctgtcttgaggtttgttataatgcattagacttaggaaccacttaagaattctgttgctatgacatgttatgtaaaatagtttactttcgttcttaaaattcatgtttttgtaaagaaaatcttcaaatgtttgtaatctcatcaacctttttctatttgaaattgatcttaatgagcaaattaacttagaaaataaaatcacttctaaactggtataaacaagaagagtacctagcacatagtatacactcagtaaatatttaaaggaatgcattattaaaaactgacaaagttctacttagctttctgagttacttatttttgttctgtttttaaaagatgcacagtttgaaaatgatgaacgaattacacccttggaatcagccctgatgatttggggttcaattgaaaaggaacatgacaaacttcatgaagaaatacagaatttaattaaaattcaggtatgaataaattacttttatgcttattatatttctagaaaataacatttaaaagaaattaagaggaacctagtagaagttgagcagtagtaaaatttaatgtattgtttctcttcagaaatttgacctttggtttatagtcttaacatgagcactgggggctggaacttaatgtgccatacttaagcatatgttgcctctatgttgtggaaaatttaaaaaccaggggtttgtgcactctcaattgatgcttaaagattatgtaaaaagtagatactatttttaattaatggtaaattttagatttttgtaatcaagaatatataaaattttaaccaagtagggagaattttagtagacagtaagtagcccaaaacgtcattcaaagatacaatagctagcagtcaaagcaaatactaggtactttcttagttaaataaactttttctcttttgagaattttaaaaatttcttttcaggttggataaaagaaaatccaagtcattccccaccttcccaagaattagtgtggtgattgtcaagtagaattaggacctgaggaaaagaaaataggcagaaaaacgactgcttcctttatgaattcaacccagagcaaagagatttgtcatgttattgcaatcttttaggctgctagagaaagcaagtctttcttaatacactactgtaaaatcaaatgggtgacaaagtttatagcaaacatttaatatattccttactatttgccaggcactgttctaaactctttcacataaaactcttacatcctcataacaatcctatgaaataggtactattgtttccaccattttacatataaggtaactgggacaccaagaggttaagtagcttaccaagtttacatagctacccaaatggtaagtggtcctgtcttacttaccacgttaccaaaaatgccaatgcatgaaaaaaatgatcattaaaaaacatctagcttcttaggtgtgtattagatattttccagggatctgactagcaaattttatgtatcctaatcatcacaaacatcatctacctcctctcatttcccttttactcaaaattaatatttaggtgggtcctaaatgtgtgtggtatggcttctaatttatttattaatacatacttttcatttggtctaaattagagatagaatgctgggcatttatgaataaatgtgcatgggaccagtgcaaatttttcatgtcatttcaagcgacacttattttgtctttgaaaaataattttatatcttttatcaaattaaaattattaagctacataaaaatgttctcaacagaggatttcagacttacctgagttatcttaataattaaataactattgggtatttataaacgcagtctaaggttggtatttttcatcttttaggctatagctgtttgtatggaaaatggcaactttaaagaagcagaagaagtctttgaaagaatatttggtgatccaaattctcatatggtaattatttaaattaaaaccatagaattttagaagtgtttatgtagagtgaggaaaactgaaagaaaattggaggagaaaagaaatgctttatcttttaaacagtatagaataataccgtgcaacagaaaaactacgcaagtcacatatgtgatttaaaattttctaataagctggacgcagtagcttacacctataattccagcactttgggaggctgaggtgggaggatctcttgagctcaggcattcgagaccagcctgggcaacatggagagatcctcatctctccaaaaagaaggaataataaataatgaaaaataaatacaattttccagtagtcatattaaaaaagtaaaaagaggcccggtgcaatagctcatgcctataataccagtactttaggaggctgaagcaggaggatcatttgaggtcagtagttcaagagcagcctgggcaacacagcgagaccctgttctctacaaaaaaattaaaaattagccaggtgtggtggcgcaatactgtagtcctgaggtgggaagattgcttgagcctaggaagtcaaggctgcagtgagctataacgctgccactgcgctccagcctaagcaacagagagagacgctgtctctaaaaataaataaataataaaatagtatagtatttgcatataacatatgtacatcctcctgtatagtttaaatcatctctagattatgtataataacttacacaatgtaaatagttgtactgtttaggaacaaaaagatacaaaaaatctgtatgtgttcagtacaggtgtaattttttcccccatacattttgtggaacaaatatatgcatttcttttgggtttatatgaagagtagaactgattagtcataagatgtgtacatactcagttttagtagatattgccaaactgttctccaaagtagttatgtcagttcctccagtagtgtgaaagaattctagttgctccacacaccttgtatctgggttttcattttagccattcaggcaaatatgtagtgctatcctgttggattttaatttgtttccctgatgaataatcagattgagcaccttcccttgataatgttagtagatagagttggagagtgactaccttaatccagtaaggaacctgggcctagtagagagtaggttgggcagttttggcaaggctttgtctatctctaatttaaccctgtacctggggtataaccctccagaaatttcagccaatagcctgatatgtctgttgggttttctacccttaatattttctccatagcactatgagactactgaaaattctactctgcttatacctcccagaagaggaaaacttaatggccaggaaatattaagaggttaagataagtacttgacctcactagtattaatgttgcctcattagggcaatattaagtactatattgaaataccactttccatgcctcagactggcatcaattaaaatgtcttagaatatcaacagttgtctcaacaaattgagaaatgattgtactgcctgccataacttcctttcaagactgtaaattggtacttctttgggagatcattttagcaaaatattttaagcatgcattccagcaattccacttctagacaataccttagaatagctggtttcacttttaactgcatattttaaaagccatgaagtttaaaggcaacaaaaaaccaaggccttcctgagacagttgctctgggattgagcctaagaatttttttaaagttctactttttttattgtgcagccagcattgaaaaagctactgtccaagaaaaacacatacaatgcacagaagataatgtagaaaaatgttgaagagcgatacaataattgcaagtagcctaaatccctcaataggcatgaagaatggatgaataagtgatgtttttgatcagtgtagtactttacaatggcaaaaataactacttctaggaatatcaaatcagcatggataaatgttgtaaacatagagttgagtgaaatatagcaagtttcaaaagaatacgcatcgtacaacactatttgtagagttaaaaccatgctaagcaatgctacatatttgtggatacatacatatgtagtgcaagtaaaggaattcctgggaatggtgaattctaaattcagggtaatggttacagttaggagaggaaagggaatacaatcagattatggtagtaaacagggattttaaccatattgattatgttttatttctgaaactgggtaatggatactctggtttataatacatatctttttgaatctgtctaaaatgtaaaatattttttaaaatgaggagaggccagaagaagtcagaaaaaggtacattggcatgccatttaaaacttaattttaaaaatatctgtgtctcttgagtttgtaaagtgatttcttttcaattaaataatatgtgacaaaaatcgttgtatctgtaactttgtgtgatttatgttaatatatttcttctgttttctttagcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggtatacatattattcaagagtgactaataatagacttaaaggaaacgttataataaaggagaatacttgaaatagaaatcctttaaaattaatcagaatttttcattgtggttttgtagaaaggtgtggtaaaatgttacattttgtggacctaattaaaagatttatgagtgatatgtacttttgtaacttttcaaaattagtttggggaaattttcaaaagaaaaagttgaagggaaaacttagaatgaattaaaaataagaaataggcaaaagcaaatattttaatttaagtaaattttaaagactttttaaacatatttttggggaaaaatagaattgtattaaagaagggccttttaaaatttttctaggccaggcgcggtggctcatgcctgtaatgctagcactttgggaggccaagtttcaggagttcgagactagcctgggcgacatggtgaaaccccttatctacaaaaaaatacaaaaaaattagctgggccgggcgcggtggctcacgcctgtaatcccagcactttgggaggccaaggcaggtgaatcacacggtcaggcggatcacacggtcaggtggctaacatggtgaaaccccgtctctcctaagaaaatacaaaaaaattagctgggtgtggtggcaggtgcctgtagtcccagctactcaggaggctgaagcaggagaatggcatgaacctgggaggcagagcttgcagtgagctgagattgcgccactgcactccagcctgggcgacagtgagactctgtctcaaaaaaaaaaaaaaaaaaaaaaaaaagctgggcatggtggcatacacctgtagtcccagctactttggggagttgaggctgtagtgagctgaggttgagccactgcactccagcctgggtgacaaaatgagaccctgtctcaaaaaaaagacatttctggtcaggcgcagtggctcatgcctgtaatcccagcactttgggaggccgaaatgggtagatcgcttgatcccaggagtttgagaccagcctgggcaacatggcaaaaccccatctctaccgaaaaaatagaaaaatttagccagacatagtggcacacgcctgtagtcccagctacttgtggcggctgaggcagaaggattgcttgaacccaggaggttgaggctgtagtgagctgagattgaaccactgcactccagcctgggtgacaaagtgagacttgtctcaaaaaaaaacacatttctagtcaggcgcggtaactcacgcctgtaatcccagcactttgggaagccaaaatgggtggatcgcttgagcccaggagtttgagaccagcctgggcaacatggcaaaaccccgtctctacaaaaaaattacaaaaatttagccaggcatagtggcgcatgcctgtagtcccagctacctaggaggctgatgtgggaaatcacctgagcccaggaggttgaggctgcagtgagctgtgattgtgccactgcactccagcctgggtgacagagtgagaccctgtctcaaaacaaacaacaataaaatttttctaataacattttattttctgtcttggcctccaaatttttaagttgacagtgttatagtggagcatcttgattgatttgagatagtttttatttgaaaatatctagaatttttattttttttttttttcatgcagccttttctcttaaaattgcctagagagcattttgtctatcaaatatatttacaaggaaagaccaccttcgtaacgctgataaaccaagcagatagctaatgtagctgctggcagtgtcataattattggtgaaaataacaacacagtgcccttcattggcctgtgaacagatacattagctatgactatcaaagaattacaaggcttaatttaatgctatttgtttaaaatggcttaatgcatttcttcctatccttctacctccacgcacgttttttaaggcagcggcaaaagtagtagaaagcaaaaggacaagaacaataacttctcaagataaacctagtggtaatgatgttgaaatggaaactgaagctaatttggatacaagaaaaaggtttgtaatttaatcaatttgtatattttttgttttatgaatgttctgtctttatgtaaaattgatatgtctttttattaaaaataattattgagtagcatgttatcttgctgatgattaacatttaggtatttgaagtactgtagagttatttcatgacttgtgcaaattatatatgctaagcaaaagtagagaataagaaaatattacagtttaaataatgtggatagtttaccattcttggggtatgcttaggaacaagggtgaggttggactcctgtgccccttagttgtgtttagattctacatgttctcattatgtgattcatgtttcactgtactaagagtctagtattttaagatattattcatatatcttctctaagcataagctcactgcttcatctggtgctcaactgaagaaatagtgatttgctttaatactggaggaaaacaagttgtgtcagtcctatatattgagagatagttgttaagtctccaaaattattttttctttagggattttcaggggtgattgttgtcttttgttttagaagcttaagtatcttcccctattgagaaagatataactcttaacattataaagatcttcttttctgttgaacccatggtctgttttctctgttcttctacccttaaaccaaggccagataatcaaatctctgtggtctctggatgggtatatttggaaatggatgtaatattactttcttcttgggaccatgacctaagtgttgcagggaccccatcttaactacttatttagaggtggagattggggttcaagttggatctacactgcatttgtcacatcttaggactgaggttctgtcatcttatagtggcccctcctattgttcctgcctgtcaaagcatgacttgttcctcaggggttcatctctccaaaggctgtactaaagtcttatttcacattgatgtacttttttctaaactccaatttaagaagtagagattccatttttattggcccaattacttccttttgtttcaaaaatcaaagttgaatgatactaatacccagtacattcttgtggccaagccatcctgctcatgataatattgctaataccatggttcttacagataatcatgagcacacttcctatggactctccttatatagtgctacccacttatttcagatgctctcctagacacaaacacagtgcaatccatgtgtaccaaacagaactcttcatgttctcatttgcctctctacaccctgcctctctttaacctcacacatccagctgctctccaagtattaggaaccgcacctcagaaatgcttctccaatctatttttatctatatagctttgtaccattcaaatccatccttgacataacttctagagttagcttccacaaaaataaatctctttagatcactcccagcttaaaaaccttttggctcctatttcctactagatgagtcagaatttattggcatggcttataaagccttacgtagacccattttttttttttttttttttttttacatacagtcttatccctaagcatgaactcctccctgtccacatacatggtactttctagcagcacagaagctttgttccttctatttgaattcctatcattttattctctccaaggcaagctcttccttgccattcagtctatctcagagatcacctatatgaagtcttgcccagctctgtaatcagagttgttacttctgtgctttcatagcatacatctctataaaaggacttatcttcgttggtaacttatttgtttacctgattctttcaatagattgagaattatttgaaggttcttacttagctttgaagcatcttaattagcttggtatccttgttgcctcattcattaccaggcatacattagaacttgctgtacactagttacagggaacaaaactaaaaccagaaacagggtaaagatcaagaatcgagcaaataccaaaaccatcgtggaagcagaaccagggcaaataaagcatcaaaccaccagtgtcatgacagttaccagtaaggattcaagtaaagcaagtatagaatcagaagtgtgattgtgaggtcagacaaatcctagaaaaatggaaacctccatgttatgaagactagatgaaataaatattttgctctgataaagcttatacagttgttccttggtgtttgaaggggattagtcctaggacatccatccttcatgaataccaaaatccatggatgctcaagtgtcttacaaaaatggtgtaatagccaggaacagtggctcacacctgtaatcccagcactttgaaaggctgaggcaggaggatcacttgagcccaggagtttgagaccagcctaggcaacatggcagaaccttgtctttacaaaaattaaccagtcttggtggtgcatgcctgtagtgccaactacttaagaggcttaggtgagaggattgtttgagcccggcaggtctgcagtaagctgtgtttgtgccactgcactccggtgaccctcggcgagaccctgtcaaaaaaaaaaagggggtgtaatatttgtatacaacctacacacatcctcccatatactttaaatcatctctagattacttaaaatatctaacacagtgttgaaatagttgagatggacagcttcatggaggtagtagtcttgaacaggggcttttgtaggatggttaagatttttacagatggatagaagaggaaatatcattttaggagagaggaatattactagtgaaagcatggaggtgtaaatagtcatgctgtgtgtatgtggaaaccattttaactataacaaacgggaacttaatcgattcccaaaagttcaattggagactggtggggagaaccagaaattaaaattgaacccatcaaattgtatactttaaacatgtgccatgctttttatgtatcaattataccttaataaagcagtttttaaaacttgaattcatggaaataaagtgccgtagaagagtttttgaaagagtgttataaatgcttgactacaccattaattatgcttatgtttggagaaacttggtttaatacctcttataagcatgtctggacaagaattagccatgttgtaatggactgtatatgtcccgatgttaccaaggtttctttccaaagttatttttttataaattgaaatatgccttgactatgtggaaagtactatccttatgaaaagtttcttttgtttacattcttacaaattttttcttcttttaaagtgttagtgacaaacagtctgcggtaactgaatcctcagagggtacagtatccttattgaggtgaagtaaattgacgtttttcttctttgtctttcaaatctttgattgaagcaattcatgcagacctaataaaaactaccacataaatggtacaattgaaagaatatctcagggtcctagttagcccaacagatagtcacgactctgagacatcttgaaattccaaactgtagagacctgctctgagactgggttgtttcacattgtttctacaaagccattattggaatacacatatagggagttcttgagcttaaaacagatgtttagtaaacacttctctgtcacagaaacaaagatatgatactggggcaggaaggggatggcaattacatttctaatgaatgccccatgccaattttatgaaagttacttgaaaaactttatttgatctaatagaatcgctgtgacagacaatacaacctgtcccgagggcagaaagtctgcatgaatgatttctaacatagagcagttgggatcacaagtggaaccatggggaggaggtggctgacttcatgtggaggaggtgattggacatgaggaactgagaggccaagatggtatatgaattgtctgtgagaacactgaaataattcataatagcagcacttaggtgtagagaaagatctgtgaatgatgaagaagtgcttggaaggatggtaaatggctgtgaagaatgattgaaggtgatacatctcagtggcatgaatcctcaaggctgaagtttctatggaagcaggatcttgaaagtggcattcattaggaaatgaaaactgctgtctctggagtcctatagtttatggagggtggaagattaagccaatctctacttgagaaggctaccaaggagagaaacattgtccccaggggaaagctagattttagacaaggcaaagagcggagaggaatgggtgaagagattgagaatgacattctagaaaggacaatagaaagtcttaggaaggagggacagaggggaagagagaaaggatggctggtcacctagagtatctatagggataaaagtatagctaaaataacctacattttaggtggagataatacagctgcctaagcttaggtgaactgctttttgaatcttagtttgctccttcataaaattggattaatataataccaatttggcagagttttcaaaaaaaatgatgccacatcctgtgtttccaaacagccttacctttcaaaactctttttggaagctgtaaagataatcaagtgatacctgccattatgtaaaggaattttggaatccgtctttggggaaataaaagccataagagagaatgaaagctaatactttgtagtttaaggatttttttccttgatgtatctaattggaaggccgaaagagtcttgtcttttcttttttttgcctgcttcttctgagacatcaaaaaacatcttgatttctgcggagtagatgagatggagaaagatgagacaggcaacagaaatcttaagaggccacaggttaagatggggtactaagcagggagagcaccaaaggaagtaggccaaagtattaatagaagatcctagaacagattaaggcaaatcatttacctgttttccattgccttactatctttctggagccaattacaaactttcctgttttattttaggtctcacaagaatcttttcttatctaagttgcaacatggaacccagcaacaagaccttaataagaaagaaagaagagtaggaactcctcaaagtgagtactgttataacagttttagaaggggagaattgatgtgtcctcaaacaatccagccattgactttaccactatagcaaaaaaacacacacttcagaaaactgaagcacaaagtcttgacttcatagagttaattgagatagtgtttaatttagaaagttagctattttgactgtctagcttagggttcttttgctatggtggtacactgcttttctaccttcactgtgttcagcaacttcaagtatagtcatatgccacatcatgacatttcagtcaaagacagactgcattgcatataggatggtggtcctgtaataatgtaatggagcacatatggaaacttgataatgtggcacttgatattggcattgcatatcaagtaggggaaatgattgataattagcaatggtactgggaaccgtgggttttctatatgaatatatatatatatatgtatgtttgtgtaagtgtactcttaataatgttcacataaggacaaaatcacccaacgccccatttctcagaacatatcccccttgtaaagcaatccgtgactgtagttacttttcagaaacattaagtacagttgattcttgttattcacagtagttacgtttaataaagtctgagagcgttgacttagcaaattacaagtttctttttggtatgtagtcatttaacaaatgtttattgaccccacagtaatattttaggtactgaactgatactgagattttttttttttatactttaagttttagggtacatgttcacaacgtgcaggtttgttacatatgtatacatgtgccatgttggtgtgctgcacccattaactcgtcatttagcattaggtatatctcctaatgctatccctcccccctcccccctgagatttttaatatggatctaaacctaaatacttattgataaaaataatagacataatgaaattaggtttatttctccatgctcataaggtaccatcttggtgccaggcaaatgataggcctgcagtaaatattatagaataaatttgttcatacctgatggctgatgacatggcaaccattagcaaatatttgtaaatagagttctaaaatatttacattcatagatatcattcccatttttaaagatgagaaaacggaaactcagtaaagttatgtgcttaatgttggtggagttccaagattggttttctatacctattgctgcaagacggctgggaatcattttaaatgagaataatgtgagcattttcctagggttttaatttcatagtatgaaattcaaagaaaaggaaatgtaggccaggcgcagtggctcacgcctatagtcctagcactttgggacgctgaggcaggtggattgcctgaagagctcaggagtttgagaccagccttggcaacatggcgaaaccccgtttctactaaaaatagaaaaaattagccaggcatggtggtgcctgcctgtaatgccagctactcaggaggctgaggcacgagaatccagcttgaacctaggaggtggaggttgcactccagcctgtgtgacagagcgagactgtctcaaaaaagagaaaacatggtttatcagcaaactcgaagactataaactctttgcaaactggcttgacagtgactgtggctattgagtctataaggtctttgagttttagcacattttattaggtgtcagtaataagtacgttttcttaaaaaaattcagtgtacttcagtggtacccaggtaccccctctttatagtttgaggctaataattttgtttgtgctaaacctttttttctcttctttttctgtttttggagacagagtcttactttgttgcccaggctggaatgcagtgcagtggtgagatcttggctcactgtagcatctaccttcccaggctcagttgatcctcccacctcagccttccaagtagctgggaccacaggcacatgccgccacaccctgctatttttttgtttgtttgtttgtttgtttgttttgagatggggtcttgcactgtcaccctggctggagtgtggtggatcaatctcggctcactgcaacctccatttccaggtttcaagcaattctcctgcctcagcctcctgagtagctgggattacaggagtgtgccaccacacccggcagatttttgtatttttagtagagacggggtttcgccatgttggccaggctggtctggaactcctaacctcaggcaatccgcccacctcggcctccccaaagtgctgggattacaggcgtgagccaccacacccggcctttttgtgttttttgtagaggtggggtttggcatgttgcccctgcaggtctctaactcccaaactcaagcaatctgcttgctgtaattgtgctgagattacaggcatgagccactgctcccagccctaacctttttttcaaaaactaatttttgtgttgtaaaattgacatatgcttagggaaaaaaaatcaagttaattcagaaaacttgaaagaaaaagccaaatcatccagatttcatcagtgcagaaaaactcaccagcattgagtgaaattattaatatttgagttgaaagctttttataggtaaatgcattcaatcctcaaaacaaccttatgagattagtgctttttttttttatcatctccattatacagatgaggaagctgagacttaaaaaggtaaataaaatgcctttggttacacagtgtatgaatagaacaggagccaaaatttgaaatcagacagtctgactccagagcccaggcttttaattgcttagatggactacctcagtagaagaatgtatagattgaaagcaaatcaaattttagaaaaatgtcatcaagttacatatgttactttaaaatatatttacatttaatttttaatatgtaaaactgaaggattcagtacttcagataaaggtggtttcacaagaaatctatcagtaacctttatgatctgtgtaaaataaagaatatgaaatgctttaagaggtcattcaactttagttaatcaactttagtctgttgattgaccttagcaaaaatttcttccaccaatccccaaattttcttggttatattttatataatcaatagttgtagcattgttttcccatgttggattttcagttcaaaatactttttcatttttgtagagacttttttactgacctatgagggaagttgtttaatttccaaatatctttctgttactgatttttagtttaattctatttcagtctgtgaatatgcttcgtagatttttttttttttaagatttgttttatggcccacagtatggtttattttggtccatttggatgtgcacagagaagaacgtgaattctggcattgttgaatgaagtgttttaaaatgtcaattaggtcaagtttttaataatgctgttcaggtattctatatatgtactcatttcctgtctattgttgtatcaattagaaaagtgataaatctcccaaatataattatgaatttgtctttacatttatgtgattatttgctttttgctattttagtcccctagcacctgtttaaacatttctcctaatgctaaaatctctccatcagagctagtgtggtttccattttcctgactggaacacacccagtatatatgtcaaaatcccatatatgtcaacatcccatgtttgtagtagggtaatcttattgtttttcaagagtatcttgactattctggtgttttggtgttccatattgtcagggaaaaaacctagccatagggctttataagcagtaaacctgctgctactttatagatacaaaaggtagacaacaagacttagtgacttaatgagttagagtaagacagattattatagcaaacaacatggcattgatgtagttgttcagatttccctaccccaagtccggtggactatgcaacaggcctaaatggatgctgcgaaggcagtaagttatatttcagctgaggaaaactcagagccaagggcccagtgctttttgagtaagcaacaaaacattgtaacaaatagcaaacaagccagtaccctctcccaggagagagcagttggcctggtcatcatgttgtggtttccttgacctgcttaattgcctatctgactggctatagaaaatgcactatttcaggagatgaataaggcttttctacattcaacaggaattgcaggggtgctcagagccaatagtggactacctgtcttaacacataattttagaataattttgttaaactatacgaagaaccctgttgagatttttatgtgaaattgcattgttaacaatagatgattttgcagagaactgacaccattacattaagtttcctgtgcatgaacaaaatacatttctctaacatgtttttatatatacagtcatcccttggttttcacagggtattggttccaggacccatccccccgcccccacagcagggataccagaattctcaaatgctcaagtcccttacataaaatggcatagtctttgcatatagacctgtgcacccgcctaccacatgctttaactcatccccaaattacttacagtaactaaaacaatgtaaatgataaataactaaattgtagtaaataattgttagactatattttttatttgtatcacttttattattgtagttatatataaatatatataatatatatttatatataatatattatatatatatgacctatgagggaagttgtttaatttccaaatatctttctgttactgatttttagtttaattctatttcagtctgtgaatatgcttcatagatttttttttaaagatttgtttaatggcccacagtatggtttatatgtaatataatatataatatatataatatataatgtacataatatataattataatatatataataattatactacatataatatatatcatatattatataaaaccccatatatactatataattaataatttatatattataatatataataatttatattataatatataatataataatatatattatataatataatttatatataattataatataataatttatatataattataaagctttactatgtatataaaacatgttatgagaagctttatctatcttatctacctatctacttacctacctacctacctaactgttggccctctatattcacagattccacatctgtggattcaaccaaccttggaataaaatatttggggggaaaatacatataaatttttatatataatatataatatatattatatatgttatattaacatataaaatatattaaatatatttatatataataaatttatatatttggaataaaatatataaaccttggaaccttggaataaaatattcgggggggaaaatatatatattttttatatataatatatataacatatcataaatttattatatatattatatattatatataacatatataatatatattatatgtataataatattatattatatataatatatattatatagtataatattatattatatataatatatattatatagtatgaaatatatattatatataatattatatagtataatatatatattatatataatatatagtataataatatatatattatatataatatatagtataataatatatataatatataatatataaatatgatatataatatatataaatatgatatataatatatataaatatgatataatatataatatatataaatattatatatatataaaacatatatatatttttccccccgaatattttattccaaggttggttgaatccacagatgtggaacctgcgaatatagaaggccagcagtaggtaggtaggtaggtaagtagataggtagatagatagataaagcttctcataacatgttttatatacatagtaaagctttataatttactacatacaaatgtatcacttttgataaagttatctaagaggccatgacctgatggctcatacctgtaattccagcactttgggaggccaaggcaggaggattacttgagcccaggaattaagagaccagcctgtgcaatatagtgaaaccatgtctttacaaaaaaattttaaaaaattagtcgggcatggcggccggtgcctctagtaccagctactcaggaggctgaggtgagggaggataaggcagaagtatcacttgagcccaggagtttgagctgtgatcataccactgcacttcagcctaggcaaaagagagagaccctatctcttaaaaaaaaaaagttacctctaagaatgttagatttttttgtggctattgtaaatagtatctttatattgttttaattaaattattttaactgtttgttgctaatgaatagaaatcctattgctaatgaatgaaatcctttttgtgtattgatcttactgatcttttaattctatttgtagattctcttaggttttctgcctaaacaattatcatttttcagtaattacagttctgtttcttttcagttacatatatttgtcttaccaaactgactatgaataagaaagaaggagtgaggaaaggattatgcttcttagtactcctaaaacattatcgtaagaaaatttcaacgatcctatgcaataaatatttttcctttttttttaaacagataatggaaagacaggttcagggatgtgaaatgatttatttaaagacatataaaagaatcaagactcaaaacactccccctctgatttcaaaggctgatctttgcactataccatactgcttccagatttgaaggaaaaagttaaacatgtactttttcttagaatagcttagaaaaggaatttcattataatcattaaaaatataattgctcttttttctttaatgtaaatcaatatttatgacattatttttctacttttaggtacaaaaaagaaaaaagaaagcagaagagccactgaaagcagaatacctgtttcaaagagtcagccggtaactcctgaaaaacatcgagctagaaaaagacaggtatttggttttttaaaattcgaataacgcttatggacattaaagttataacttgaataattgtgattatttctgttcaacctccccaaaattttgagtgtaaaatatttgccctttgccatcttttattttgccgtcttagataggtgactaatcagcctattcaaaatgaaatacttcacccatatttaaaaagtcttaagttgggtgttggtactgacatctgtttggaattattgtgatactatcataaaatctgtttattagatgtaaggtgggacttaactccacattataagctttgatgtttaaattttcctaacagggatccagtgtaaaaagagttttctttacttaaaaacaaagaaaagataccatttgatcacaaaattttattaaggtgggtcaatttagggcttgattcatttgcttcccctttcagtgactatagtcttgtgccatctgtccagtgtctgaaaccattattttatgtattttttgattgtctagttgttcacagcagatggataaatctggtctttgtttttgtggtgtgtgtgtgtgtgtgtgtgtgtgtgtgtgtgtgtgtgtgtgtgtttcccccttttttttgtagagatggtgtctcacaatgttgcccaggctggtcttgaattacttggctcgagtgatcctcccaccttgggctccaaaagtgctgggactgtaggcatgagctactgcacccagtcaggcccttgttttcttttgtggctggaaccgttttcttactcgaaggtgcctttttttttttttttttgacaagctaattgcaaatagttcatactgaggtgctgcagatagtgtcaagttgcacgctactcggaatatcttctgtgactcaaagttatgttacccttcatttctcccccagtgaacatagcaagcaacttctacttttcatttgcttcctacacatattacttgcctttgtgattcccttttttagccttgccatctctggcctttagtaggttgaggggagctcctgctgttgctgaccagagatttagggggtgtacctcagggtattttcattagaaaaacagatggcacacacttcctgagatctgtagacagagttgctttttcatacacctaagttgcactgattatttataccctttctacctacattatggttcaggttgtaaatttctcttaacttttttcagagtttgggattttatttcttgttgcttttgggtgaattcccaaaggagaagagggaaatgctaaccttatgctaccatatgtgaccacagtcatgcatatgttttgtgctggattttttttgcagtttgaatatgatgtacatgtatatagtttgttatttatcctgcttggtattttctgagcttcctgaatctgtagtttggtgtctgtctttagttttggaaaatgctcagccattattacttcaaatctttcttttgttcctttccttcttcttctggtgttcccattatgattccaaatgttacaccttttaagattgtcccactgttcttagttattcctttatctttttcattcttttttctgtttacttttcagtttgagaactttctattaatatatcttcaaatgtactgattctttcttcagctgtgtttaatctgcttatgagcccatcagaggcattgttcatttctgttaccatgttgatttctggcatttccctttggttctttcttagagttttcatctctccatttacatttacccatctgttcttgcatgttgtccactttttccattaaatcctttgacatattgatcataatcattttaaattccaagtctgacaatttcaaaatctgtgccatatcttgagtgtggtcctggtgcttgctttgtctcttcagactgtgttttttgctttttagcatgtttataatattttgctgatagctagacatgatatatcaggtaaaaggaaatgagataaatgatcctttaatgtgaggttttatgtttatctgtctaggagttaccgtttgtagctgtaggtgtcaaaggctaaaatttcctttagtgtcctgtttttgtctctcttgttgtctctgggtttccctagagactgctttttaataagaatctgagggacctctttcaactataacgcccaggatcctgactaatgtagtggtaaggtaaggggaggtgaagcgttctggagtcctgtgcatagttctccttcttttagtaagcctgtgtcctaggctgtgaccttcataagtgcttctcagcccaccaccccttgggtgagacatgaaggctagagaggggtggagttgagtatttccacaggtaagttaggttctggtaaaacctcagttggttaggttctggcaaaattagtttctcttgaggaaaggattttgttaagaagaccagaacgctttcctcatttattttgaaatggggagtatttctaattggggagtatttcaaaatggctactttttccctccgcctgtcagaagcaggaaggaatttttgtgtaatctttaccctgagacctgggggggctcctggagataaaactcacaaaagtttgtgagtccctctgaaactgggcccttggagtttttaactctgaagcttatccacacggatcctccatcagttcctcagtcacagttaattgctcctaccagtattggctccagctgtgagcttctgctcctggcctttctgtccccagtaattcttgtgattttctcaatctgcctctctctctctttagttttcaggacagcagtttgccctgtgacatttgttctttgatgtatctaagaagagttactgagtttcagtttgttcaacagcttttttcttctggggactgtagtgatgatttccaagctcttcacatgttagattggaaaccagaagtctctgtcttatacatataactgatctttccctatagttcttccagcagccattccaaatgaggtgttatttacagatatatatgaggaaaacagttgtttctcttctattcaaaacgaaatataggatatcgaccacataatcagtgataatatctatcaccatttcctatgccaaaaaagaattctgtggatatcacaagggcctggttttattttttagctttccgttgttggccttttgttaaaatacttgttttagaagataagtgacagacttaattttattttgtattgaggtttttaaaaaaaaaaacttacggcaatagcccatgtctacttggacagttttcttttgctgcattggtctgttaaagatatttcttccttcctcatcagaattaaagagccctccttttataaacttattccattaaagaagaaaagtaaatgcctttcaaactgttttccataaacagtatgtaatgagaaatactgtagcagtattttcttttactattcgtagtatcattttaaggcattaaaaagcattatttgttctttagaatggatatacagtgcagatctgagttatgtaatctctagccttgggaaagaaaaagattggtgtgttttaatttgttatgtgctctttgtatcttttcaggctattggcatggctggggttgttaagattttgtatttgattttttgagaaaataaaagacaaatgacaataaaacaaaggaaatgggttgtatgggtttaatgtccagaaatacatcatcttaaactcttcccttaattattactatcagtggaatctggtacaatcagttaaatgtataaaatgaggaaatggaaagttttaagcacaatagtagactttatgaaattgtactgcccttatgttttctttctgatctgacacaggtcagttgtgtcactcattaaactctagctatagaaagtagaagttggtaccaatgactactaggccacttgaacctctaaacttaaaaattacagctttccttacttgccagacgatagcttattctgtatgatgttttcaaaactctttcagtcacaggtaaaattaagcaaagactgaaaacattcagatcaagcaaaacaatcaaggcataatcaaccatgaaataacactatatcaagctaaagttactctttttcaatagaagaaaaaaataaaatacttaatgctaaacactgttagttttcagttaatctatactgacaacattactactttcctctaggttaggggtgagcaaaatttttctataaagagcaagatttataatatatttattactaatgtattttatgtatatttcacatacatagtttctgttacatattttaaatatattttttaaatgacttaaattttaatatggttcttagctccggggctgtagaaaaccagccttgggctgggttttggcagtggcttgctgtcccctgctatagatgatacatgggaaaatactgcttaaacatactgcacccaggaccccaaataggattcagaaaacattggtcatttcttgaaagaaaggggcttttgtattgtatcaaacgtcatctgtgcaccttattaaaaatactacagctcagataagaacaagaaaacaatgctgtatatgtgtatgaaatttgtctaaaccacaaactactttttaaagctgaataacgtatatggcaagtttttgaaagaacagaaatgcttaacttggagaccatggagttgataggctctttaaagagagtttatgtggcccccaaatttgtatatgaaattttagatactatacttttctgtggagtacgtctgtaagatttatatgaccccaaagattaataacccactgttgaagtgcttttaatcagtcaccccacacatgaaaaatttattaatgcatctcttggtttttgtcagttaatgacaagcagtgtagtgaggttttgtaggagtgaaggccgagtcaggcagtaatagatggtcataggaggctgtcagcctttgtctagcgattgaatagccatgtacttgtaagcagcacagttgccgataggtgtgctgcagacaaacaaaagcaaaagcacgtacagaagagaccaggttcgtatcttggatttaagtcacaaagcagaggaatagcaagaacaggggatcaggtttaaggtagctcaaacaaacttctgcatgggtttggttacggtcactgccaactttttggtactgagtcatacacgagatggttctcatgtcatgtttgtattcttcaggccaccttgaattctttctaatattgcattagacaattgaactggatttttttttcttcgattatagtaaagtacacatgatataaaatttaccatttgccattttaactatttttaagtgtacagtttggtagcattaaatatattcatattgtgctaccatcactaccatctatcaatagcactcttcctcttacaaaactgaaaccgtactccttaaacagtaagtccatttccatcctcccagcccccttgccaccatcattctactttctgtttatgagttggactattctaggcacctcatatcagaagtagcatagtatttttctttttctgtctaacctaatgtcctcaaggtttatccatgttctagaatgcgtcagaacttcctttttaaggctgaattatataagtataatatataatataattttgtttatccatttatcagttgatggacagttgggttgcatccacattttaactattgtgaataatgctgctatgaacatggatgtacaaatacctcttcaggtccctgctctcgactcttttagatatgtacccagaagtggaattgctggatcatatggtagtccttttaaaaaattttttgggtaactgtcatactgttttccatagtggtgctataattttacattcccaccactagtgcacacaggttccaatttatccatatcctcaccaacacttattttgtgtttttttgatagcagccatctgaatgagtgtgggttgatgaaccgggtttttaaagaaaatctgaagtgctggagaatttcttgtagtctagacacagtaaataaccacgcagatggtcaaattgctctttcagcatgccaacagaaggaataattagttagttgcctgtagcaaatgccaagtatcagtaatttttctgtgtatagtattaaatttgatttttaaaaatgtttaggaattttctcccagcataaaattaaatgtttttaattagtttatgttagttgtatttttgaaagtctattttagacaagatttgagttttatatgggtgtgtaatacttcccctaccataggcagaacaggtttttcactgagttcattagtgaactactaaacattcacaaagcctatttggagatttggaggataataaatacaactattaacaattgtagaagagcattttaagagacagtgtgggcttaaagtcagacaaattcagttgacatgtagcactgccactttctagctatctgatcttgggcagctgagcttacataaaatgaacagtaataataatgacccctaaaaatgttacgataaatgtaaaatcttttaaaaatctaagaaatgtttagagaagtcttccgtctttaagaaactaagcattattttgattttttaaaactggcatttatagtaggtattttctttttgaataattgtttctgtaaataactgttttactttttatcaaaaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacatacctta

SEQ ID NO: 36417 - DNA, 28701 bp, Homo sapiens
ccggccagcgggcgggctccccagccaggccgctgcacctgtcaggtgagggggaggagaggtttggctgccagattcaactggaaaggaaccagtcccagtccagccgcaacctgggagtgggaagctggaggcagcccagacctcctggagccctgcagtcctggggcagagacagaatcaggacacagctcgaggtcagggccagaggctggagctgagggcctagagtgagagggggcaaggcaagggggggagaggaagagaggcaggattagagagaggaggcaggccagaaagaggagagcaggagagacccaaagagaaacagaaggcagatagagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtcggttagtccctctgccccttccctggtgcctgcgcctggaagggtggtccagggtgctgaggtgctcactgggcaggcagagcctcagacctgagggtgggaactgacacccctgtcccaggtagagctcactgctggcaaaatgaggagcctccagcttactggactggcgtccctgcccagtggagccatcctagcaccccaggctcacccagagtgtggttgttggagcagcattgccctcccctgccctctcttctccttccctcccattcccttctccctcctgcaagtgggagggagtgcttgcaaaagggcaggggtgtgctcagctgcatcccttttctggagcaagatgccagcaaagtataagacctcgtccacctcagcaggagagtctgatggaggggtgaggctaggtgaggggaggcgagaccgtgcaggtgctgtggaggtggtgctgtcagtctttgtttagaaggggaatttattatggagaaagcaaagagggggatcgtggaggttagggctgcaagtgagcccaaaggctgggggcaggggccttacagaacaaggagaatgggtcaggctagagagcagctccttgtgaagctcttcccccaaaagacccaggctaaaatgctgcactgttgacctgcccaggtgcctgacctttacgtgcttgggtgtgtcctgaacttttgggtttcatcggtgctctttgccaatgttgggtctggaaaccggagcaggtggtaagcgtggagaagagaggagggcagggctgagtgcttttgtataccttttatttgtattcactcagccatgccacaccttgggaacacctgcttcaagccagacacagggctaggcacctggcaaaatggattcatgaataattcataagccctttattgaaggccaggtagtttgctgtgttgtggagacagataaaataagatagcagagacaggcatataagccagtaactgtggcacactgggataagtatgataaaaatggtgagttagtgtaccttcaaggagtgcaaaatctttatgggtgtgggtgtgagtgtgtgtgtgcacatattggtatgtgtgcgattttggatgctggggattggtcatgctgtgggtggaggccccttcgtatattccatcatgtccaaaggtgcgttacggactaagaaagggtgggacgtcctgtcctggagagagagagaaaaaaaaaagccaggtcatttcgttgattaacgtctgtataatgtcccaggtagggaccatttccttaggaagctgccgtgtgcacagacgctgcgaaggtgtcttgggtatctcatttcattctcacatcttacaagcccggtgctattgttatccctattttacacttgaggaaactaaggcaaagagaggcaagtcacaacatcacagagagagtgactgagctgtgactcatcctgtttacgcctaatcccaaaactctgcctctttttaatacccaagatgtggggctttgagtgaatgaaacttccagtcagatgtggcttccgcctcatttcagagctctcttgggtccttcctcttagcctcatttttctccccctgctgcctgcagacatcttcacccctttaggccttggtggaggggagggacccagcaggaaggggaaggacagcaggcggggcagtgggcactcaataaatatttgtggttgaaaatatgtcagtgagagatggaaagggagggcaggggtgaatcgggtgaggcctgcacagttcttaggttctgctggatgcggggccctagacagtccaggaaaaagccggggaaaggaagccataagccctgcctctggggcctgcaggctgggaggcagccatctgcccagaaagaatccctccttcttgaagggctgctgtgggagtcgggagggagagtacacctaggagaggagaggagtcggggaagggctccccagcacagcgggaggagatgcaacacccaccaagcactacacacttgaccttgtagtcacattatgtgctacaccctaaagctgggtgctttatagacactctctcatttaatactgacaagtccagggaggtgggcagtattattcccatttttttagatgaggaaattaaggcttggcaagaggaaataatttgagcaagggaacatacattatttatttattaaattaaaaaataaccgctgggcatggtgcctcacgcctgtaatcccagcactttgggaggccaaggcaggcattgagggatctgggatggagctcaaacaaggttgtttaaaagagcccctcacttgaggccaggagttcgagaccagcctggccatcatggtgaaacccccgtctctactaaaaatacaaaaatcagccaggtgtggtggcgcacgcctgtagtcccagctacttgggaggctgaggcaggagaatcacctcaggaggccgaggctgcagtgagccgagatcacgccactgcattccagcctgagccacagagtgagacacagtctcaaaggaaaaaaaaacaataataatgtttgtatatatttatgggccagactttttacaaatgaatctaaatcaaatgattctgctttaaattatttaattctcacaacacaccttggaagtaggtctcatgatgactcttattttatggatgaggaaactgagtcccagagagttaagtaactgcctcaacttcagacagacaacaagtggtgaaactgggactcaaaaatcatcccccgccccccgccccacccccacccccaccgtccaccctcacccccaccccccgcccccccgccacgctccaatggaaagccagggcatctcaggttagcagctgagtcacaaacctagtgtgtttgatttcaaagctcttttacccattacactttaagtagggatcaggcaaagacctcccagggtcgggggcagctggtgggagcccagcgggcagagcagcagtcattggaggacaatttgtcaggcgtgcaggagggagggatccagggccactcctactcaggagagtggcagggaggtaaacaggttaatgagcccctgtgagtgaatcaccgggagcgcagtgaatgactcctaccgaggagatcggttgatgagctagaggaactggagtgaggcagagctgcccagggctgcctacctgctgagggtcgccaccagcagagggagaggaggaaagtggacatgcaggactctgtgctgctttctaacttcaaggaaaggggacaaagcactgaagacctttcagactaagcaaggaagtgctgagtccgaagggaagggttggccactgcagcccctttctctctggtcaacaaagggcttcttcactgaaaggagagggccagtcatacctacagtcatggaaaacagagcccacagacatatttttcatccagtcccaggaacggtttaggctggacccaagaacttggggttcttgaacaatgaaggaggtcatggtagcttctttcctggaaatggcacagcaggaggccaggagtgggtgaagcaaggggcagtttcccagagagagctcctgtggggaggatgggaaagccctgagctagggaggccgtccctgcctgtggtccccagacgtggcgggcagaccctgcattccctgggcagtctggacaccaggctgtgctcagcagggctggcaggaaaaaaagcctggactgttgagagttgacatccctctaaccctgccatggtggttggatccttctcatcccaggtgggatggggcctaggcggctcccacggctgttaggatgagcatgggctcttctgtgagaggaggccaccggggtaagagggagggaagaggaggagagagcagagtgtcagcctccaagtctcccagggtccttgcaccctgctgctccgtcctggacacggaagaggggctagaggggagagggccagctgcagggaaaggagattttgctgcctgatcccagatgcttcagagctgggaggcagacacagtggaaaaagcaggggccgtggagtgaacaggcctgggttcacatcttggctccagtccttcctggctgagtgaccctggggaatttgcctagttgataggcctcagtttcctcaactgtaaaatggggataataatgcctgcccgatggaattgtgtaagggttgactcaccctccaatgtagggctgcctgccagagcagatgggagtgagggcagtgagcatgacctgaggaggaggtcaaggccagaagggctggactgtctggaagaacccactgtgggcattctttatcccttccctccagccgctggtctcctcaaaacaagatcggatgtcttcaatgtgctttctgtttagtggtcaattctcttagctctaggtgtcaactcaaaggctctgcctcctgctataggaatttctagtatcacggggtcatggagggagagattttttttttttttttttttttgagacagagtcttgcactgttgcccaggctggagtgcagtggtgggatcttggctcactgcaagctccgcctcccgggttcatgccattctcctgcctcagcctccagagtagctgggactacaggcgcccaccaccatgcccggctaatttatcatacttttttagtagagacggggtttcgccgtgttagccaggatggtctcaatctcctgacctcgtgatccaccatcctcggcctcccaaagtgctgggattataggcgtgagccaccgcgcccggccattccgtcttatcttatgccaaaaaagaggagcagtagaccttttgggagagtgaaggtggggccctatggaacccagcctcctctggaggccttgtcacaggtttgtgtgtgtgggatcaagggctgggagcccaggctgtgctcagtgggggggctcatcagtgaggccaggcaggagggaggcgcgtagggtggcaggagggaggtgcgtagggtggcaggagggaggtgcgtagggtggcaggagggaggtgagtagggtggcaggagggaggcgtgtagggtggcagcatggaggaggaagccgggcacagagatggcatgggggctccccaggggagaggagtgtggccagagaagtgacaaccagattgaagttggtgatgagagagagggaggggcaggaggcagaagggacttgagccagcctggggaaggagtggaaagggaggcccagccaggatgtggtggaaataactccaggcaagtgggggatctggattcttcctgtgtgaccttgagaaaggcaaattcgctttcctgggctcctggctcctctgtgtcttcctgatagtcgatggtctcttcactttgtgtcactgagtattttctcacttaaccccccaagagcttcatgcggtaggcagatctagtgttatgcccattttacagataaggaactcagactgagagtcagaaaggctgggtcacttaccccgagttacacagacagaaagtgtgtggctggaacaccaggccctacatctcagagaggttctggcttgggtgctctttctggggcaccatgtggccctcctaaaatagccagaggtagcagggacggaccagagggcagtgtggtggttggagtgctgtctgacccatttgctagctgtgccaactggaataagtcatcatgcctcaggtttttcacctggaaaagggaatgacaattgtgttagctaacagtggctaacggtatactgtgttacactgaagattaaatcatgttaaataagttttagcctaaagttgcctctttacatttttaaagtttgtcctaaaggtttcttcatgcatagtgaactgccacctaactagatatgtaaacacactataacctacctttatagcaatcacagagttttggccaatgaaaggcagcccacttgtcaaaccttgtccaaataaggcaaacgccgggggtgtaaccaatccgggtgtttctgtaccttacttccgttttctgtgggtcactttccttttcctgtccacgaatattatcgaatcatgcagcagcccccagagtcactgtgaatctattctggttgggggcggggggcactcgattcgaggttcattgtttgctcagtgaaactcaagttaaatttaatttgtttaaagtttttcttttaacaattaaataatgtacattctaataccacagtgcctggctcataataagtgctcgataaacgctagctatgcttgccattcttttaattataaataacgagcaagtctcttagaatgccaaacacaccttcaaccagagctacattttctcctgtgagaagttcaggggctgccagagctgatgcctaaggcccagccagctagacttttctggtagagatggaaatagagctgaatggaagaggaagtgaagatctggactagacggtggttaatgtagctgcacgttaggaccacgtgggggctctttcaaacaaccttgttctggctccagcccagacccattaaatctgaatctggcaagtaagaccctgcactggtatttttttctttaagtgaggcataattgatgtacaataaaatgaacaaatcttgagtgcccactcaggtttgacagtcgagatgttgaacactcccattacccggtgccccctttccatcaattcctcttcctctcccactgtcattttctgaatgctatctctatcaactggttttgtctgttcatagaattcgtataaatgggatcatacagtatgtattttcttgtatgtgtgtctgacttattttgcttaatgtttctggaattcttccctgtgttttttgcacgtatcagttcctttttattgctgagtggttttgatgagcctattctggttgaggggctgcctgatttgagcatcgttctttgctcaagtcaactctgttaaatttaattttgcctaacgttcttcttttaacaattaaataatgcacattctaataccatagttcctggctcatagtaagtgctcaataaatgctagctatgattgccattcttttttatttttttaagacagggtcttgctctgttgcccaggctggagtgtagtcacacgatcacggctcactgtagcctcaaactcccaggatcaggcaattcttctgcctcagtcttctgagtagctgggactacaggtgtgcaccaccacatctggctaatttttgtattttttgtagatacaaggtttcgtcgtgttgcccaggctggtctcaaacttctgagctcaagtgatccacccacttggccttccaaaattctggaattacaggtgtgagccaccatgccccgcagattaccattcttttaattagcagtaatgagcaagttttctagaatgccaaacacacaccttcaacacacctttgagttgcttcaggctttttggctattataaataaaatggctatgaacattcatgtacaaatctttttcttttttttttttttgagatggagtttcgctctggttgcccaggctggagtgcaatggcgagatcttggctccctgcaacctccgcctcccgggttcaagcgattctcctgcctcagcctcccgagtagctgggattacaggcatgtgccaccacgcccggctaattttgcatttttagtagagacagggtttctccatgttggtcagtctggtctcgaactcttgacctcaggtgatccacccaccttgccctcccaaagtgccgggattacaggtgtgagccactgcacccagcctcatgtacaaatctttatgttctaatgtgtttcgggtgcggcctaaacaccgtaaattaaacacagctcactgtaaatccctacattccttcttaatatgttcatcaattgatggacatttgggttatttctactttttggctattagaaataatactggtatgaacatttgtgcacatttgtgtgtgtatgttgtgggggcatatgctttcatttctcttaggagtggaatggatgggttatatggtaactctatatctaactttttgaggaacttccagattgttttccaaaatgatcgtatcattttatattctcactagctgtgtacagggtcagaatcttttaaaaatgtaggtctgttcggctgggcgtggtggctcacgactgtaatcccaacacattgggaggccgagacgggcggatcacgaagtcaggagatcgagaccatcctggctaacatggtgaaaccccgtctctactaaaaatacaaaaaattagccgggcgtggtggcacgcacctgtagtcccagctactagggaggctgaggcaggagaatggcgtgaacccggaggcggagcttgtgagccgagatcacggcactgcactccagcctgggcaattgagactccgtctcaaaaaaaaaaatgtaggtctgttcataaagtgcctactacatacggttgttctagggattatttgttagatatttttcttacaagagaattttgcctaccccaaggtcaggaagatatcttccatcttctagagtgtttatggttctgaatttcatgtttacgttatgatccatcttgaattaatttttgcctgtatagcataaggtagagattgagggtcattttttttccaatacagtattcagttgttctagcagaacctgctaacaaattttattttctacactgaattgaattggtgttttggccaaaaatcagttgaccatctatgcatgagtttatttctggactctattctattccattgatctattgtctctccttaccaagaaccgcattgttttgattactgtggctttatagtaaatactaaagtcaggaggaatacattttccaacttggctcttcttttctaaaattttctagctattctagattgtttgcatttccagataagtcttagaagcagtatgtcaatttctttaaaaatacctgctggggccgggtgcagtgagtggctcacgcctgcaatcccagcactttaggaggctgaggctggtgattgcttgggctcaggagttggagtccagcctgggcaacgtggtgaaaccccctctctacaaaaaatataaaaattagcttggtgtggtggcacacttttggtcccagctactagggaggctgaggcgggaggattgcttgagcccaggaggaggctgcagtgagcggcgattgtgtcactgcaccccagcttgggtgacagagcaagatcctgtccaaaaaaaaaaaaaaagctggaattttgatagggattgtgttgaatccatatatatatatatctccacttattctgatctttgatttatttcagcagggatttcaatatatttttcagtcttgcacatcttttgttacatttatttctatgtatttgatgttgtttatgttatttaatattgctgttgtatttctggttttccaattttctgttgccagcatgtagaaatgcaattaatttctttttgagacggaaatgcaattaatttttttttttttttgagacggagtctcgctctgtctcccaggctggagtgtagtggcgcgatctcggctcactgcaagctctgtctcccgggttcacaccattctcctgcctcagcctcccgagtagctgggactacaggcgcccgccaccaagcccggctaattttttgtattttttttttttagtaaagacggggtttcaccgtgttagccagggtggtctcgataccctgaccccgtgatctgcccacctcggcctcccaaaatgctgggattacaggcgtgagccaccacacccggcctaaatgcaattaattttttttgtgtatttgttgtgtaccctgcaaccttgttcagtttgttagttctatatttgttttgttttggtagatgacatccctcaggccctgctactctggactttcatgatggagatggtaataggaattgtattaagaaggaatgtagggatttacagtgagctgtgtttaatttacggtgtttaggccgcacccgaaacacattagaacagtctttggaggagggaggcggggtgggtggggcatcctgtatttttagagttggagattctaaaagttcagttgtgaactcttgatttcggtgccaagcggcactcaagccgaaaggccaccgacactcgcctgcggggatcagggcgggatgacctgggtaccgcggtcacgccaaggccgaggccctcacccttcccctctttgggaaagggcagacaagttccgggttcccttctaggtccgggcgagggggagagcgccccacagacgacaggcgcctcctgcctctctccttcaataaacagtccacagtgtcccggctgggctcgccgtggcctccgccttcccggcggacacacctgtttacccttcaccgccggacggccaggaggcgccacgacgaccccagccccgcccaggcttctccgggatggaccggcctcccggggcacagatgaggaccctgaccccggaggggccagacactcgctccagggcccctggcctgaccctcttcccctcgccccttcaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctggtgaggcccgcagcgccgaggggcccgccccgcccctcgccggcccctggccccgcccacccatgggctccgctcctttcctgacccgcccgcgcagcccagtgacaccacgcggggcctcgtgggctcgcgggcaaaaaaaaaagtaaataaatacaaataataactagataattaaaataacacctcttggtgcccaagcttttggggcctcctccctggggtcctatgtagaagcatttcaggggtaggaagtcaaatttattatggaaaatgaacttttattattattattattattattgttttactgtttctggtccttgattcaggaaggaaaatgcaactttctgaattccagtgcccactagtgggactcagttaggaccctccagcgtgatggagaactgggctaacagcccaagatagagaataaggagacagtaaaaaaaggaaacttagctgggggcggtggctcatgcctgtaatcccagcactttgggaggcctaggcgtgcagatcacctgagcccaggagttttagaccagcctggtcaacatagtgaaaccccatctctacaaaaaaaaaatacaaaaattagcccatgtggtggcacaagcctgtagttccagctacttaggaggctgagatgggagaattgcttgaactcgggagatggagactgctgtgagccttgatcacaccactgtactccagcctgagtgacagagtgagctcgtctgccaaaaaaaaagaaagaaaggagcaagggaaaatgagggaggagccaaggaaaggagacagggaagttcccattagtaagagtgggctggggactggagtcctagtcccagctcttgctgggacaaatctcttgatccctcagtcttcccatcagtgaaatgggagggaaagtcttgctccttccaccctaggcaggggaggtataaatgaaccaaaaccgtgtgtgtgcagctactggtctcctttcctggcctgcaactcccttaatcccatgctcccctggtccatgctcctagggacttctgcttctcttccacttctgtctttccccactcctggcttccgactcctgtccgtcagtcctcagaaccccagatcactcattctttgcccttggccctgccaaggggcttatccccggctgcgtgtcccctctgactctagtctctgtgtccagtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgtgagtcagtcctgcctggctccttgctctccgcggggtccgcttccctgggtcagcctcacgccctgcatgggcagggcccaggaaatgcttgttgactaaaaaaatgccagtgccagcaggccagggggaagcactggctttgggcccacaccctgccccagagagcgccctacgaactcctgctgctccctgcactgctggatctgagggaagtggcctcacaggatgccttgggaagactggggctttgagaaaccaaaggctggaagcatggatcttggtcttttttgtttttcttttttttgagatggagttttgctcttgttgctcaggctggagtgcaatggcgcgatctcggctgtctgcaaccttcacctcctggggtcaagcaattctcctgcctcagcctcctgagtagctgggattacagtcatgcgccaccacgcctggctaatttttttatttttagtagagacgttggtcaacgtccatgttggtcaggctggtctccaactcctgacctcaggtgatctgcctgccttggcctcccaaagtgctgggattacaggcgtgagccaccatgcctggccagggtcttggtctttctaaggcccctttctccctagcatcaaagctcaaaagggcctaggagatcatctgtctcatactctgttccctgagctgaggctggcagtagtagtgaggtggagtggcatgggttgagggactaaacctaagttcccactctagctctgtcacttcctggccaggtgactctggatgtatcacatcatccttcagagcctatttcttagattgtaaaatggaagtaaaacaaaaaatgagattcattcagtgttcgttcaacaaatagttttgactatctgggctatgtgccagtcactgttctaggcatttggactacatcaaaggaaaaactatataatccatgctcctttggcacttttactcaagtgacgaagatgatgacgataacactcatctcaagagctgtaccaagtgtgtgagatacaaacgtgagggcactttatagaccacagtaaatgatgggtttcattactcttgtactcaaacaggtgaagtgacttgcccttgggaatgggccggccctggctaaggattcttcccaccccactacccctcgggtattcattctgtgaggacccctgttataatgtccttgcaagcagctcatagcagctgcaggttctctgagggctgggagaggctgaggcgaggggggggtccccttctgtaacctctggccccctcctcccctgccttctcctcctgctcgtttattttccggagccatctccctgcctctgcctggctccactctacagggggcattccctcccctgttgctgaagaatggccacagggcaaggtgtcacttcttacccttcacacacactctgcccagtacacgattttgttctgtttttagtctttgcatttgtttgaggacagaaactaccagctgggaagtaagatggtagcaacacctaagcctgagtccgcccacacctgtcaccaagttcctctaactgtcacctggacacctgtgctttccctatgccctcacccgatgcctccctttgctctgtgtgcctgcctccccatcaacagaaagtccatggacacctgtgctttccctatgccctcacccgatgccctccctttgctctgtgtgcctgcctccccctcaacagaaagtccatggttcatctttatcttggcacttaggcgcttaggtcagctcagagcctcattgctcgcctgggttgttatacccaccactccaccctactgcgttcttttgcctccaaatcctcccttccttctgcaactacaggaacctttgtacttcaaccttacttcacgtcaccacatgtaactattccagttagtcctgtgtgttagtccattttgtgttgctataaaggaatatctcaccgggcacggtggctcatgcctgtaatcccagcactttgggagaccgagatgggcggatcacctgaggtcaggagttagagatcagcctggccaacatggcgaaaccccatctctactggaaatataaaaattagccgggtgtggtggcacacatctgtggccccagctactcaggaggctgaggcaggaggattgcttgaacccaagaggtggaggttgcagtgagccgagatcgcaccactgcactccagcctgggcgacagagcaagactccatctgaaaaaaaaaaaaaaaaaaaaaaaaggaatatctgagtctgggtaatttataaaggaaagaggtttaattggctcagggttctgcagattgtacaagcatggcaccagcatctgctcagcttctggggaggcctcaggaaacttttactcatggtagaaggggaggagagggggcaagagagagagagaccaggcacttttaaacaaccagctatcgggtgaactaattaatagtgtgaggattcactcattactgtgaggagggcaccaagccattcaagagggacccacccctgtgacccaaacacctcccagctaggatcacctccaacatgggggatcacatttcaacatgagacttggaggggacaaacatccaaactgtatcctcctgtttaaaatcgttcagtgtctctcacggcctccagcatcaagttggtactccttagcatggctttctcacccctttcctccccgataactacacccttttcccccaccctataatctttttttaataacacttttattgagatataatttacaaaccataaatgtattcttttaatatgtataatttagtgatttttaatatatttggagttgtgtaaccattaccactacctgtttttagaatattttccttaccccaaaaagaaaccctgtacccattagcagttcttccccattttctcccctcctccaagccctgagagccactcttctgctttctgtctctatggattgcctgtggtggacatttcacataagtggaatcatacaatatgtggtcttttgtgagtggcctctttcatttagcataacgttttcaaagcttatccatgttgtagcatggatcagaacttcatttttatggctgaatactatgatattgtgtagatacaccaccttttttttttttttttttttgagacaggttctcactctgttacccaggctggagtacagtggcacaatcagacctcactgtagctttgatttcctgggctgaaacgatcctcctgattcagcctcccaagtagctgggactacaggctcatgccaccatgcccagctaattttttttaattttagtagagactaggtctcactatggtgcccaggctgatctcgaactcctgagctcaagccatcctcctgcctcggcctcccaaagtgctgggattataggtgtaagccaccacgcccggcccacatttttgcttatccattctcagttgatggacatttggattgtttctactttttggctgttatgattaatgctgctatgaacattcctgtacatgtttttgtggatcctgtacatggatctatgtttttatttctcttgggtgtttacctatgagtggaactgctgggtcatgtggtaactctatatttaacattttgaggagctaccagacttttccaaatggtcacaccatttaacattcccaacagcaatgtatgaaggttctaaattctctacctcctcctcatgctgttgtctgtctttttgactttagccatcttaatgaatccctgtaatcgtactagtgagctaatacagctcttactaaggctagacaccattctaagcataatttcatgctcaacacccctgtgaggttgatatttttattatccccattttacagctgaggaaactgaggtacagagagattaagtaagtaacttgtttggtcccacatctaatacttgttagagccccaggattcaaatacaaggaatttaattctggagtctgtgctctttttttttcttttggagacggagtttcactcttactggccaggctggagtgcaatggcgcaatctcagctcatgacaacctccacctcccaggttcaagtgattctcctgcctcagcttcctgagtagctgggattacaggcatgtgccgccgtgcccggctaattttgtatttttagtagagatggggtttcaccatgttggccaggctggtctcaaactcctgacctcaggtgaccccacccgcctcggcctcccaaagtgctgggattacaggcgtcagccactgcgcctggctgagtctgtgctcttaaccatcacattatactgattctcataggccactatagtaatgtgcttagtgtgtatctctatgtgtttttgcaaaatctgtatttaatttatataaatggtattgtgttatagatctcatttcacctcttactatttttttttttgagacagagtctcgctgtagtgtgcagtggtgcaatctcagctcactgcaacctcccaagttcaagcgattcttctgcctcagcctcccgactagctgagataataggtgcccaccaccacgcctggcgaatttttgtatttttggtagagacggggtttcaccatgttggccaggctggtctcaaacttctgacttcaactgatccacctgtctcagcctcccaaagtgttgggattacaggcgtgagccactgtgccccaccacttttttttttcgaagctctatgttttaaaacccatccgtgtttctccaccgctgatggaacttgtgcctgctttccatgggggcagcacccaccattatacttgtcccctctctgtgtgcgaagggctcaccagccttcaggactggccacctctgtagcctctccttcagtccttccctgcatctagcctgggctctagaagtgctgacttcccagtacatcctagaatgtgcaccagtatgtcacgcctctgtgcctttgttcttcaaggccagtggaatatcccggatcacctagttccaatctcctcattttacagaatcatcctacattttacagaggaggagaataagcttagaaacaatgacctgcttgagaccgtacaaccagaaccccaccctttatctctggccagcctcttctccctcttctctttagtcctcctctgctgctcactggccgaagtcccctttccgtctttgcctggctcccgtcgctagctccaagatggcagggtagcagaacacagatcctctctgtgccgtgtggcacatgtgctgtgctacaacccacacagcctccctgttctggaacctgtgatttgctgtgaaattgcagtcctactgcagctgtgttgcctctgtgattgctttctctctgtccccacacctgtcacagatgagttttggacctaccattctgagacatactgatgcaagaggctcccaggaaacacttggtactgatcttcctcccctcagctccgtgctcaccactggtcacactttctcctttaaccctgctcccctcctccccttcattcattcattcattcattcattcattcattcctcactcaacaactatttattaatcatctcctctatctcctagatgacaggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggtgaacccagatggcctggtgagaggagcctggactagaaggtagatgtgtgaccttgggccagctgtttgagctctctgagccttagcttcctcctctgtgatatgaggatgagactctcacaggctgttggttggagtgactgagggagtgtgagtaaagctctcagcattgtgccagcacatagtaggtgatcaggaaacaaatggctctgaaaggcacaagtcctgtaggagtttaagagagtggacatttctctctgcctcatctccctattccctgcaccacctacactttcctctctgaccctactctctctttcctgataaggaattactctcacttccaccacccgatgtatggaaactgctatactttcaatgacaagaacaactccaacctctggatgtcttccatgcctggaatcaacaacggtgagaagctccctgcttgctccatggcgccctctgcttcagccactcacctgtacttaccttgagctcacctcctagagctgctgggaggggtcctgcctgctgtctctccccaataggtgccacatagtccgttccaggcatgagaggaatcccgtcccaggtcttcctcctgcctccagattccagctcaggggttgccaggtccctttgcgggtcttcctgaacttgcttctcttgcagctttagagactgggcaaggaagggagagtggatttccatctcctaactcttttctaggattcccgcctctgccaactctgctctctctgcacccctaggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggcaaggatgctgactgggaggcctggaaggagcgcctcagattgcagaggggcagcggggaggcatgggaggctggagagggagagcatgtggggtgggccttgagcatgtggaggtcttcaggagcaggaatgaggggcagaggggctggcactgggaagtaaagccctgcagggtggaccctgggggacaagtgctgagaaggcattcaaggcatgcttagggtttctggggatgctctgggcctagtggccttgaaatgagcagtgggtgggcatgggggtggctggaagcatgtattgagagggcgaggccagtaggaggggctggcaggtgtgagatacaacctggaactgagggaaggcagagaacccagaggcacttgctctgtcctctgatctcttggtgtatgtgggttcataggaaaccctggacagacttgggggcgattatggcgactgcaccaagaatggcagtgatgttcctgttgagaacctttacccttcaaagtacacacagcaggtgaggcccaacctgattccgtggcagccactcccagccactgccctggctggccctgcaaagctggaggggttgtgtatgtgagagagagagagggaaactggggggtggtggaaagaggatggaggctctgtgcagagaactgctgagttcaggcctgaaccccctctcctctccaccctcctcccttccaggtgtgtattcactcctgcttccaggagagcatgatcaaggagtgtggctgtgcctacatcttctatccgcggccccagaacgtggagtactgtgactacagaaagcacagttcctggggtgagactccagggagcccccaccctgccccactgaccccagtactcactgaggcactttttcctctcagtcccctgtttgtggggatgacttctggctcccacctgctgggatgaatccttccttgctcttgtttttcagcctttagtctctgcctctgtcagtttccctctccctcagtctctctctctttttttctatttttttgaaatggagtctcgctctgtcacccaggctggagagcagtggcgcgatctcggctcactgcaagctccacctcccgggttcccaccattctcctgcctcagcctcctgaatagctgggactacaggcacccgccaccacgcccagctaattttttggtatttttagtagagacggggtttcaccctgttagccaggatggtctcaatctcctgacctcatgatccacccgcctcggcctccctctctcttctatctctgttcctccctctcagtgttgcagtctctctgttttggcctttgtgtgtttgtcaaggaattgtcccatttaaaaacaacctgcaggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaataaaaataaaaataaaaacaacctgcagcagaaggaaggaagagcacgtgagaaaacctccagcggttcctcaatggctcctaaggtttcagtgcatgctctgcccacagcttccctgctcagtgcccagggcgcttagctgggcaggctctggaggggctgggtggggtacacaacacttccctggggagcaggaagaaaatattagaagatacatgggtctgtctcattccttcacattttccatcttatgtgctttagaatggacatactgtatccattcaatagtagaggtatataatttataaatcaaatacatgtattggacctgtttaagattttttttttaactgaacaagggcacaatcagtaaagtttggagcaccttggaatctcctccttatcctggtataggactagacaaatctctttccttttgactacagttgagttgtttggcagggaagtcgtgtgccaggaagctgagagagaaagaaaatcacaaaaagaaaatatgtaagctgcaagggtttgcattcctggagttcatgctcttccctggcacagctggcctgttccccctgcagttcctcctcccagggctctcccctgggcccagctgtcccacagggtgggcggagggccatcacgggaggggacatggtagtgggcactggagacacagaggccctcaaaggcagcggattgtctcaccccagagttcagcgtccatccctaccttgttcctgtctgtggtgacttttccacttctgtccttccctgggctggctccgcagttctcttctgcctggactttccagtcgtggcctcctggttcctgtctctctgaccttagaggattgtagcacatcagaactgggggaaacccaaaggccatctggcctcatctcctgtctcagatgagcaaattaaggtccagggggaggatgtgacacgtcccagggtatacagaactgggatggaggagatgccacctgtgatttctccctcccctcaaataattatttctactttgtgggtttgcacatctgtgagtgaaaaataacaatattgattgctgagaagttgtgaggatgagagaggaagtaaggctaaaagcacagtctgttgcatttcctagggcttacttccccggagaagagggccagctgcttccccttcttcctaaagatctccagccctggtagggatttgggtcagaaatgaagaaggacttcagactgaggaactaaaagtagcaataatgacaaaataaccttacttagaatttgggaaataggggaggaggtgaatctacagttccattattattattattattttggtaatagctttattgagataatttatatcccatacatttcactcatttaaagcatacagcttcattttagtcaaattttagttttaattttacgttttaagtatagtcccagagttgtgcaatcatcatataatcagttttggaatatttttagtgttcccaaaagaaaccctgtactcactcaagccaggcacagtggttcatgcctgtaatcgcagcactttgagaggccaaggtgggcagatcacttgagcccaggatttcgacaccagcctgggcaacgtggcgaaaccctgtctttacaaaaattagctgggcatggtggtgcacacctgcagacccagccacttgggaggctgagctgggagaatcacctgagcccaggaggtcaaggctgcagtgagccatgatcaggccactgcactccagcctgggcaatggagtgagaccctgtctcagataaataaataaataaaccttgtactcattagcaagtcccaagcttccctcccctcctccaccactgccagcccttgggcaaccacgattctttctttctctctctatggatttgcctattctgaatctttttttttttttttcttctggagacagaatctccctctgtcgcccagactggagtgcagtggcgcgatcttggctcactgctacctctgcctctcaggttcaagcaattctcctgtctcagcttcccgagtacctgggactacatacaggcgcatgctgccaagcccagctaatttttgtattttttagtagagatggggtttcaccatattggtcaggctggtctcaaactcctgacctcaggtgatccgcccacctcagcccccaagtgctgggattacaggcatgagccactgcgcccggctattctgaatctttcatatagatggaatcttagagtgtgtgaccctcgtgtctgccttatttcacttagcataatattttcaaggttcatccgtatggtagcaatagcagtgcctcattcctttatatggctgaataacaacactcccttgtatggatagaccacactttgtttacccatttatcagttagtggacatttgtgttgttgccactttttggttattgtgaataatgctgctgtgagcatttgtgtacaagtttttgtgtggacgcatgttttccattttcttgggtatatacctaggaatggaattgctaggtcatatggtaatctatgtttaaccttttttgaggagctgccaggctgttttccgaagtgacatcaccattgtacatccctagcagcagtataagaggttttcagtttctccacatcctgccagttcttgttattgtctttttaaatttttatttatttatttatttatttatttattatttattttgagaagactctcactctgttgcccaggctggagtgcagtggcacgatcttggcaaactacaacctccacctcctaggttcaagcaattatcctgcctcagcctcccaagtagctgggattacaggtgtgcaccaccacacccgactaatttttgtattttcagtagagactggatttcaccatgttggccaggctggtctcgaattcctgacctcaggtaatccacctgcctcagcctcccaaagtgttggtattacaggcgtgagccaccgcacccagcctattgtctttttttaaataacacacatcttaatgggtgtgaagtggtatcttattgtggcttaattcccttattcttatacaattattgttcccatttttcttttctttttttttttttttgagacggagtctcgctcagtcgcccaggctagagtgtgcaatggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcttgacctcgtgatccacccgcctcggcctcccaaagtgctgggattacaggcgtgagccaccacgcccggcctgttcccatttttctttatggcgtttatgtttttgtccatagcatatatttccttacactggtgtatcctgttttgtttttcgcctgacttagcttattttctttctttattaatttattttttaggccaggtgcggtcgctcacacctgtaatcccagcactttgggaggccgaggcgggcagatcacgaggtcaggagatcgagaccatcttggctaacacagagaaaccccatctctactaaaaatacgaaaaattagccgggcgtggtggcgggcgcctgtagtcccagctactccggaggctgatgcaggagaatggtatgaacccgggaggcggagcttgcagtgagccaagattgcgccactgcactctagcgtgggcaacagagcgaaactccgtctaaaaaaaaaattaatttattaaaaatttttttttttagagacaaggtctcactctgttgccagagttggagtacaaaggcacactcatagctcacttgcaaccttgaactcctggcctcaaacgaccctcccacctcggcctcccaaagtgctgagccactgtccctggcttagcttaatttcttaaacgcttcttggtactgccactcataaggcatcattataatgctaaataatgctcttgtaaagtgggtacccagggatcttgggagacctcttgggtgtggggtagagaaagctgaggtgccctaggagaacaggcatctctctgtacccacagggtactgctactataagctccaggttgacttctcctcagaccacctgggctgtttcaccaagtgccggaagccatgcaggttagtgtccccttccccgggtacaggttgggtagaatacaggttaccgagccaagcatttgggagagctctgccccaacactgagcacctttctccatccccagcgtgaccagctaccagctctctgctggttactcacgatggccctcggtgacatcccaggtagagtgtggggaagggatgggtgggggatgtgtgtgcccatgtaatgctgtggccttctctgggtattatgtgtatgagtgtgtttgacacaaccctatccctgtaagcctgaagcatatgggagtgaccttgatgacacccccattctttcctaggaatgggtcttccagatgctatcgcgacagaacaattacaccgtcaacaacaagaggtcagtcctgccctggtcccagccacaagaagggaatctttgggagggaaaatagacctaagaagagggatcgatatggttgattagaggaaggtccaggaaattcatcctctaccatttcttcccaccctctgccccacacctaagaaatggagtggccaaagtcaacatcttcttcaaggagctgaactacaaaaccaattctgagtctccctctgtcacggtaggtcgtgcctggatggagcctgtgatgctctgggggtcttacttagcagggcggctgtcggggaaaaccaaaaggttgtctctgtgggccagaaggctctgagtctcaaaggcaggggaccaaagaagagggtcaagggagaggttgggagggttggaagaaggagctcggccggggcataaggtctctgggggtggtgggagggacaggcatgctagatgctggggtgaaggcgcttgacccatgcccccatttcagctgcccctaactgtgggccagttatcagttttctctgggtgacactggccaggagcagagacaaagagcccagggggctgctgagaggctgagaggactcgggggtcttcagggatgaagggagacagcttggtgaggagggaagggggctcctctgccagagtccatccagaaccctctgtcccatcgtcaatgtacctctcctctcacagatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatg

SEQ ID NO: 36418 - DNA, 20544 bp, Homo sapiens
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagagtggggtgattcacgtcttgaggtctcggccggtgtgagagcccagcctgttcccctttctgcgcccatccccggctcggccgccaccccgcccgcccgccccattccgttcccctgagctggccgggccggagcctcattttgttttctacttttttctctcctatgtgcatccccccaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacaggacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggtatgtcttagtttttggtttccaaatttgtaagtttactggattattttaatgatggaataaaaattgggtcttgagagcaggctgaaatgtcactgagtgtgtgttttactctctcataataggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaattgtttggtgtaagcatttttactagttctttatttcttacacatctttcttgctgttgaagacaaaaatgacccgcaaacatcattggatgaacagaattgctcaaaatagtttttaacccaatttaaagtttttatggtcatgtgttatgttagtattaacaaagtctggatagaagccagtttaccagttggctatcaaggttttatacatagcaacatgtaaaacatgacttttttttttttttgagacacagtctcattctgttgctcaggctggagcgcagtagtacgatctcagctcactgcaacgtctgcctcccgggttcaagcaattctcatgcctcagcctcctgaatagctgggactataggcatgtgccaccgtacccagctgatttttgtatttttagtaaagacggggctttgccatgttggccacgctggtcttgaactcctgacctcaagtgatccacccacctcagcctaccgaagtgctgggatgacaagggtcagccacagcacccggcaaaacggctttttatgttgatgacactatacactgcatctgatggatttttttttttttttttttgagacagtctcgctttgtcacccagcctgggcagtgtggagtgcagtggcacgatctcggctcactgcaagctcctcctcctgggttcacaccattctcctgcctcagcctcctgaatagctgggactacaggcgcccgccaccatgcccggctaattttttgtattttttagtagagacggggtttcactgtgttagccaggatggtctcgatctcttgacctcataatccgcctgcctcggcctcccaaagtgctgggattacaggcatgagccactgcgcctggcctgacggaattttcaagagctgaaaaccaagttagaaactgaggcccacaatgaataaacccatcattacacaagtaaaatgtggagatgggattatgaaacattgaaaatcaagaaaaaacatcttgtccctaaaaacctcatgccacataagatttttttttttaacagagccaaggtctcattcaatgaataaactcatcattacacaagtaaaatgtggaggtgggattatgaaacactgaaaatcaagaaagaacatcttgtcccccaaaacctcatgccacacaagactttttttttttttttttttttgaggaagagtcttgctctgtcacccaggctggagtgcggtggcacgatcttggctcactgcaagctccgcctcccgggttcacgccattcccctgcctcagcctcccgagtagctgggactacaggcacccgccaccacgcctggctaatttttttttttttttttttttttttagaggagacggggtttcaccgtgttagccaggatggtcttgatctcctgacctcgtgatccgcctgcctcggcctcccaaagtgctgggattacaggcgtgagccaccgtgcccagccaagactttttttttttttaatagagccaaggtcttactctttcgcccaggctgcagtgcagtggtgtgatcacagctcactgcagccttatcctcccgggttcaagcaattttcccacctcagcctcccaaaagtaactgggactacagctgcatgccaccatgcccagctaattttttttatttttagtagagacagggtcttgctaagttgcccaggctggtctcaggtcctcctgccttggcctcccaaagtgttgggattacaggtgtgagccatggcacctgaccaagataattttgaaggtaaagcggatcactgaaattagggtctcctatgtgtactgaaaaagtacacatttttttacaggaaatttgcaaacagaaaagctccagttggacacaagcataaatcagataaattaacatctcatttggagggtgaatttgtagtcctgtgttaatacaacggatttttagagcagagaaacaatagcccttaaaactgccagggggtaaagaagtaaacaagtgctttcttaaggactgaaatgaaaaagaaaaagaccatttccccctagatatgtgaactcctttcattattcatgacattggcccaaattcctaaaccgactaatttccacaataatgaaaacagtagttgataagaaccactgtagactaatgtccaagataaatgttttccaaaagaagtcagatacctgaaaacaatgctctgtatctctctgagttctccagcaaatcagtactgagctcctcagtcaaaggtaatgttgtcctgcaagcctttgtatcagtgtctgttatggcttcctagattagaaggcagccacatataaaaatgtagccctgtattatatttaatacaggagggctttgggatttattggtggctcagagagcatgccatgaaaatgggcttacagagtcaatgatcaaccaggggccctattaggcaggcaagtaactacataagagaaactctggcaaaaatgaaagggtaactaaacacaaagagccttgtggagaagtaagatattttgcaaattgtgttttggaaagtgagcctcttagaggaaaacaactacatgctgactgtggttaaatataggaataaattaaattaaccaccaagttacaatataactctttgtttcctcatctttcttagaacttagccttaaaggcccagtgttgtgaagatgaaggcttttatgaagttttgtatccactttaaagaagccccttaagtgtaaattttatttattttaatttttatttgtttttagttgttttcttttttttttttttcttgagacaggttctcactccattgcccaggctggagtgcagtggtgcaatcacaatttactgcaacctcgaccttctgggctccagcaatcctcccacctcagcatcccaagtagctagaccacaggaacgcaccaccacgcccagcttttcttttttttttttttaattttttgtagagatgaggtcttgctacatcacccaggctggtctccaactcctggcctcaaatgatcctcccccctcagcctcccaaagagctgggattacaggcatgagcctgcgcccagccagctgtaaaatttagaagctgaaacgccaactgggagcagtggctcacgcctgtaatcccaacactttgggaggccaaggcgggcagatcacgaggtcaggagttcgagaccagcatggccaatatagtgaaaccctgtctctactaaaaatacaaaaaattagcccggggtggtggcaggcccctgtaatcccagctactcaggaggctgaggcaggagaatcacttgaacccaggaggtggaggttgcagttagcagagattgcaccattgcactccagcctgggcaacagtgtgagactctgtctcaaaaaaaaaaaaaaaaagaagaagctgaaacaccacagcattagcccactactagctcaactcaattacaaagagacctctttaaaaactgaactataaagcaaatctataaagtttgaagtcaccaggcaagtaagaaaacatgttacggggaaattatctgaaaagaaacaacaaacaatgataaacatggaaaaccagagtccaagatcatcaaccgcttagattccacacagtagtctttctagggaaagaaagtagagtcttttttacagaaatgctgaagaagcaattcagaagaaacctaatgatttattaatgccttcgacccactctaccccttcctgtgagtctcctttccactggggacccagcagggcctagaatggatgatgctcatcacggttcactgaagcaggtggctgctcaccagcaactgatggaactgccaggccctgggaaaccagccaccttctcctgctaggagtgaagcaacttcctcactgactgtgacagccatggccttcctctgagtctgcaggtgaccatgtctgctcctagaattctatttccttgactggtgccatgtttgtttgtttgtttgtttgttttgagacagagtttcgcttttgttgctcaggctggagtgcagtggcgcgatctcggctcacgtgaacccgggaggtggaggttgcagtgagccgcgatcacgccactgcattccagcctgagcgacagggcaagattacgtctcaaaaaaaaaaaaaaaaaagaaaaagaaaaaaactagtgataagagctaacatttattaagcactaatcaggaaccaggctttcagtttagcactttgtatacattattatctcatctaattctcacaacgactgtatgagattggtacaattataagtttctttttacaatgagaaactaaacctaagagaagttaagttgcccaaggccacacaactagacctgggaatcaagctccaaaccaatttctcaaacccctggggcttcctgccatagtctcacaggacctcacagtttctataagaatgattgaatatggtgtttctgtgtgattctactgcaaagaataatcagtataagcattttctggataatcaaaagcagtgattctcagtatgggctacacattagaatggcctagaaagcactgtaaaaatactaatgccccatcctgagagagatttcttttttttttttttttgagatggagtctcactctgtcccccaggctggagtgtagtggcgtgatcttggctcactgcaagctccgcctcccgggttcacgccattctcctgcctcagcctcccgagtagctgggactacaggcgcccaccaccacacctggctaattttttgtatttttagtagagacgaggtttcaccgtgttagccaggatggtcttgatctcctgacctcgtgatccgcccgtctcggcctcccaaagtgctgagattacaggcatgagccaccgcgcccggcccaagagatttctaatttacttctgtttttatgcatataccaaagtgatgccaggggcccagtgcagcagctcacgcctgtcatcccagcactttgggaggccgagacagatagatcacttgaggttgggagttcaagaccagcctggccaacatggtgaaatcctgcctctacaaaaaatacaaaaattagccaggcgtggtggcatgcacctgtaaacccagctacttgggaggctgagacatgagaatcgcttgaacctgggaggtggaatttgcagtgagccgagatcacaccacgcactcccagcctgggcaacagagtgagactctgtctccaaaaaaaaaaaaaaaaaaaagtgatgtcagggttgagacccactgatatctggataagcagcttgcagcttataactgaatcttagtcacaattgttagtacaaccatttcagtttgtgtttatgctgttcaccttggctcttgccaagcaaaaccaagtgaagtcatatcacagtgcctaaagacgaaccttctcaaaagtttttggaaaacaaggcagaattgtcatctcactccatacagtgctgaaatcaaagaatatccacccaagcagtcagtaccatgttcctttgcaagcagcaacttcattacagaaaaacatcttccatcgcattaaatcagcattgttcatgtgaatgttattagtttggtaattttgtttgtattatatttataaatggatactggttttacagttatagaggagcagtaaacacaaaatattcacatctagtgtataattatagtaataaaaataatttcaaacaccactgagggtctgtgagaattttttttttttctatttttttgagacagagtcttgctctgtcgcccaggctggagtgcagtggtgcgatctccgctcactgcaacctccaactccctggttcaagcgattcccctgcctcagcctcccgagtagctgggattacaggcatacgccaccacgcctggctaatttttttgtatttttagtagagatggggtttcaccatgttggccagactagtctcaaactcctgacctcaggcaatctgcccgcctcagcctcccaaagtgctgggattacaggcgtgagccaccgtgcccggccggataattctttttcttttaaaaggagtctgtgttactcaagtttgaaaaatcctgctatgaccagtatacaatactgcctgcttttgttaggttaaaaaaaaagtgccaaaggcattagagataagacttgatcagattcaagtttgagttttgggcaagaatatttcataggtgatgtttttcccctcaagaagcaaataatgcctggtcttctctgtgctgctagccgttgttaatagcaatactcaggtctgctgattcattaggacttgcaaaatggtgacattctatcattccttctttatttatcacctagaatacttctataaagagaacttccacccaggtgctgtggctcacacctgtaatcctagcactttgggaggccgaggtgggagggtcatttgagcccaggagttcaagaccggcctgagcaacataatgagaccccgtctctataaaaaataattattattattaaaataagataactttcccccatcttacattttgttaccttgaggtacacagttcacccagaagaggcagaataaatgcttaattactcccttttatttactagttttcaaaagaatgaatttagtgccccccagcatcttccaattaggcttttttcctttcaagtagcattattatgttttaaaataatatacagatggggtttcaccaagttgcctatgctggtcttggactcctgagctcaagcaattctctcgcctcagcctcccaaagtgctgggattccaggcatgagccaccgcgcccagcctgaagtatcattattaactcaaggactcttagcatttcctgtgtcttaattacttgccatttttttcttattgaagctcagatttccctaattgtccagtgaaagcttcttcaagttggctccagaattgagtcctttggactcgaccccagaagcctttgttaacttcttcccttttaagttgtcccaggctcatctagtacatttcctcccccagacctgacatcaatggctaggtaattctgagcttcagcggttcccaggggaaacaacatttattgggagcaggtggtgttcacagttctctgttttgataataacacaggcacagcagggagatccttttaaaagtggggcttgagagtggcggcattcactccaggctttcctgaggaagtgttccaccagctgtgggccaacactgtcttcttccacctcagtgtttgtttatactgctttcttttatccagtgaatcaataacaacagcaacaataaaaatggcttcaaaacagctacatccacaacaacaaatctgtttgcagagacgtggtccagaggcagtttgggtctggtgaacacttgacttggagtcagaggaaattgaattagattctggcttttcttcatttatgagaataaaaacaaacttcatcttttttttaatttattttttattttttgagacggagtctcactctgtcgcccaggctggagtgcagtggcgcgatctcggctcactgcaagctccacctcccgggttcacgccattctcctgcctcagcctcccaagtagctgggactacatgcgcccgccaccacacccggctaatgttttgtagttttagtagggatggggtttcactgtgttagccaggatggtctcgatctcctgacctcgtgatgtgcccgcctcagcctcccaaagtgctgggatttttttttttttttttttttttgagacagagtctcactctgtcacccaggatggagtgcaatggcgtgatctcggctcactgtaacctctgcctcctgggttcaagcgattctcctgtctcagcctcctgagtagctgggattacagacatgtgccaccatgcctaactactttttttgtatttttagtaaagacagggtttcgccatgttggccagactggtctcaaactcctgacctcaggtgatccacccacctcggcctcccaaagtgctgggattacaggcgtgagccactgtgcctggcagatatacattattaatatattctatgtgacatatttatagtaacactacactgagcatctactatgtgccagacattgtggttttatttcatgaatgcccataacaatattgtagggtattccagtggtatgctagtaagtcagctggaggtggggtatccttgatttgtagaactggctgatttccatggtgtgaatacatccgctaagggtgtaccaaaggttttagcaactggctgacaaaattcctgaatatttaacaataggttctcccaagccagaaggagcaggttgcagcacaccactggatcaggcccatcttattttattgcattttattttattgagacagggtcttgttctctcacccaggctgcaatgcagtggtgtgatcgcagctcactgcagcctcaacctcccaggctcaattaatcttctcaccttagtctcctgagtagctgaaaccacaagtgcatgccaccaaactcctggctaatttttgtatttttttggcagagacgggtcttgccatgttgcccaggctggtcttaaactcctgggctcaagtgatccactggcctcggcctcccaaagtgctgggattaagggcgtgagccaccatgcccagcacaaatcaatttattttatgtcatacaaccaggaggcaacaggattgagatctgaactgggtagccgggttgcacatatacctcacgaactacaactcatggtctagtctcactaaccattcatggtagtgtttcctcattaaacactggtggtgctttagggctaagactgtttctttgaaacctggaaaaggtcttgcctgtgcttagattcggtgtcgaggaacagggagaatgcagtcttcctgtccactgttccctgtctcaacacgtctctgccagctctgcaagaaaattcgacacttccacaaaagaccagtgaaggaagccaacatgtttcaccccaaaacatacttctttgacgtatttcaagatggctattcagaagggctggaaatacgagaatagctgcaaagctgccttttgtggagctttgtatgtgtagagaaaatccgcattgatgcagccctgctttctcggaggccctcccttgtccggatctaggaaagattgactgagagtctgacgcctttggaggcctttggaggcctgaaaaagggctaccacttgtgaggtttgatctacataacaagacccactttgctagccaggcctcctcttctccccctaaacaggttagaagaggacttctcctccaacctgttttgccaggatccaagccccattcttttatttttatttattaattttattttgagacggagtctagctctgtcgccaggctggagtgcagtggcgtgatctcggctcactgcagcctccacctcccaggttcaagcgattctcctgcctcagtctcccgagtagctgggattacaggtgcccgccaccacacccagctaccaagccccattctttctgtaacctcaagatggtatataaacctctgtaccccctggaggatgggttgcagtaatcactctgtgatttccctccgtgaacattgataaatttgtatgccatttcttctactaatctgccttttgtcagttgatattccagtgaaccgtcagaaggcgaagggaaagatttcccttggcctccacagcagatttgaggcaaggcaagtgtttgagacggagtttcgctcttgttgcccaggctggagtgcaatggcgcaatctcggctcatggcaacctccgcctcccgggttcaagccattctcctgcctcagcctccggagtagctgggattacaggcatgcaccacctcgcccggctaattttgtatttttagtagagatggggtttctccatgttggtcaggctggtctcgaactcctggcctcaagtgacccaacctgccttggcctcccaaaatgctgggattacaggcatgagccaccatgcctggccaaattacgtttgagttctgttgctagaaacaaaaatgtgctctcctgaattttccacacaggcctccaaggagttaaaagacaaaaatcattttccagtttctctggcttcaagcctgattcccagacgggatccaacactaatcgccatccaaatgcctgtcagcaagatagtcatgatgtactctggcatatagtactgaggcagtcttgggcaatgttgttatagaattatgttataattatactcggccttgtttcctgcacatctcacagatgcttatccaccaacggagtgttagctgacaatcattccaaacaagcccagacaaaaggaataatagcggtaacctgaggaacttcggaagaaatacacagctaaggtctgagaatgtttggccagttcaatagcctcttacgggcaagtccaatgtcaggcggcatttctaccttctcctgttctgcctttgacctcttcacgctctcttgtcctgtccagaacactgtcacttaaactcctctgttttttttttctttttttttgagacagggtcttgttctgtcgcccaggctagagtgcagtggcacaatcacaggttactgcagccttgagctcccaggctcaagtgatcctcccacctcagcctctggagtagctgggattacaggcacatgctaccacacctgactaatttttgtaaagatgaagtctaagtctcaccatgttggccaggatggtctcaaactcctggcctcaagtgatccacctgcctcagcctcccaaggtgctgggattacaggcatgagccactgtgcctggccaaaaacatgtaacactgggggaaattctttcaatcctccattcgccctgacccccccactccaataccaccccactttccaaaagggctcaaaggcttaaggagctgaatgtcggggtactgtttgttagaactgcgaaggaggggcctgtctatccaccgtcctcttggtcctcccctgagatgggagaaaaaggcttgtgttatgctcaggggcaccatggtctccgccagaccggatggaattctggggaaacgttcccacagaaatccagggaagtggagaggagaaagctcctgagggaagaatctaggtggtgctgcgtgtgtgtggtttacatgccagtctgtattttaagaggtttccaagccgattttaattaacctccagttgaaacttgctaaacaagttttgcagcccaggttattgtgttagtatttttccgggtatattgtcctaggtttgaatttcatgatgtttattattctttctaactacaactcagtggggaaaagcccaaggtaccttttaagacctaagtatttcctggtaatgacttgtaggaaagaatgacatttccataacatttggaccaagagaagaagtgagaatttaaagttgacatttgcaagtgataaaagccaaaaccaaaagtattcttttaaagaatatgcctttcttctaatgaaatatacacaagtcttgattcagatgataacttttctagaattacctttgaaaacaaacccttaggtttcttatgctccaacccctaggggacagattcagaacagcttgtttctttcaagtctactcaatcaaggcctgccttctagagacttttcttttttttttttttttttgagatggcatttcgctcttgttgcccaggctggagtgcagtggcgcaatctcagcgcaccgcaacctccgcctcctgggttcaagcgattctcctgcctcagcctcccaagtagctgggattacaggcatgcgccaccacacctggctaattttctatttttagtaaagacggggtttctccatgttggccaggctggtctcgaactcccgacctgaggtgatccacgcccccacccctcggcctcccaaagtgctgggattacaggcatgagccaccgcgcccagtctctaaagactatttttaatgggcaccatatgatctctctggaactgagaagagcggactttggggaaattagaaaagatgtagaaggatgctgctccaagggccttcagaataatcacttgacatcatctctgataagttactctctaggtcatttatataagcctctgccccaagcatataggagagagacatctagtttagggccatcaaactgggaaacatttgttgcttgaggtatacaagaggattccaaggtactgagttttaaggaacttgggttccaaacctcaacttctatatatactctttccagaaatggtctacctgaaaatgctcctgaggttaagaggtcacacttgggctgggcgcagtggcttatacctgtaatcccagcacttggggaggccaaggcgggaggatcccttgaacccaggagtttgagaccagcctgggcaatagagtgagagcttgtctctaaaaaagaaaaaaaattaaaataataataataggaggtcacacttggctcctcttgcctctctcctctttcataaatgcccttcctggcaagatggggtggttcacagctgcactctttttatttatttatttttgagacagagtcccgctctgttgcccagcctggagtgcagtggtgcaatctcgactcactacaaccttcacttcccaggttcaagtgattctcctacctcagcctcctgagtagctgggattacaggtgcttgccaccaccacctgctgatttttgtatttttggtagagatgaggtttcaccatgttggccaggctggtctcgaactcctgacctcaggtgatccacctgccttggcctcccaaactgctgggattataggggtgagccaccgtgcctggcctcggctgtactcttaacactttgggaggaggaggtgggtggattgcttgagcccaggagtttgagaccagcctgggcaacacagtgaaacccctgtccctaaaataaataaatgaatgcccttctcccaccttactaaagaaaggtgtacccctaacctaccctgaatcttagcagagggtgctacccccaaggtgtaaaaacctctgggcaccaaaccaaagaataattcaggaatgtacagctctcaagggaagagttcccagagagttgagaccccttctcagattacttaggtaggagcatgtactggggttttatttcaagtttcacaaagaaagaagctcctcagcaagtcagtttgaagactgctttcttggtagagataaaagtgatacaatgaactatgggttacagagtctcagcagccaggcagctggggggaaaccataactttccagaaaaagattactcaaacattacatcaggattgctgattacgtcccggaacagactgtaaactacctcagccctaaaagttctcttccagattaagtttgggacaatttgctttctcaagacctgaaaaaagagagctttggttaaaaaaaaaaaaaagaagaaagaaaaagaaaagaaaaaaaaatggcagctgtttaatccagatgacaaattgcttttttttttttttttgagacagggtctcactctgtcactcaggctggagtgcagtggcgagatcatggctcactgcagcctcaaccttccaggctcaagtgatcctccactttagtctcccgagtagctggcactacaggtgcacgccgccatgcctggctaatatttttattctaattttttttttttttgtagagacggggtttcgccatcttgctcatggctggtcttgaacccctggcctcaagctatctgcccacctaggctcccaaagtgctaagattacaggcatgacccaccatgtctggtctgcacaatcgtttacaagttagtctgatttggctgattggtttgatagtaaggaatggctttgtcattaagttatagaacaggcactttccattaaccgaacaagctaaatgagctgtgccaagattctgaagcaataaaaatagatttaaattaccagggcgtggtgggggggggggcacctgtaatcccagctactcaggaagctgaggcagcagaatcgcttgaacccaggaggcagaggttgcagtgagccgagatcatgccactgcactccagcctgggcgacagagcaagactgtctcaaaaaaagaaaaaaatagatgtaagccatgtgcataatgtatagtacaccagaaatcacattctttgcaccttttttttttttttttgagacggagtttcactctgtcacccaggctggagtgcagtggtgtgatctcggctcactgcaacctccgcctcctgggttcaagcgattctcccgcctcagcctcccaaatagctgggattacaggtgcctgccaccacacccagctaattttttgtatttttagtagagacgggggtttcaccatgttggccaggctggtctcgaactccagacctcaggtgatcctcccgcctccgcctcccaaagcgctgggattacaggtgtgaaccaccgtgcccgacccctcagctctcagctcaatgtcgcttcctgcaatgtgtccattctacacagggaaatggcggaaggcagcaggtaaaaaaaatcacagcctttcctcatactgcttggcctttttttgttttttaaattctgaagaaagccatctccaagcacttccacctacatttcattggctgcaatgtgtcacctggcaacccttagctgtaagggagtctgggaattctagtattttgctttccagtttctctagtagaaaagtgtgtttctctagtaaaaagtgtttctcatgtgtgtaaagtgagcaaagtgataaagcatatattctaaaaagtaatttggggctgggtgcagcggctcttccctgtaatcctagcactttgggaggtcaaggtgagagggctgcttgaggccaggaatttgagactagtctgggcaacatagtaagactctgtctctacaaaaaattaagaaaatagctgggcatggtggcacatgcctgtagtcctagctacttgggaggctgaggcaggaagattccttgcacccaggagtttgaggctactattgttgccccactgcactccaacctgggtgacagagcaagaccctgtctttaaaaaaactaaataaataaatgaaaataaaaataaaaagtaggccaggtgcagcagcgcatgcctgtaatcccagcactttgggtggccaaggtgggaggatcgcttgagcccaggagttcgagaccagctttggcaacatggcaagaccccgtctcaatttaaaattttaaaaaccaataaaactaaaaagtaatttggaagactgtgaggtaaaccaaataatcaactaacaaagtagttacttaaaaaaacaaaacaagctgggcgtggtggctcatgcctctaatcccagcactttgggaggctgaggcaggcggatcacgaggtcaagagttcgagaccagcctggccaatatggtgaagcctcgtctctactaaaaatacaaaaattagctgggcatggtggcgcacacgtgtagtcccagctactcgggaggctgaggcagaagaatcgcttgaacccgagaggtggaggttgcagtgagccgagatcgtgccactgtgctccagcctgggcgacagagcgagacaccatctcaaaaataaaaataaaaataaataaaattaaaaaacaaaacaaggctaggctcagtggctcacgccagtaatcccagcactttgggtggtcaaagcaggaggattgcttgaggccaggagttcaagaccagcctgcacaacacagtgggaccctgtctctacaaaaataaataaataaataaatataaatataaatataaataaaaacaagccctccaaaaacctttgacagtgtgtaaagctatgcaattttctaatcgtgttaaagtaaaagcagttcacaaacaattcagactatacagaaataaaaagtagtatatatggcctaacattactttgttcttaaaattttccagtgacttttcttcccacttccaactccaactgccctattccagaatgtcaaatgattgtgacttgcaggttttctaatcagcacgtaagtcggaaattctaaaaatacattttaaattgtggatcacaccattacatgactgtctatagagccatttaattttgaaggcaagttaattttaaaaatagttacacacaaatgttcagttgattacgcttaagacagttttattctggtgattcagcatgatttttttcaacaaattaggtactttgtctgctttgtggaacattggcagtttcatttcctgttaaggaagctatcatcagaactcagataaacctttgcctttactatttgagtactgaaaataaacaaagaatataaaactcacatataggctgggtgcggtggctcacacgtgtaatcccagcactttgggaggccaaggcaggcggatcacttgaggccaggagtttgagaccagtccggccaacatggtaaaaccccatctctactaaaaatataaaaattagccaggcatggtggcacatacttgtaatcccacttacttgggaggctgaggcaggggaatcacttgagcccaggaggcagaagtagcagtgagccaaaatcatgccactgcactccagcctgggtgacagagcgagagtccgtctcaaaaaataaaataaaataaaaaataaaacacacgtatatacttggggacagaaacatcaaatatgttttctggatgatttaaaggtttagaaggggattatttattctaactgaaaaaaaaatcttttaatatgaattatttatatggaagacttctttttgaagctgttgtggctgatgctgttggattcatgtctaacttctttcattttataaaacagaatcatatcatcatcacaatctgtacactcccacctatactcttagggggcagtctggggtggttcctagggtaacaggcccaattatcccagtatacattgcatacagtaccctaacaacttttaggaaaggttttcattattagtgctttgttttagaaaaagtccaaaacaagccctaatgaagagtccaaaggataaggaagatgaagagaaagagaaagcactgaaaagtagaatcacatgatttgcaagtaggacaaggaaagcgagcaggaaaaaaaacagagttgtcagaacctgtggggaaaatgtgctgaacagcaagggctgagaaatgagcaacatattaaactttttttttttttttttttttttgagatggagtctcactgctgttgcccaggctggagtgcagtgccgacatctcagcttactgc

SEQ ID NO: 36419 - DNA, 2845 bp, Homo sapiens
cacattaaccggcaggatgtcggaggtgcggctgccaccgctacgcgccctggacgactttgttctggggtcggcgcgtctggcggctccggatccatgcgacccgcagcgatggtgccaccgcgtcatcaacaacctcctctactaccaaaccaactaccttctctgcttcggcatcggcctcgctctcgccgggtgagggagggaggcgccggttggccagggacgtctgcagagcgtgggggtagacccacaggtctttgaggaccaggacggggaacctgagggaggtgcaaggccgggaagggcgaagtcagtagagatggacggcctgaggggcttggaaggggggccttgaaggaggtggagcctagttataaggagggcctcagggagatggagcctggctgatgaggagggcctgcgggggatgggggtctgcaaggaagatatggggaggatggagacaagtgtgggactgaaggggaaagtgggctggaaggtgaaccggaaaaaaaggagggcccgaaagggggacatgagagtacttgaggggcgtagggggggtgtgatgtgaatgatggggccagattgaggccgaccctggagtacttagggcagagaccgggaaatagacggtaaagttggagggtttggaagatgtatttattggggatccggtcttggaggggagcctggctatgattggaaggcgccaggggcaggtacctgttggggaacttgggcccaggaggaggatccatggttggaaagcctgagaccagagagggatggagaatctggaggaaggacttgagcagtgctgaaagttcagagtggggctgacgacctggaagaggtcctagcaatgatggagggaggaatctatagggaaatgggagcctggagggcggttctataaggaccctaggcctggggagaggggaacgtgtgaagacagaaggcctgaaagagggatttgcaggggctggtgttaaagggggagcttgcgggcaggctgatgaggggccctacgggggcagagtcggaaggaaagtccagggaagtgttgggagcccgggggtgtggggagtgtctagcaggatgggagggcctgaagcggggacctgaggaagacaggacagtggaattgacaaggaggaaaggaggggtctacaagggtgagtcgggagccctggcagatgggcctgctggagatagggctggtgggaggatgtgccaggctggagtgtccggagacgggagaccctggctcttggggcccagggtgggtggtggtccggaggccgtctctccgcccggccggctagcttggttcccttgtacccgcaggtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttcgtgagtctccactaccccgagatagccaggaaagcagccagagcatgcttaaggcaccaggccagccctgccggtccccgggttgagagggggctgggaaacccgagggcctcgccacgcccccgctaaaagcgccttcccgggcttcgttcccccttctgggaacaccccttttattatcgcctttcctatctcactcttggtgttaagtgccttccactggccacgtccccgttaccgggcgtcttccctggccatgcccacgttgccaagccaattactcggccacgctttcagtatctgaggcgtcctggctgctcaccactccattggcctgcctgcgcgccaattcccttcggtgggccccggttggctgcaggctgaggtctattccactgaccacccctctcggtgccgcccacagtgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacctaggaccaagagccacctacatccagccccaaaactggggcttcaggccagagcatccatggccaatttcaaattgtgaacccagagacactcccatccacccttctccatgctcatccccaaactggggcctggagcaaggcactctcaaatcttgaaccctggaccaaagcttttccagaccccaccctaccttccaacccaggtcaagacattgccaaatcttgaactcagaacccaagtgttccatgcccctgtgtggatggagtcgggtatcctgactgttggacccctggtccaggtgatcccgaccctcaccagtcccatttgcctccctccagctctgcttaggcattttgcccctcaccccaatgttccacaccatcgacaaccaaggggtgaggtggggacaggcctcagcagggaatggggcgtatatgttagtgttgctgcaacaataaagcctgttgcatctctcatgccaa

SEQ ID NO: 36420 - DNA, 5867 bp, Homo sapiens
cgcaagatggcgccgtccgccttgctgcgtcccctttcccggctgctggcccccgccaggctcccgagcggccgtgagtatcctcctcgtgcaggccgactcgaccctcagattacccctcctaaggcggacccagcccacgggtgcaggaggcggcagcggcccgggttcgtcctgcagtgaccttcgccggcagacgacccaaggcccagcccacgcctgtcccctacgcagggctctctgctccccatcacccgcctctagcacttatccaagttcaacctgaccactcttggcctttgtaaatggactttgggtccttgccttccccacctctgtacgttaggtcccgtaaaccgggagaggagacaccctccccggggcgccccttacatgaccactcccgagtcgtctgagggtccgcaagcccttaaacgaggctttgaaagcctcggacaggacaggtgcgtcctgtctaactcgccagtggccctgggcgaggtacttgatctctttgaacctctatttccttggctgtttaagtgggagatgggggagttgaagggagaattaaatgcgataatacgcacgtaaatgttagggttttttccctacaaggcagtaagttacaaatttacagaccctcttcccctttcagcttcagtgcgatcaaagttctacgtgcgagagccgccgaatgccaaacctgactggctgaaagttgggttcaccttgggcaccactgtcttcttgtggatctatgtaagtactttactcccggatgtcgtgagactacaccagcgtggtaagggaatgacataacattgcgagattgaatggtgctgttatatgttgtatggcagtgaaactctcataacagtaggatatttatataatcgctgatacgtatttttccataagagaaatcccaaggactaaaaagaaattaagatttcagcaacattgaaaaagtatgatgggactaaaatttctgttattgttccttaacatggttttgtaaggaatggcagttttactaaatagtaattatactttttttttttttttttgagatggagtctcactctgtctcccaggctggagtgcagtggcgtgatctcggctcactgaaagctctgcctcgcgggttcacgccattctcctgcctcagcctcccaagtagctaggactacaggcgcccgccaccacgcccggctaatttttgtattgttggtagagacggggtttcaccgtattagccaggatggtctcgatctcctgacctattgatccgcccgcctcggcctcccaaagtgttctgattacaggcgtgagccaccacgcccggcaatagtaattatactttatttcttaatgagaattgaggctaattggagttttatgaaggtacctttttcagatgctgtaaggacaaaccagcagtgtgcaagttgtacaaattgaatcccagtagacttccattaggttttaatcaatgtttgtataaatacattgttggaaattgtacatagtgtgtagcgacctttttaaaaaaattttcaggccggacgtggtggctcacacctgtaatcccagcactttgggaggccaaggtgggcggatcacgaggtcaagagatccagaccatcctggctaacacagtgaaacctcgtctctaccaaaaatacaaaaaaaattagccaggtgtagcgaagggcgcctgtagtcccagctgttcaggaggctgagacagcagaatggtgtgaacccgggaggtggagcttgcagtgagccgagatcgtgctaccgcactccagcctgggagatacagcgagactctgtctcaaaaaaaaaaaaaaaaaaaaaaaaaaaaattcacaccacatgctttacacataaacttgcgtttaatcatttcaacaacactacgtggcacctactattgttgacccgttacagataagaaacacttggagaaactagtttgctgaacccagttctcctgacttcagaggccacactatcctagaaaagactgtgaaacactgcctctgttgggataaaatttctttttaaagttaaagtatctgctatattaatatttaaaattttgttttttatctaatgggtttgggacttcctccactgtcccccagctctaagatattttaaattttcttgttgaagtggttcagatttttgacttggaaaggggtgagagattttgagtcacttacaacttaatagtaactcatctttttgaataatgttgcttataatgaattttatacattcttaatttaaggttttctctaacaagaagcttaattactgctgagagcactagtgattgaacttggatctttgattgccatgaatgtcatcgtatataagccatttttccagttgcatattctgtcagacagtggtcctaaaaatgtgactgtcctccatgacatctaattaatacacatacagtttcgtgatggggttggtcattcaatcaaggtatcctacttctaagattagaagcataacacgcacccaccaaccagcctggatcccatttaataaccaagttgtgctgtatcatattgatttaccccttcatgataagccatttcattacgtttattacccaccaaatgaggtaaaatttttggcagtagtttaatttaaatttttggccaggtgcggtggctcatgcctgtaatcccaacactttgggaggccgaggcgggtggatcacctgagctcagagttcgagaccagcctggccaacatggtgaaaccccatctctactaaagatacaaaaattagccaggcgtggtggcaggcgcctgtaatcccagctattcaggaggttgaggcaggagaatcgcttgaacccagaagaaggaggttgcagtgagccaagatcacgccattccactccagcctggggtggagcaaaactccgtctctaaataaataaataaatatatatatatatatttaagggctcccttctcaaatttaggatgtcacattgtggtgagcaagtttataccattcctggtttttgaacttttggatctcttagccttttatttctaactagaatagttgtttattttttctatccttattcctttacaaaatataagtatccaggaagattacatttctaattttaactgtttaactctttgtagctcatcaaacaacacaatgaagatattttagagtacaaaagaagaaatgggctggaataaacttttgaaacactaatgtagtaagtatacaagcttattggatgaatagattatgcaaattaacttgacctcttttttaaatactgaaaaacaagcttgttgtttgttttgtattaggtttatacattttagcacccatatttctgtctgtgacaaatttataaatttgtaataccttgcctcaagcagttggttttgttttgggggggatggggttttttttgtttgttgtttgtttgtttgtagacctgttggccaggctggtctcactccttgcctcagcttctgaaaatgttggaattataggtatgagccactttgctagcctcaagaatcttttagcgtaatcatttttaatcattagtctttgactctgttcaaagaaaggtatgtttaagaatgaaaccaaaatctgccaggcgcggtggctcacgcctgtaatcccagcactttgggaggccgaggcgggtggatcacaaggtcaggagatcaagaccatcctggctaacacagtgaaacaccgtctctaccaaaaatacaaaaaaattagccaggtgttgtggcgggcgcctgtagtctcagctactcgcgaggctgaggcaggagaatggcgtgaacccgggaggcagagtttgcagtgagccaagatcgtgccactgcactccagcctgggtgacagagtgagactccttctcaaaaaaaaaaaaagaatgaacccaaaatcatattattttcttaaatctgatagtgctttacactttgctttcatagcacttatgacaaattattattcttcgtgtgtgtatttcttaatgtctgtttggtatcttgtacacttgagtgtgaattccatgagaacagaaacctattttattaattatcctttattcagcaacttgctcatctggtccatttaggagtttaatatttgtagaagtgatgaatgtataacggcaatcgattctttttattttattttattttttgagacggagccaccaggctggagtgcagtggcacaatcttggctcactgcaacctccgcctcccaggttcaagcaattctcctgcctcagcctctcgagtagctgggactacaggtgcgcgctaccacgcccagctaatttttgtatttttgatagagacgggcttttcccatgttggccaggatggtctccatctcttgacctcgtgatctgcccgcctcggcctcccaaagtgctgggattacaggcgtgagccactgcgcctggccagagcaatcaatttttaaatttttttctgcatgactatttcattatgattgtcaactcaactaatacccagttggacagttcctggtaaaaaacctagttatgaacaagatagtttattctgcatggtctgtgatttaaaagagaaagtttattatatatatatatataaaatatatacatctggctgggcgcagtggctcacgcctgtaatcctaacactttgagaggctgaggcgagtggatcacttaaggcaaggagttagagaccagcctggccaacgtggcgaaaccccatcagtactaaaaatacacaaaaaatagctaggcatggtggtgcgcgcccgtagtcccagctactttgggaggctgaggcacgataattgctttaacccaagaggcagaggctgggaggttgcattgagccaatattgggctactgcactccagccagcctgggcaacagaacaagactctgtctcaaaaataaatgaatgaataaataatatattcatctatagatatgtatcaaatatatataagtataccatatacagtgtacatatatatatatatatatggtgtatttctgaaaaccttttttaaaaatcctatattaatccttttataagtgaacagtcacttaaaaatctcagctttcataattgggttgattaagtaacttatatctgctgtataataaacatagcgatcacagactatcctttttttccatattttataactctgaaactgagctctttactgttgattatccaaatcttttgccttttttctattagcaccctgcccatttcactactctaatcagccaatcaagagataaaatgagtctgggcttggtggctcatgcctgtaatctcagtactttgggaggcctaggcagcgggatagcatatgcccaggagtttgggcaacatagtgactttgtctctaccaaaaaaaaaaaaaaaaaaaagaggtaaaaatgaaataggcattgaaatacaaaccagatggcttttgctgttctttcatagttaaggcaaaatattttttgttaaaattaaataaaataaggtattggtactctttgtgggtcttttctagactttttctgatgttctaaggtgaattcagagtagtttaattttaatattatttctgctggttaatgctacagttttttttttcttcattataggtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttc

SEQ ID NO: 36421 - DNA, 236239 bp, Homo sapiens
atgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggtaagctgcctttttctgttcctaaaacatggggagatatggcattatctccaagtaatcctgttgttcatttgtggttggtgttttgaagtttttggaaatgtttagttggctctatttttggcatgtgtaccaggataagaaaatcccattctattatcaactaactttagagatacatctgacagggttgtagatgagaatatgttgaatcaaattgagtcctctgtgactcacaggtctatctagcaaaacaaatggtgttaatatggattgtaggaaatgccccttaggctaggaagcagatgtcttaaactcctaaaagtttccttttcctctattctgccataaatataatttgcctttctcaaaacaatacaaactccattttacctccagccttcccgcagcttgacgaatgttctaaaaaagccttcttaaactgtgagccaagtctcacagtagatattagagaaggtaagttggttggcatctgagtccttctttgctcattgataccatggtggtattgccatgtgtgtgttgtaagaatttgaatgaagcagcaactcctcaatttgaaatgataggggaatgaggttgtctatgtattaacattttccagcttcccattttaagaaacagacttaacttagtgtaaatgtttttggcaatcacagtaaatattccatttggagacctttccaaagtttatttcagatttctctgacctttgaatggggtatctaaatggattaaaccttcccttgtagatgtagattcttagttgtaaaagccactattatactactgaaacatggacaaaattttttggataaagggccttttttttttctttttctttttctttctttctttctttctttttttttttttaacggaatctcgctctgttgcccaggctggagtgcagtggtgcaatctcggctcactgccagctccacctccttgggttcacgccattctcctgcttcagcctcctgagtagctgggactacaggcgcccatcaccacgcccagctaattttttgtatttttagtagagatggggtttcactgtgttagccaggatggtctcgatctcctgacctcgtaatctgcctgcctcggcctcccaaagtgttgggattacaggtgtgagccactgcgcccggctgaggcttttttttttctaaactaaagtatatgactctgtgtgaggtataagagtaggctttatggttgctgtttcacagactttagctctttctgcccattgctgaagtctgtgtctggcataattactggaagtctgatttacggatatgattgattttgtagacaatcctgatagccacagacaaaaccatcccagaggattaggaattattttaagccatttaaagatatttttataatgatatcagtgtggagttgaactgttgaaattatgggctgaaaatagcttgaaatacaaggaattatatataattagaacctccagtgctatgatcatcagactatttaaagtaagaaagtggcacatgccaatttcttctttggaagaaactgagaattttgttcttggattataaccagattatcacaaatgataattttctcagggcaagtagtttcctctgaaatatacctgccataaactataaagcaacagtctatgtattctcatcatatcatccatttctctaaatatcacaattagaaggattttccttagagatttaatgagggttttcattctttcctgattaaatacttcccagtagactgaaacaatgaggcctaggaaggtgctaatctcatttagcagtgctgctcaagaatggctgattaactgaattagaactgaggacatagaaggacaggggctggaggggggagttcatgggagtctgtacacatctattttgatattctgatttgtgattgaataaaggattacaagatattctcatctaatgtgtatacgaagtttgtgcatagcagtttgggaaatagtatttggttttaggatgaccttgataaaatattgaggcaaaataaacaagaatatagttaattgcactcagtttcaaatgatttagatcaccattttacagccatggaggtgaattttataattggctgaagtctatgtaattcagtttattaaatcagaaagtgtcctacctcagcaagatttttttttctttttttactcttccttttgtggacagtctttaggataccaaataatctgacatggatttaattttgacttaattatatctatatagtttaaggtgacaaaacaagataatcagataccagataagttgacaatagccaggaggcatgattgctgggactccagaaaaaaaagtggggagtcttgtggcatctcattttcactgcatatttctcttccagacccagaaattcatatttctttcatttaacctcctttttaaaaaactattatgataaaatcacttattttaagacattaagtatcatactccattctgtcagaatattctttccacaaggtttaggtttcgtgaatctgagccatgaagtctgatgatgggtattttccacaaagggtggacattttaggcactgtgataagttggtggggagatatttttaggcagggggaaaagaagcaaaaagcatttccagcactccttgtattggcctatgggcaaggctggccatggtaattgtttttatatttggctttgggaagatgtattcagcagcctggaattatagcagggggtggagacatcagaaatgatgcttagccttcatttccaaggtttacgagggtcggtggtttcatatgtaatttgttttggcagagtcttttcttttttggcacagcctgcttctgaaatcattgtgtcttgatattgatgcatttaagtttagcctttgtcttgcaattattataaagtatacatttaacttccatagttgggtaggaattaaaccttttgctttctatcacaaatgagtcttgcagcattctcttctctattttcctacatgtctgagataccttttcatttttgaggaaatttatgaattgaacttctcataatataggtaacagcacaggatgtgatctggatctgtttatttctgtatcactttgttctgtgcaaaatgataaatattctgatatgctcatttctgctgtcctatttacattctaagttctgacacctaaagcacatgttaaaaaacagctttgtgttgtccgtaatgttcattccaattttcagttaggcagaattccgtgagattgtattttgatttcatgcttttgcaatgagtgagcacatacttcagtgaggcttgttgtggtccagatggttgagatttgtttatataacacaaaggagaaccggagctggaggaaattggcatctgaaaccaataaatgcagattgctgtgtgcgtgctacagcttgaagtataaatatttttgtatgaaacacatttaaaactgtgatcttcacagtgtccaacacctgaaaattactagggtacatttctcttcagagcactcccctgggttcatctttcgggatccagctgggctgcagaagtcatcttgaggaaggtgaggctaggaaggttgtcctttgagctgccctgtgtctatgctaaagacacataagggtctgctgggtaggacattggaatgcactgcttgctaaaggggaacagtgaagcaatgactgaaatgtttagccaaattcaattgaataagaagaaacctgaaaggtgacttttttttattattatactttaagttatgggatacatgtgcagaacgtgcaggttttgttacataggtatacacatgccatggtggtttgctacacccatcaacccgtcatctacattaggtatttctccaaaatatgtatttattcaatttattaataattataacatcagcagcaaatacctatatagcatttggcatggtgccaggtccttttccaggtgctttataaacatgagtcctttacttgtcatgacaaccctatgagggtagtatctttctgtaactctacttcctgggtgcgtgtcaggattgtattccctggaccctactggctgtttctacccaatgtgtaagcagaaatgacttgtgtgatttctaggccaagaatttaatttacctatattggaccctgaagaatgttccttttgttctgttagggaaactggcattgtgccaagtagtgctggcttaggcagtttgggtcctggagtaaggacactgatgatgtaggatagaatcctagctaacctatcatgaacatgtaatgcaacaagaaaaacaaacaaacaagaacttttgttggttcaggccactgggattttggggtttgttattatagtataaattagtccatctagattggtgtaagtatcattatccctatttttcaggtgaggacactagagagcagagacttttcccatggtctaagctagtagtggccaaggcaggattcaaatctaggctgccagactacagagttcatgttcttaaacattatgcactactgcctcctgatatacagatatttattgaaagctggtatgatatttggttctggggattcaatggtaaacaaaataggcttaaatttaatttataatgtaccaagagtggtctattcaaaataagcaaacaactaataaacataaatgctgacagtgatgccaaaacaaaaggacatttagcatattttcaactacattcatttccttacacacacagacagacatacacacatcacacatgaacatacacagttctttaaaaataagatggtaattctgccaaccattaaagagtatattctactagaatgggcatgtggtgaaagacctggctctgctgttctcttagtctttgtgtgtcttgtaaatagatcattgcaatgcattgcaagtagctagagtgattctaatattcaaagatgtacactttcattcagcatatccactaaatctgaaccaatttcttcttctcaagttcagctgactaaacgctgagctagtctaacattgcaggcattatgagagcatcctaaaggattttcaaagctaaatctgattatttgtggtttttactgagttcccctcactctagtttgtaggagaatgtcgatgtttactttgaactttacaactgccggtccacaatctcttatctatagtactaaaatctgaacatctgaaaactgagacttttttcacaatccattgtgagacaaaacatcacttcattaaaatctgacctgaactgataagaggctacttgtagttcgactagtcagctatttctctgtagaaatattcctccctttaattactaggggctgcccccgatgttgctgggacattacacaatatgagccctgtgcccagtattacacatccaaatcccccaattcagaatgccaaacatatcactcctcaagagtttcagacagtaggttgtagatctataaaacataaaaatgaatctacattccatattcaaagagaagaatgaatttatcatggaaatctgaaacgccataaagtgagcaattcaatgtattttgcccataagatgctcatgtctattttcttaatttttaaataatttattttcaattgactaacaaaaattatgtatacatttattgtatacaatatgatgtattgaaatatgtacgcattatgtaatgactaatttgagctaattaacatatacattacctcccatacttattactttttcgtggggagaatatataaaatctaccttcttagtggtttttaaaaatacaatagattatttttaactaaagtcaccatgttgtagaatagatcttttgaactcattcctcctgtccagctaaaattttgtagcctttgttcaacaacttcccagcccctggtaagtaccattctactctcggtttctatgtgtctgacatttttatcctctacatgtaagtgagattatgtaatatttgtctttctgtacctggcttatttcacttaacatactatcctgcattttcatccatgttgtgcaaagacagggtttccttcttgtttaaggctgactggtatttcatatataccacattttctttatccattcatctattgatgaacacttaggttaagtccatatcttggcaattataaataatgctgcgatgaataatggagagcagatatctcttcaacacaccaatttcattttatttagatgtatacctagtagtaggattgttggattaaatggtggttctatttttagtttttggaggaaactccatactgttttccataatagctgtaccaatgtacattcccactaacaatgtgtaatagtttccttttcctgacatcatcaccaacactttcaccttttttccagtagccatcctaacaggtgtgaggtgatatttcattgcggtataatttgcatttccctgatcattagcatagttgagtactttttaatacacttactggtcatttgtctgtcttcttttgagaaatgtcaattcagctcctttgcccatttttaaatcaggttatttgtttttttgcagttgagttatttgagttccttatgtatttttggatactaactccttgtcagatttacaaatgttttctctctttgcaaatattttctccattgattgtttcctttactgtgcaaaaaccttttagtttaatgtaatcccatttatttttgcttttgttgcctgtgcttttggggtcatatccaaaaagtcattacccagaccaaagtcaacaattcttttcatacattttcttctagtagttttagttttaagtcttatgtaagtctatttcattttgaatttatttttgtatatgtcataagctaaagttctgatttcattcttctgaatgtggatatccagttgttccaacattattattattaaagaaactgttttttcttcgttgtgtgttcttggcacctttgtggaaaatcaattgactgtaaatccatggatttatttctgggctttctattctgttccattggtccacatgcctgtttttatgttagtaccatgctgttttgattactatagctttgtagtcagcttttttctttttactcaagattgttttggctattcagagtcctttgtggttccatataaatttcaggattttttttttctatttctgtgaaaaaatgttattggaattttgttagagattgcactgaatctatagattactttctgtagtatgaacattttaataatattaaatgttaatatttaatattaatactaattcttctagcctctgaagatagaatatcttttcatttattgtgtcttcttcagattccttcattatgtttcatagttttcagtgtacaggtctttcacttccttggttaaatttatttctaagtatttgatttttcttagcttttgtaatttggttggttttcttaatttctttttcagatagttccttgttagtatatagaaatgctactgatttttgtattttggttttgtatcctacaactttactgaatttgtttattagttctaacagttgtttgatggagtgttgagggttttctatgtataagatcacgtaatctgcagataaggacaatttaacttcttcctttccagtttggattccttttatttctttctcttgcctaattgctctggctaggacttccagtattatgttgaataaaagtggtaagagtggcttccttgtcttgtttctaatcttagaggaaaatcttccatcttttcaatgttaagtatgctgtcagctgtgagtttgttatatatggcctttgttatattgaagtacattcctttgacaactaaattgttgagaatttttattgtgaaagagggttgaattttgtcaaatgctttttctgtttctgttgagataaccatatggtttttatccttcattctgttaatgttgtgtatcacatttacagatttgcatttcttgaattattcttgcttttctgtgataaatctcacttgattgtggtgaacaatcattttaatgtgctgttgaatttggtttacaggtattttgtggatgatttttgtatctgtgttcattagggatattggtctataattttcttgtcttgtagtgtagttgtctgactttggtatcagggtaatactgactttgtaaaatacagttggaagtattcctttttcaattttttggaaaaagtttgagaataattggttttagttctttagatgtttgttaaaattcagcaataaagtcatcgtgttctgggcttttctttggtaggagacattttattactgatttgatctttttacttgttattggtcagttcatgttttctttttcttcgtgattcagtcttcgtaggttttacgtctctaggaatttatccatttcttctaagttatccaactgttggcatataattgttcatagtaatttcctatgatcttttgtattcttgtggtatcagttctattgtctcctctttcatttctgattttatttgagtcttctcagatttttttattaagctagcttaagggttgttgattttgtttatctttgtaaaaggccaactcagtttttggataatttctactatttgtctagtctctatttcatttatttattttctgatctttattatttccttcattctactaactttgggcttagtttgttcttttctttttaattccttgtggtatgatgttatgttttttgtttgaaatcttcttttttgatgtaggcatgtattgctataagtttttttcttagatatattttgctgtatctcatagtatgctactagattttagtattttgtgtgtccatttgcatttgtctcaagatatttttaaattcttctttgacccattagttgttcagaaacatcttgttaaatttttttgtatttgtaaattttctgaaattctttctgttattgttctctagttttatatactactgtagtttaaaaagatgtttgatatgattttaatcttttaaattttgttaagacctttttgtgctctaatatgatctatcctagagaatattatgtgtacacttgaaaagaatgtatatatatcctgctgctgttggattcaatcttttgtatatgtctgttaggtttatttggtctaatgtgcagtttaagtctgatgtttccttattgatattctgtctggattatctatcctttgctgaaagtggagtatggaagtcctctaccattattgtgttacagtctctctctctattctctctctctattctctctctagatctattaatatttgctttatatttttagatgttccaatgttgggcacatgtatatttacaaccgttattatcaaattaatcattttaacttatataatggctttctttgtcttgttctactttttttaatataaattctattttatctaatataaatagctaccttgctctcctttggttagcatttacatggaatatctttttccctcccttcccttttagtatatatgtgaagtgtgtctattgtaggcagtgtatagttaggtcttttttaaaaagccctttcagccattcagtcattcttgtcttttgattggaaaattgaatccatttacactcaaagaattaattgataggtaagaatttattagtaccattttgttaattgttcttagttgctttgtagatctgttgttcctttctttctctcttactgtgagagaaattgtaattagatgattttctatagtggcttatgctttgattccttactttttatggtttgtgtatcaactaaagtgttttgctttgtatcatgaggcttacataaaatatcttatagttataatagacttttttatgctgacaatttgatcacatgaaaaaactcaataattttactcctctttccgcattttatgtttttggtgtcacaatttacatgttttatattatgtatcccttaacaaattatagtagctatcattatttttataatttagtctttgaaacttcatactaaagatataagtgacttacgtagaaccattatagtagtagagtattctgaatttgactgtgtactgatttttaccagcaaattttatactttcctatgcttgactgtattactaattagcatcctccttttcatttagattgaagaaatcccattagcatttcttgtaaaataggtctggtggtgataaactgtcagctttgtttgtctggggaagtatttttctctccatttctaaaggatagatttgctgggtaaagaattcttggttggcagtttccccccagcacccccacccacacacacaccctgcctctgggttatcactttgaatatattatcccactctcttctgccctgtaaggtttatgtaaaaaagtctattgctagccttataggaacttcattacgtgtgatatgtttctttttttttttttcttgcttttaggatcctctttttatctttgatttttgacaatttgattataatatattttattgtaatcttgtttgggctgaatcttagtggagaccttcctgtacctggatatttgtatatttttccagatttgaaaaattttctgttattatttctttaactgaatttcctggccctttattgttctactcttactttttaactccaataatttgaatacttgcttgtgatgctgtcctataaatcccataagcttcctttatgcattttcattcactttaatattttcgtctgactatatattttcaaataacctgtctctgtcttcaagttcacaggctttcttctgcttcaccagttcgctgttgacaccctctattgtatttttaacttagttcattgcatatttcagctctagaatttttttaataattcaacatctcgtattttggttgcttattgttctttaattttgttaaattgtttctctgtatgttattatatttttgtgagctttcttaaagcaattattttgaattctttgtcaggcagcttacaaatctttattttgagggtggttattggtgctttattttattcctttgatgctgtcacgtttccctgattgtttctaattcttgtgactgtgtattagtttctatgcatttgaagaagtagggacttattcctgtctttttggactggctttgtctggggaagtcctttactagtcagctcatctagagattctcagcagctggtctggcatggtccatgggtgaacttgctgcttgagtccttgggcaggctatcctggtgcctgggtcagcaggtgggcaggcctggtgcttgagtccatagggttaggcctggagcctggatctactgggataaacgtattgattggttctatgggggtggacctagagcctatgtccataaggacaggcctagagcctgagtctatagaagctggcctgaagcctgggtttatagaggctgacctggtgcaggggtggtctttgagtctgagtctgaagaggctttctaggggctggctaggtgctggtatggacctggtttctaggttcactgggacattgctgaagtctgagtccacagggactggcctggcactgtggtaggcctggaccctgtgtcaactggagcccggggacactggaactggccaagggcctggggctgccctgttgctaggacaagtgtggaacctgggacaagtgtggagcctgggggccggatatgcagctgttggcctagaggctaagtacatgaagggaggcctgggtcttggggccacaggtgctgtcctggtatctgggtccaaggggtggtcctggagcctagctctgtgtgaagaagcatagcagtgaggtctactgggatggacctagcccctgggtctgctggagcaggcctggcccatgaatatgctggagcatgaagctgcaggactggcatggaaagtgaggctgtagggactggcttggcactgggcaggatcttagaacctgtgtctttgagtgctagcctggtaactgatgccagggttgccaacctggcaaaggggcaggtctaaagcctgggactttgtgggctgacctggggcctggggccataggtgcttgcctggatgctgagtccatgggtaccagcatgatgactagagctgtggggggctcatgtcttttggaaataaagaatatactcaagctaggatgagcattgtgtatagatactgtctgtgtagccctccccaagccaaactctgacactcactgagtctttctttgagtatctatagtttaaagcctttggccttgacctgcctgtgctgcccacagcccttcattctagctcctcactaatggtctgctctgggtctataggagagcctcctagcccacaaagcagatagttactgctctgtgcacgtttgtcttgactcagggagcttaaattgtaaaatattttgtgtcacctacctagacatattttccttttctccatttacattttcttctctagaccctgaagcccttcaaggcagacagtatttgtatttgtcttctttgtatttctagtgacttgcatagggcctgacacacagtaggtgctcaatcaatattgaaatgaaactcttcttaaacggtgaccaaattaagacacagagagatgaatttaccagaatcagctgattatttagagagataaaaaagagtagagtgaggctttctgacttttaagtccagttcattacccactgtgcatcactgtgtctgaattgtactgtggaaagcaggttccaaaaacaaagttggctgtacatcagcacaaacttccatgtagaagaatgtaaggcagaaagaactcaggtgattcagcagcaatgctcaagccaaatgtaaatgcactgaatccaaatcacccttgtagttaagatttgacgttcataaagaaacctgctttatacgtcaatttatatttatgtaatgttcaaaatttttagaggggactgactcatttagcaagccgagtgaataaaaaaattagaagtgtcttaagcagatttatttttataactacatcaaggagaagaaaagggagatgggtaaaaagagagtagcaataaaagcaataaataaaataaatatttatattattatgtttatgttactgtaataaatacatttttaaaaggtaacaataaaagctaaaatctcgaactctggaagaacctagaaaacattaaggctggttggaaaattcacgctagggatctgtaacaaagactaaatatgaagataataattcactatggtttaagtatcactgaatatatgttgtaaaaataaaatagaagtgaactataggaacttgagggtgggaaaatggatcaccaaatattagttttaaatattaaagcaggtaacagttaaattagacataaaatatataaggaatacttaggaatttcactgtttttcttgtgttgttcattccttataggtaaaagtgacatttatagttatatttgttgtcttaaggaatatttaaattattaaaagggcatatcattgtactctggaggttaaatctgttttgttttgttttttttccctgaacagtgactgagacccataattagttactgctaatcacttgggggcacctgccagatgagaggcccagtgtggggcagatttgaacgctgctgtaggacattttatgaaaccttaacctttcttaaagtgactaaaatattccagaggcatatttagtatcttgcttctccacagtactgagtgacccccggggcccaagagcctgacaagctactctaaaagtcccacttaactacctgaaaataattgagacagtagagagaattaaacctgatggatagagttgagagtatttggattctgtgccaaaaagtgggtaaacatatattcttgatgacacttggtgaaagatgactgccatattccatttattctggtatgatattaaatagggacatggagcttttttttctccctatttgcaaaaatgagtacttggaacccacttcatatggtttccatcagagctgcttctagtctatacagtgactgtgaattattaaaatgagcagaagcagtcttaaggcatactgcctggggaaaggaagtgactttgtaaaaataatgtcttgccctctaggctgatgggctgcgtgcagccctgaacagggtgccttggtggtggtggaggggtaggctagatttcatctgccactcacttcctgggccaggagcccctgagaagtacacaaagacacaaccatcgtgggggccatgaaaatttcaaagtacttcaaattttaaaagatgtaaattcaaaggtaactcttgagttctgttgcctaagaacattacttttttcagaggcagtttcagagatagaacccagggttaggatgagctttatcattattattttctttagtctcaacagctgaggatgtcatgggcttcaccctgcctgtcttgacttccttgaatctagtctcagtttggtgggcatgaaattcttgattgacttggtgataaccagagaaagtcagagttttgatgtgaactttaaaactcctccaaggtaaccatcacagcaggcctgacatttagttcaatggatgagatcggtgtgatatagatgggctgagtgccagttctattaataccctctgctattttctctgtgagagtggggttattagtgtgctgtatagacttccttattacctgttcattgataattttgtgcttatggtgttcaaccatatgcccctgccccttttagcaaaatgggtatatatagaaacagaacatgtgtagtttatttttttagttttatcagtttctgttaatattctattttactgggaatgttctatcatatagcctgactattattttaaacagaaataccataatctcatctgtgttttaagagagagacttgctgatcaggtacatgatagttaaggttttttaatcaaccatattcaaatatcatgcctcatactttgttcaaaacctacctttccccccaaaaaatttttagctattattaactccaaattatttagtataatgtattatttatacatagaatgcactgtgtcatatgatggtctagtctttacattccagctgggtgattgtaagtgtcttgaggttggaagagcaacctcctcattcttcgggtgtcccagatgttgaatacagctctctagacatgatgtgggtgttggattcagaagcattggggtccaaatcctgccttgacaatgtagtagttatttcatctttgccaacttaaaaatatctttgaaactcagttcccttttttataaaatggtgttaacaacaccttgtttattggcttcttatgtgattaaatgagatgaagtagacagaggaggcagcataatactagaccttcttagtaagcatgttctcttcctcattcttcttcattcccctccctgcgacccagatctgtgactgtctatctctggttcaaggaaggaaggaggttttctaataaccaggtgtttttctaaaaatatgtagacctagagagcacatgtctatggaatttggaaggaagacttcagcagatccttgcagaattataacaacaaagttgtgcttttatatcatagccttgagttttaaggaaggttaatctcagtttccacatggaaactatttcttcaattgttttaggacacttcttgttcactgtttcccatataaggttcacgtgatacttttcttttagaactagttccaggaagactttgtttactctggggaactggtatttttttctcactatgaggattatgtgatttatgtgtttttctttttctctggcttctaggaaactcaaattaaaaattaatattcagtcatagcaactatcttttttcttattgatcctgatattttatttcttatatactaacctaattatgtatatatgtaatataagatatttttctgaattagctcttcaaactttcttcacattttaatgaatactttaacaatcatcttttaacatgtaaagaagatgtccagtgatcattaaggatgtgttttacagatgttttaaattccattgtgaatagaaaaaaatcacctaagttaatatgatatttttagaataacatgcacacaaactttttttttttttgccgtgactcatatggtttagaaaaatagtttttaaacatctccaaggaaaagaatgtaacttggcaatcacaattgacaacaacatcttccaggaacacgtgccatctaggtccacatggttttagaaaagcactgggtaattaaactatctttaagttttactcttaaatgtgatcattattctaatattcatttgtgaggaaatgaacacttataaagcatttgaggatatgtgtattcaagtttgtcctcatcataaatcagtctgattttgaactctgaaggcttagagacacattatttcatgggaagatgctatagtttcaatgcctgatgcttgagagttttattctttccctcaaatagattactttttgttgatattatgttccgtcaagttgtagaatttggaacagaagtccacttaaaacttaccattgtgcagcttaagttcacgactttgcaaggggcacatgaaaggaaagtcgtttcactcttcaactagcctctttagaaattttcagggaatgagagtcttcagtgtcataaatgtggcagtgataatcagcttttattacacatgctttttatatgtagacttgttctaaatatgggaggagggagggtagggacatgataatttagaaggaggaggagaaagtgagtatacatttggttacctagccctacctttgcccagcctccttgacaaccaggctttcagctcaagtggggttgtctttcccccagaaacatctctgagtttacatatctaagtaagtgtggtccctttcaaagtgattcctctttaggcaccactcactgattgctcattttttgcaatatcttgagtggtgcaaagcgtatgtatttatagagtggatttgaattggtggaagcaagtcatttagagttaactatggtgactcatgtaggtaaccaacccaggtaaaaataatttctatttaaacacaacatgcacataaactataataagaaatagctacaaaacactaggaatgacttccttttggagcttttgaactgatatttgggaatttcagaaatgcacaatgaaagcattgctgcaacaagttcacctttttgaaaaagactcagctgtacatgtaaaatttagtgtattacatcaggtacatttttaaattgtgctttatttataatgcacccagccttgagtctcaggcccatgtttcttgctgaacagggcaagccttaggaacaaagaaatgggctctgtagtgtgaggaaaatcctgtctccaagtatctcctacagtggactagagtcttttgaaacctaaaggctgttttctgattaagaatcttctttttaatgaacataaccctgaaagatattatattctaagatatacctaagatgtatcctaagatattctaagatatacaatataagtacccagagaagaacagtgacttataaatacactaacaaagcgaaagagtactgcagcaatcaatcaatcagccatcaattatttaataattattgaaactctaccatgtcccaagtattgctcttggcattgggagtacaaagatgaaagaaatgcaagccctcatgaagcttaatgtttactgagatctgaaaattatagtacaagttaggtgaagtgagagatggaggcagaaggagcatattataggcgctcagggcatgggcactaagagggaagagtgaaggctctggaatattttttctatattttatcatgtatagagcgaggaggcagttcagtgtatcctggtagccgctttcctcatggtgaccaggacgttgttcagctcctctcacctccgcttggcatggctatgtgtccccacccttttcttggtgaacctggcagtactcttgtccttggagaccttgagctccatgatgtgtcactcttataggatgaagctgcatgctccttggatcatgtctcacttgaattctgagtgcttggtgaggtgtctgcagtggcagctgtgccttggcttatgctcttggtcaccttgtggccctattgagtcctatggccatgggatagcacagagccatgactgccatgcttcaatggctgctgtcacagaagctctgagagatgtttttattctttgttttaagctacgccttgtacctgtacaacagtctccacatggacccatcccatgtcataaaatgtgctggctgtcaggacttttcaggccctcctcttgtgtaatcagcattgttgtcctgtcacacagggccttttttgaaaggatgactgatgagtgggggtgacagggaaagaatggcctttgactctggccagggctgcttctccaagtaaacccagccacagtgacaggtgaggtgggaaagaaacattttatttgtgacccatgtgtcctaattttctccttagtgtgagaaatttttgctttccttggaaggtgacctgtgagcttgcttattttaaaaactgcaacctgtgaggagagagggtgttctttcacaacattacatcattgaagcctctaggtgttgagtcatcattatttttaggcagctccatgctttttttggttgttctaagaatagcccctgtgtctggactctacagaaagtcaccacagtaaagattctgtcaccactcagcagttgggataggatgccttcttaattttcaagctcaaggcatactttttagaattttacttgtaaacattctgcctttctaggtttttcctgagacgattgactttgtcaggagctgtcacttgaagttgttcaaccctttgtcaaaagtacttatagctggaaacaacaactgtaacaacaacaaagtttgaagtcctccctaataaaagtttccttattatctgcactcaatgtacatttggtttgtgaacaccttaatcagtgactttacccaatttttaaacatttcaagacatattttcatgccttgtattttataaattaagtgactatagatcccttattttaggatatggggtgggagtgatgctcttggaatttatgcaggatctgctaaaagcagccaaaacacatgttattataccatgttaaactaaataagcatctaaactgtaaactgtattggaacttgatggcagggcattaaaaaggattgagcaagcccagaaatggaacattatgggtcaatgtggaggctcgttttcctattgcctgttcagggcatacacccaaataggatcaatttattttacgtggcactttcaagcccgtaagagtactaatggcttctgagtataaccaaatgcttttccaactgaagcataaatggaagcatctgcttggaaaaaaatgaggcagttgtttaatgttatagtgtctggagatgacagacaacagtcacataatctgtgtctacatgtgactgaaggcattggtgcctactgggaaggctgaactttcttttgagttactggtactttggaggggttggttctgtttttattatctaagaactcaagcctcatccccacaagggtcattctgtctctaattagggaaatgatatagcagagtgattgagagagagagggccttagcatctatcagtctaagtccaaaaccaaattccactgcttattagttgtgcgaccataggcagtttatttaacctttctaaacatcaatttcctcacctgtaaaacagcatcaagtaacagtattgacctcataggtttcctgtaaggatataagtgatatagtcaatgatgtcttgatcctagttaactgtaactattggctaggaataataatagtttctgcccatcagtctgatctgcatcttgcatcatttaaaactcatgggactctgggcccggcacggtggctcatgccgataatcccagcagtttgggaggccaaggcaggtggatcacctgaggtcaggagttcgaaaccagcctggccaacatggagaaaccccgtctctactaaaaatacaaaaaaattagccgggcatgctggcacgcgcctgtaatcccagctactcgggaggctgaggcaggagaattgcttgaacccaggaggtggaggttgcagtgagccgagattgtgccactgcactctaggctgggcaacaagagcaaaactccatctcaagaaaaagaaacctgttgggactcttgcttcccttgcctgtggttgctgcataacgcaccaaagagcaactctggtcaactgccattgtctagtctcactaccctcagaagaacttctaaatccagatgggggagcagtaagccagatgagtaccttctgaaatctgagcacatatgtttattcacaagaactagcccagaagaaagtgcattttctatctcccctgcgtacagagtcttgaacagctacacatttccttactgtaccaataaattgacagtcttttgtcttcatttctccagtgctcactagaaagttccattttcctttatgtttgatgtatagttacaaagactagatgcagtcacttggcaattccattcatatgcctccatgtgaagcctgataagtgttggacttgtagttggtacagcatccttagaagttttctgaaaagacaagtcagttttgccttcctgttttgctttccattctgtcgttgcatcagttcctaaagaaaactggattggttgaccaagccttctttgtgagtaattaaaggcatttcaaattttaatttcaggaaacaaaagtctactgaatagaagatacattcctctgcgggtgcttcattcttgctaatggcaaattttgagtattcgttaattgtgattggcaatttaagcaggtccaattactttagaaggaattaacatttgcatgggaaagagaaggtaaatgagaacagagccctttaaaatctgaatatggtttttaaaatatattcattaagtactttgagaattttacttagaagactcttcacttaatccaagcacatttctttctgaagaaaatagtgcaggaagcatcatagcaaaatagccacatgaaaagtgacagttctctggaagagaaacatcattataaagagaatttgaattcatatgaatgactttattacacttaatgttttatatgattaaaggagttatttcaaaaaataattctttagggaatcctatataatcactgtagacagaatgatagccaatagcatacatggtaaccttttaaaaatctcttttggcacaggttgtcatttgtataatactaattattgctgggcacaaagtgagaagatttatattccaatctatatagaaggccatcatgaataaataatgcatcgcaacgacatatttaattgtcagagactttgttgccagaaatataactaatatgggaggtgcacaacttctcatggcacaatctcattcagggtttctccacttcagaattactgacgtttctgactgataattctttgtgtgcgggctgccctgtgccatgtaggatgtttagtagtatccctggcctctacccactggctgacagtatgccattccccatcatgaatacccaaaatggccccagacattgccagatgtcccctggggggcaaaatcaccttgcttgagaatcactggcccagttgatggtttcaaactacagatgagaggagttgcctgggcatttctcaataatctgttctaggacctcatcttaggataagaatctcctggggtgggtctctagaagaagcatgaagaaaagaaagttataatcccattctctacatctcattctgagttcttttctttcctccattctaaatgaggaggctgcagttcttcaagtcctctctttatgagctgctttggggcagtctgtgcttagtgacatggaggctcccataagcagccctccaaatattccttcctcattccaaaaaaaactgtcatgtaaggtctccccagagtgtttctgcatgggcctcaggagacctgtctctgagtttgcttcacagacacctctccctcagctgccaccattactgcacccactctcaggacaccagaaattgtgggattcagaccaaggagaagttttgttttgagataatttgtttgtggagttaccattggattggttacccagatggttaggctcagcacttttatcactgtggtaatattcagtatcctaggaaaagcagctatctttgtgaggcacatagtgtgaatggaacctaaagaaaggtgacacaggcatactgggcaatcagcacattggtcagagggagtaaattttaaagtaccaatgataaattaattaccatatcaaatcacatgaaagtcttgtgccaggtttgtataggcagtctgtgttattggtgccattttgtagttatacccagtaatatgctgaagtgggcacttacccgctccaccaattgtgtgcagcatttaacaacatggattaaattggccatgggagtactaacaacatggaaatgaacaaactataaatcaggcttgtttgttttcctagagtattagtttcctatttaactaatttaaattaaattcctaacaatttaccacaagcttagtgttttaaagcaatgcaaatgtattatcttagagttctggaggtcggaagtcctaaaatctaggtgtcagcagtcatgtattccttctggaggctcttgagaagaatccatttccttgtctttccagcttctagaggttgcctgcattccttgacttgtagccccttcctccaacttcaaagccaacactgtaaatcttaatatttcactacccatctctttgacttctgcttccaataacacacctccttctctgagtctgatcctcttgcctccctcttgtagctttgtgttacacctggataatccagaataatcttctcattttaaagtccttaatgtaatcgcatctgcagtgtttcttttgccttgtaaagtaatgtattcacaggtttcagggtttagggcatggatatccttggtgggactcgggtaggagtgagggtgaattgtattattctgtctaacacctgctgagagctgctaaccagcataccactggttatactatactgtatatggcagtttctctgaatttgggagtataggccgatctgaggaccatatgtagactaacatcttttctcttctacagtttactccctactgcctgattttcagcattctaaaaaggatcactaaaatttgatattatattcctgattattattgttgttaacataatttcttatgacacatagaggtaaaaaagttattcacccaaagccatgcagagatgctcataagtttttaattggtgagccaagggaaggctcctcctcttccaaaaaaagtaaaataataatgtacttaaagattcaggaatgattttgttaaaaatgtttccaaaaacattcttatgttttcaggtttatagtgaatatgtgtcttgactattacaaagtggcatataccccactttctggagtcagatgtactaccattgtgccacgaggtcacatatatcccaccttcttattattaaattgtgaaacctcaaaatcagataagctgcctccctcagctaagttgcttatcatcacaaatagggatttttgagttgctaatatcttcggcatgtattaattatctaattatgatgcaatttgacagtcagtgaacacgttggccaagtctgctggtaactggtgattttcatgtttcatgtttagaaacagcattgcttctaaagatattgatgacttttgatgaagcacaccaaattatttatttatatatttatatataaagctaaagataggccgggtgtggtggctcacacctgtaatcacagtgctttgggaagccgaggccagcaaatcacctgagatcaggagttcgagaccagcctggccaacatggagaaactccatctctactaaaaatacaaagttagccaggcatggtggcacatgcctgtaatcccagctacccgggaggctgaggcaagagaattgcttgaaccagggaggcagaggttgtggtgagccgagattgcactattgcacaccagcctgggcagcaagagaaaaactccatctcaagaaaacaaaacaaaacaaaacaaaacaaaaaacccccaaaacactaaagcttacacaaaatagttattatggtaaattaaacctttataagctgatactaagtgcagttaaagtttgtaactacaacttataaatcatcttaaagaacattgtgtaattcattagtaggaaaatagggtaacaaagtaatgaagataatttattgtaagccttctatcttagtcacaacatttttgtctccatatttgatcttcaatatatccaattttgaatggaattgtcatgcttttgacatataaacatacggatgtagtttccaatacaaagtcaatacatatcagggccttttctccctatttgaatttgaaatgaaatgaaattattctgatactgggaaaagagaaatccctaatcagattgttaatcgtcagataatatactgggcttcataaaccaatggacactctagagcatgatttttttctttctaactttaacttttgaataaatgttgggttaaagttaaaggaagctagccaataaatgttttgttgttttatttatgtgaggacttttatgtgtgcacttcctgtggagttagagaacaatttttagtgtcacataggtcacttggagcatctctaggaacaaatatttgagtcgttcagatgcctgtgtgtgccatggaagcattagaatcacctctagtattcatcgttgttgagtgctgaccaaaacaaggagcggacttctattgtttttccctgaatgaatttattgaggactatgtgttagataatgaccttgccatgttatttttttctctagaggttttcattagcatttaaaagcaagttggggccaggcatgtggctcacacctgtaatcccagcactttaggaggccgaggtgggaggattgcttgagcccagaaggtggaggctgcagtgagccgtgattgtgccactgcactccagcctcagcagcagagccaagaccttgtctcaaaaaatagtttttttttttaaaaatacaaatcttccatgatatattaaattcaaccaggaaaatgaaacacacacacacacagacacacacatgcatgcacacacaatgctgggaagataatcaacgaggaagaaatcgtttagctgttgcttgaactttccagcagaaagttcctccaagagcacctcctgcttccatattctgcttctgtcttcattcattaattatttacatcaaccatattcttctctgccagagatcattttcctgattgatggcatctggggttctctacgcaaaagtattttaaaagctgtttcagggaaaatcatttttttcttattcctcatctctcaatttttaataactcttagaacctacagctaatagcctctcttagttgcctgtctgttgtttcctattttgtattcttgatacacatgtgctgggaatctgctattgtacatacctttgaagaaaccaatttgctattgtacataactttgaagaaaccaatcttttatttctcagtgagaatgtataaaagtgaaatcacacctatggaaaatccacattcccgatgagaaggcaaatcttaaaattgggaggactaggaggattgaattaaattataaaagtgagtgcattttcactcatatattcctcttatttccctcttcattctcctcctaagcaatctcatccaaacctttaattgccacctgtacactaacaactatgaacattctacccctgatccaagcagcctctctgaggtaggtaactgatgtctcctcttgatgtctcatgatatagaaagccatctgctaaccaggtctccttccattatttcttgtattcctgaaccaaaccaccctacatccagtttttccactcagaagctctccttctccctcacccaatcattctgtagctaatcctgatgatgttacgtcctaaatatctctcctatttgacagctcacttttatccctgctccaagcttcaggcatctctcatctcgactattgcagttgtctctgtcttggtctgcgactggtcctctcttgctgttcttcaatgcatttcactttgaagcttgaagtgctttagttttttggtttcaaagctcaaatatggtatgtgtaaaacccacccaaagcttcccattcctttcaggatgaaggtcagtattcttagcctggccttcaaggtcaacctacctcaaggcttttccttcactcctgagtcttctgtctccagccatgctaactttctctccttctttgagtttacaactgttgtcatattcccagggtctttgcatgtgctgatttatctgccatatacactgccagccgcatccctcctgtgccagtgcaagacctcgttagttcctctgggatacacttttagagtgctgtgcttctttccttcagagcgcttatctcagcatgaatgatccatttctttatgtgattgttaactaacatcttcacattagaccctagggtccataagggcaagaacgtacctgccctaatgaccattctctagcacctggcacagtgcctggcatataatttgttgaaaaaaaatgaatacaataccttttagggattccttcagattctgcttgtactgatagagacgtttcatatggaacctatttctctcagaaattaaaacgttgataactctcaagataatattttccttcttcagtgtaataaccaagaaaactgaagagtactctgcagtctaccaagaagtttgtgagttatttgacccttacagcaaatgtgcaaggtaaaagatgcagagttctgtagtaatttgctgatattcacatagatctatcataggtgggactggaacccgtatcttttggcttcgagttaaaatgcctctgttgtgcaaagctgcctctaaagtggcaagttcagagtacaccctgtaaaagtgtttatacaattctattcatttatatctagcatactgtgttcccctatattaagtgggatgctttaggtgcatttctgtgaaggactctggtttctatactttaggtgcatttctgtaaaggactcctggatcaccccttttgcccctactacttacactgtggtttatcttttaaaacaattatacatgtgattaatatcataagctcttgcttaattgattacctgatattatctctgaggctgaggtcatctaccttttaccttctacatatttacattcctgttttagatatgacacattggccatatgaatttactctcattcctaaaagtaaaaatataacaaggtataaaccatggtagaagagaatagagagaagatatcacctgtcaagagattttaacacattttgagaagaaagcagatggaggaatggcaactaatttagcagagtggaaggagctttcagctaaattgcctccatgagggagaatatattaaaaaaacaagccctcaaaagttctgagagttctgggacatcaggtacagggaagagaaggtacaggaaggtgagcttcatggttggaaagacagagatatagtgaaaatttagccatgctcctctgtcctgggccctgaatatccaaagcatgatgattactttccaggtcagagactggagattcttctctggaaattctaagccattgctccaaagaaaatcccagtcagatcatttatttattcatttagcagatatttattgagttccaactatgtttactgttcaaagtaccatgaataatgcataaactataccattactcatggtgcatatcatctcatggagagaaatgatgaacacataaaaaaatacataatgtgattttcagtgggaataaatactacaaggtgacgctgctgtggtgagggactttttttttggcatcattcttatattctttgatcagggagtaaaaatatttggcagaacgagtactccctagccccagtgaatcttcacttacctctcattggctggtacccttagatgcaaaagagcctggaaaaacaagcatctatctgagaggaataggacaaccaggcctagcttagccctaacagattcatcctgtagctgaaatgtggtcctagcttagccctaacagattcatcctgtagctgaattgtggtcctagcttagccctcacagattcaccctgtagctgaattgtggtcctagcttagccctcacagattcatcctgtagctgaattgtggtcctagcttagccctaacagattcatcctgtagctgaaatgtggtcctagcttagccataacagattcatcctgtagctgaaacgtggtccttagtaaatcaaggctctcatcaagggagaagaaagaaatcacttatgtggaatcaacagacaatgtctgccataaacttacgcttggattgcttgaaagtttgaattgtctatctgttggtttctctcgtttcttttgaaaatgcaaagccctctgatggttgtatgtcaatacagctatattgcatgcgaggtcatgtgactcagaatccgggttaagagagcaggatgtcagaaagcaatgagaatgttcattagtgtattaatctgataggtatgtcattatttatttactcaatacacattttacccagtcttgttatgccccaagcccttgagaaacaattagatgaaagatagttgctaaatttgttgagttctgaacactatattcctggcatgattttaattattttacatgtataatcttatttaactttaataactatgcaatgggaaaggtactaatacttacatccatttactgatgaggaaattgaaggtcagtaactaactaatccaaggtcaactagggatgtgggcctaaaaggtctgtttctaaagcccatgcatgtaaccagtaagctggactgctgagaagaataaataacagttcctatggcacactaagtgaacaaagtaagagatgataatgtggtttttaaggtattaactgtatagtttttataaggattcatataattttcctaaaattttgttttacatgggtcattctaaattccagttattcaaaacatttaaaattatttcagagatgcagaaaactatcctgataatatagacccctctcttaccctcctaataagactctttcttccatattattcccaatgaccctaggagggaggatcattgttatctgccttctatttagagaagcaaagtaactttcttgaggtcacatatttaataagttagtaaaaggattcacatacaggtttgctacttaaaccctatcctctacttgctaaaagtctgccagagttcaaatctcatctctaccacttgctagctgtgtgaccttgagcaagttacttaaacactccatgcttctctctgtgttatactctttttaagtgtataagtgggcttttcacagcacagttttattgaacacctgatctgtttacacagtagatgttcagtaaaaaataccttcttctttacccatgaatttatgttttatttccccttcttgtatgctagatctgttttgtatcatgaaggcattttagtttttcattctaagatttagggctcattcatttacctgtatgtatttgcatagccagctgttcctctcattcaaaaatatctatggaatacagtgttcagctgcctactattttcccatgcagattaattaaagtgattagtactaaaagcggtaaaattgcttgtctttttaaaaactgcttgatgatgaaaagaattaacatttatccaaaaattcctgtgtctttaataataattttattacaggaacactgaaagtaaaacctagagaaggtctattatacataatgaaatgcaattgtgaaatcattttatctatgtttagaaacattctgcgaaaatattcatttaaaatagcaataaaagaataattaaatttctgtgggaaggaaatgttaacacaccttttaaagaagtaatcagtcagctgggcatggtggctcatgcctgtaatcccagcactttgggaagctgaggggggtggatcatctgaggtcagaaatttgagaccagcctgaccaacatggtgaaaccctgtctttactgaaactacaaaaattagctgggcatggtggtgggcacctgtagtcctagctactcagtaggctgaggcaggagaatcgcttgaacccgggagacagaggttgcagtgagccaagattgtgtcactgcactccggcctgggtgacaaggtgagactctgtctcaaaaaaaaaaaaaaaaaaaagaaagaaagaagtaattagcctctatctgaacaaacttccagagttaaagctattgcgaagtgaaccactgagaaatatttaatgtataattgtaattgagaagttaattttatctcataaggatggctgagcttctgaagatcaagaattaagattttgatatatgctgttttttttaaggtaagtaggcacataaattataactcaaggaactaatcataggtgttcacattttatgtagttccaaactgtaatttaattttttcagcttctgattgtagaaaatgagcaagaagacatcagcagagataggagaataaattaaaatatctttttttaaaaaaattcttacatcagtctaaatatatcttcactagaatacagttaccaaagtatagtctgataattcctgggggttactaagatcctttcagggatctgtgaagttaaccacaatattaaaagtggtaaaatgttacctctttttaggtacaaggatgtttttgcctttttcacttatattctcacataggtgcacagtggagttttctagaggctgcatgatgtgtggtgatgtcattgctctgaggactaatggaatgagcttttgtgcattcctgtgctttaaaactttgctcaaatttttaatacagtaaatacacactgatataatccacataaatgaaagaactttggtgtcctcaataatttttaaaagcataatggatctctaagaccacaaagtttcagagccactgctctagaataagatcgctcctggtggatgacaggatcatcttgcaagagctgttgacatccagcctgttgaagaaaggggaccacatgcatgcctgaggagtctaattttctctgtcaagatcattacttggtatgtattatacaattatttgttcctggctagaacaaaagctccatgagggtaagggctttttgactgctttgttcaccactctatgcccagggcttataacagtatctagcacgcccccaatatgcatttgtttaaatttgaaagcattgattaaaatctaagacattgaaatatttaactgtttactatgtgctaaccttgttatatatattatctatagtattcccagaatccctgggtggaagatacattatctccattctgtttaaggaagtgaagtaacttgtcccaggtcacacagtctgtcaggggcagcctaaggactcacacattgccgcctctgctccattggctccttgaggccagataagtaggggtgtgtggcagatatcacagatctaaggagttcggtatagaggggtcaactcatttggaagaaaacaacagtgcattctagggataggtgcagacaagcagaatctgatgcaaaggaagtcagggtcagagaagaagaactggaggatgggttggtaaactgagtccatgacaaaggcaggtcactttctggcttgttttatgccctttgcttcagaggcaggacaccctagtgattaagatgggaggattggagtttgtctgctgggatttgagtcccagttctacttgcttgctgtgtaatgtctggttagttgcttaagctttctgtgcttcagttttctcatgtgtaacatgaatgtgatgataatattcccacttaccttgtgggattgttttgaaattaagtgaattgataatatttggatagtccttaaaatggtgccatgctcttactaagttctatataagtctatgtaagtacgagcagttattttattggaaattgtcaggggctcatgaaacttccttgtaagtaaaagggatgaaccaggtttcagtggagtcagaggcagggctgctgggatggtggtacagagtggttagctcgcaggttcgagaaccacacttttgccacacttattggctgcgtgttcttgggttagttacctaacccttttgtgctttagcttccttctatgtaaaatagagaagacaagagggctgatgtgattgaattatgtgaagtagtaagttaatgaatatagactgtttagagaagtacctggaccgtggtatgtggtatactcaatgtagttcttactgcatcatcagattatgccttcagtgattggaaaaggaagttcagtctaatctcagaaatcaaagatgtggcaaaaattgtaactatctaagacaataggatttaaaatgtgataatcagatcacaataaaaacaatgagataataaggtacccataattaaattacaaaatgtataaggaaacaggttaatgatttatacaagtagatttaaaaaatgtctatcgaaggtgaaaccctgagtattgacttcagagaggaagggtcagtattctcgagctaataagtccatattataccaaggaagaggaaagagctcaccagagttgtggataagaatcaaccttcaagaaggaggagaaatagcttggtctcatcttgtctcttttctgttctctcttgcttttttctttgttctatcctctacaatattgaaaagtgtaaaatacaaacactataggattggccatctagagtcctgggttttagacttggtctggtctgctataatcaacagtgtgatcttagacaagccacttggcctcctgggaccccagtctcctcatttggaaataagaaggcaaattatcttaagagtcctttcttaggctgattcttggaatcacctaaacaatccacaaatactaggacttcctggaataaaattaggaatccagatggtctaatactaatgcttagacccactccttcaccaaggcactagataccccaaatgaaacacctggacctccccaggaaccaaggtcctctggatcctctggcctgacagtcacaggaggatggtctgagataagtctgtctggtcctaaagtaatgcatacttgacaagaagttggttatcttgacatagcattactccttgtgaaaaatgcccttgagagctttgtttattctcttcacctcctcatcagtagtactgtgctaacatttctgttattcatcatgttttaaaattagcttcttaatcctcttaatattttcaacttctctgccttgagataggcacccagcctgaacttggttttctgcagcctttgtacagcatataaataacaagaatggattgttcccatagccttggcttcttcactaaattaactacatttactcattactcttatttttgttcttggtggaatagacctaaattttctcaactaaatttggctttgaaattctatggtatgttctttatctccattcactttgatgttggtagctttttaaatctgtttggaacatgtcttccttcgtttttaaaagcatcccttttctatgaggctttggcttattttctttttcttttactagcttctctttcttctctactccctgtcttagtccatttgtgttactataaaggaatacctgaggttggataattgataaagaaaagaggtttatttgttgttctgcaggctgtataggaagcatggtgccagcatccacttctggtgagggcttcaggctgcttccactcatggcagaagaagaaggaatacagggatcacaaggctagaaaggaggccagagagggctgggccggggaggtgccaggctcttttttacaaccagctggcaggagaactctcgcaggaactaacagtgagaactcactcatccccaccacccagggaggatattaatctattagtgagggatcctccctcatgaccccaacacctcccattaagccccacctccaacactggggatcagatttcaaatgagatttggaagagtcaaacaaaccaaactgcagcactccctaaggcatctattcttatggtcctatacgtagctcacttcttatttctaaataattattttccttggaaattatatttactaacagttttctatctcctttaagcagatgatgtttatgttttgatatttatttatttttatcagctggttactttcatcattcattagccatttattgagtacctattatgaattatgtactgtgctggtactaaggatataaagatcagtgactttctctacttttaatgagttctaatggagtctcattgaagtgacagacacagagttagataatgccaacccaatataacatgctaaactaggatgttaaacaaactgcttttggaacctggagaagtgagtaaatgacctctgaggactatcaaggaaagacttcctggaagaaaggacattggcagtgggtattaaaagttgagtaggagtttgtgagttgcgacatctcccaacttccttctgctctgttcactctgatgtttcactgtcatcttaaatttaacatgtcaaaagtcaaattctttatctttcaccctaaattacttcactcacttgagtttcctattacattattctctgaatcatccttttggcgtttttgtctctttcctctctgttgtcctgctgtcagccacaaagtcatctgcgtgctttcttcattttttcattcagttgttcccactgccccagacacttcatactctgccacctcctgtctgggttattacagtggactccagctgattaatctgcctaagtttactttccccatttaatctgttttgtacatcattgcccattgctctttttttggatatcagtttgattctgtcactcatctatttagaaataatggcaaactggcacttgctcaatgctgggatggtttgtgaagtaattttaaaaaatgttatctcatttcattatcaaaacaactttgtgaaataaatactggaacttactgaatatcctctaaatttagaattcagtagtctatgagctcctgtaaccagggatgacatcatgttcatctcagcctccttagtgcctagcacagtgctgattcataaatgatgttaaaaacacattatggattcactcctgcctagtgtctgtgcatctttatgtgcccagttaaaaatagttgatcaggctgggtgcagtggctcatgtctgtaatcccagctgtttggggggccgaggagggcagattacctgaggtcaagagttcgagaccagcctggccaacatgataaaaccccatctctactaaaagtacaaaaaaaagtagccgggcctgatggtgggtacctgtaatcccagctacttgggaggctgaggcaggagaatcacttgaacccaggaggggaggttgcagtgagccgagattgcaccattgcactccagcctgggagacagagtgagacaccatctcaaaaaaaaaaaaaaaaaagttaatcagaagacattgaaatgacattataaaaaataacaggacagttttgccaatatttccagtgctgattccacaccctgctcagcagtcagagaatcacttcttcatgctgtgattactgctgttgctgaaccgctcttgagcctgaagattcctgatggattcttaacagtcagtgctatatagatacagaaccactccttgcaaatagctccccttaatgatgcaaccaagactcttgcacacggtagtctgtattattcttaaaatcagactcaatttaattgtcttgcatggattttagtgatacgatgataactaaaacatttgtttaaatgctctagtctttcaggttttgtttttttttttaatgtgagggttgtatggcttataatctgtactctgtttatctgcctgtcttaactcctaacttcataggaaaactggttgtagaagggataatattaaatatacttaaaaatattaatgaagtaaaataatttaagtcttgtctgcgagaatttgaaattttaaatctgacaacacagtgaaaaggatctgtctactcttgtctggcatgaaccaatttgggtaaaaagactacatgacttttttggttgttaatgtttttatgaaatcatagaatataatctatactgaattttgaaaggcagtttgccaacacgaagaataaatgaaccagcaaactatttagaaatgtgcttgacttatttatgttctttctcagccaaaatggtttgaagacgtgaggctttctttccaagagtccctgctgccatctgctggtcttcattattcagcagccaacttctaaatggagtctggatgacatggttccatgagatatgattttcaggggaaaaatattttgtaattttattatattttaaaaatagaagtaatactaaattgagattaaataaacaaataatctgcttagaacaatttatttttataaaatcttgggcaaaaatttaaaacagggtcccagggaaagtcatctttctcatattaacatgtaccttccgtggatgaaatcaggtggtttgaagctgtgatagattggttttgaagtgaagcaagctccaaactccggtactctgtgtgtggatgaggaagaagttggaatattgggagaagagcatactaggccttctaaaccggtggttctcaagctctagcagaatcagaatcacttggaaggcctgtttgaaaaaaggttgttgggccttatctagtggtatactattaaatgctttacaactggcttattggttaaaaggccctgatgtgtagcatttgctgacttccatggtgtaaatgctcccgctgtggctggtttcaaactttccacatggcatcactaaatgtagggttgagaagagatgtactgtagctcactattacgtcgtattttcaccatatgcctacaatatatgcacacggcctgaagagcacagattgtagccaaattatgttattttcttttttcttttgggcttttttttgctatctcggctcactgcagcctccgcttcccaagtagctaggactacaggtgtgtgccgccacgcccagctaatttttatatttttagtagagacggggtttcaccatgttggccaggatggtcttgatctcctgaccttgtgatctgcccacctcggcttcccaaagtgctgggattacagtcatgagccactgtgcccggccaatcacattattttctaaagaagcattgaattttgagtatttattatttctgtcttaatccatttacctgcaactgtatatatatatatatatatatatatatatatatatacacacacacatattttagagatgattatatttaacaatcagccgataaaattcctggaaatttaagccactcccccagagtggatgggagctggctcctagcacatgactagttccacctgtagagtgtctggtgtgggtcagtgggtctggggacactgagactggtcagacgagaatgacaaaaagatccacgtagtcattaaagggtggttacaaggcactgattgtaaggaggggtgggatatgaaatccaaattttgtaaggaattgaggacgtggagcaagttactttgattctggatggcgaaaaagtggcagctttaatgattagagggctgaatgaagtggaagaatttttggaagggtcagagaggaatatttgaagtgtttattatttccgttttaattgattaacttgcacatttatataacttagtttttagtgatggctttagagttttaaagtgtttgctttaaaaattcaggttgtttgtctctgaccttataatggacgttagatacctaaagtataagatattttgttaagataatgttatattactatattatcataattttcctttcttgaagtttaaataaggatagtgataataatctcatatatgattaatgtcaaatgatgtacaaaacaaaggtgggatttgtgagagaacattggcatttgcaccagacagctggattcaagtttcagattattcatttaatagctgtgtgactcttatcacagtaaaaataaataaacaaatctaagcctcagttttctcatcagtgaaatagatctaatagcttctgcaattaagtattgcaaaaattaattgtgtgtgtaaattacctggcacagtgcctggctcttaggaaatggcagctttatttttattgtagtagcattagacctgtcacacaaatacttaagacagcgttttagttcgtttctctgaaatacactacccccaaatgaaattgaatatgttggattatgtcgataagattatatataaggaattagagaaaactggaacatcagtgttttaccccagctcctgtattgtttggggaacagacttcagaaaatggccagaggagtaatggcaactgaatgatagagggattctttccctgcagttcttggttatcataaatgaagagtgtcctgctttttatccaaattgatatgtccctttcttggttttttaaaactaaattttaatctgagttcattatcataatctttcttcatcaatttgtttctctttattgactttttaatcaggaggcttagaaacaaattatagctcttaaagaataaatcttacgtgagagctctttgaggtaagatatgcacatccaaacaacagtgagatatcatttttatctctcaaatatgtgaagtgaatgaagctaacactcagtaggggagaacatgtagtgaatccttcatgaaggattgtaaattggtacctttctgaaaagctgttggacaatacagcaagagtcataaaaatgcccatgaattttgacatagcattttccatctatgacacatgtattctccatctatgcatttacttgaaggaaatagtaaagcaatattggacaaagatttaggaacaaacatattcatcacagtgaaaatagcaaaataagtatggaagaaataaagtctagcaatatgagaatggtttaaaatgatggcacatttatgcaatggtaaatgctgtaagattgaattttttggacaaaaattataaaactgaatgttttttataatctcagttctataataagcacagaaaaaattttggaatatctatcaaaacattaaccattgttatcagtatggtagaaaatcagagcaggacacggtggctcatgcctgtaatcccagccctttgggaggccaaggtgggcggatcgcttgagcccaggagttcgagaccagcctgggcaacatgatgaaaccccatctctacaaaaaataaaaacattagctggggatggtggtacatgtctgtagtcccaagtcctagccactcggaaggctgaggtgggaggattgcttgagcctgggaggttgagggagcagtgagccatgattgtgccactatactccagcatgggtgacagagcgagacactatctgaaaaaaagaaaagaaagaaaaaggcaatcagacaactttcattttgttcttatttaaaaagctatctattttccaatattctacaataacaatgtttatttttatattaaaaatgaaactttaaaggatgttaaacttattgaggaagaaggtaccatactagatccttccacttttgaccctcttactctttgcttacaataattgaatttctgccattccttcattattggaattgcttgcttagaggtgattggtgccttaagtggtcaactgcaaagacctcttcttagcccttagctcacttaattttttacaaaatcttacttaatcgatttattctttattcatattaaataacagctttattgagagataattcatatacagttatccctcagtatccatgggttctgaatccatagattgaatcaattgtgatttgaaagtattaaaaaatactgtgtctgtactgaacatatgcagacatttttcttgtcggttattacctaaacaatacagcataacaacaatttacatagcatttacattgtactaagtattataagtaatctacagttgatttaaatgatccaagagtttgttagtagttatatgcaaatattacatcattttatatcacagactcaagtatccatggattttagtattcataggagatcctggaacaaatctctcacagatattgaggaacgagtgtatatgaaattcattattttgaaatgtacaatcattgttttgtccttcacatgctcatctttttgaacttctatgactgggcatcaccctagtttatttattaatttttttttaaaagtcattgggtgccacctatgtgctaggtactagttcctctcctaactctcctttttagtcttctttgctaaatcctcttcctctgcccagccctcaaatatcaacatcctccaactctattctcctgttcctccatagtttgtttatgcaaatggttctcacttcacctttgctcaggatatctcctgaatctattcactcacatgtgctactgaggcctgaatgctcacaggtctgggactatagctgaacttaacaccctgtgtccctgcatacagcttcattcctgtttccccttctgttttccttatctcatttatggtgtcaccgtcttgcaagccaatcattgtagaagttttagagacatgtttgattcagactgtccattcaatcctcaaatcttactgattttaagcgtcttgattctatacccttaatccgttcctacagctagtgccctggttccgccgtcatcagctcagttctgctcatgtggatagtgcagtggtctctggcatcctgactctatcctccgcagttgccagggtcaccttcctaatggtagccatggttatatcattcttctgctccaaaacctttctacagaataaagctcaaaccccttgcctcagtaaccaaagacatacatgatctggccccagtctacctttccaggactatgtaccactagggagccctgtgatacccatacaatccaaccacattagagaattcacaatccataggcacattctcttcacttctccatacagtgcacttatttccattgtccactcctctttctttactaattaaaatatgggaaattgtattagagttctcaatagagaaacagaaccaataggatgaatatatatatgtgtgcacatatatagacagatttgttttaaggaattggctcatgagattgtagaggctggtaagcctgaaatctgcaagggaagccagcaggcttgagacctagagaagagctgcagttctagtccagaggcagcctgctggcagaattccctctttctccagggaagttagtcttttctctattaaggccttcaactgattagatgaggtccacccacatatggagggtaatatgcttcactcaaagtctactgacttaaatgttaatctcatctaaaaatatgttcacaaaaacacccagaatactgtttgaccaaatatctaagcactgtgacctagccaagttcgacacataagcttaaccatcatagccatctttcaagactagttcaaatgacccaacttctaagaagtcctctgtcatttctctaactacctctaactttcccacctttgcactcccatagccattggtctgaaaactttaagcacttaccacactttacaaggcctttgcaatttgtgtttgtctatctcccatttacactaatggcagctattgttcctcatttatatttgtataattcatgatatctgcataagagtctatgcaaaatgggcacttattaaatatatttagaatagaaaattaatttttaaagtcccatttacagaacctcagtctcctcactggccagcatattggcattttaatctctaattttgtctctaatgcaccatgtccagagtccctacagattggcccattactcccacctccttgctacctttcatatctctgctaaatctacacaagcatttagttacctattctgagagccgggtggctgggggccgtggtcttgctataagagccaaactaatagagaagaaaactcaaggagtggtcaccaacctttgtctttgtcccattcctgactccatcccaccgacgatattaggtagcacttctctcattcaaggaagcctcatctttcaatctgtcaggggtcggtttccccagttcagtaagaagtggttcaaactgtgttctctactctgtaatcataaagagacttcatttccaagaaacttcacatgtcagcatcctcagcaggaagcaaagacaggaggcagggccatttggtgccgttggagccagctctgatctaagggatccatcaacccatagtaaatcttatatttctaagatcatatactcgtacaggcttattttaacccaaaaattcttttataaaaaacctcacatacatgcaattgcatttatactgttgttccatcctaatgattttcttcaacaatatcttccaagtgagctaatccacaagtatcaggaggacttaactgcataacagaactgaagggaatttcacataaaaaaaatcttagcaggaaatctttcaacagaactgcctaccgtttctaatttaattagcctaattaatagatttaaataccaactaattatcttcatgtttccaggatgtaatctgtcctttaaaagatgcacacttctgctcttattttattttcattcatactgtctctgagaacctttcattaaatgctgcctctggtttcaaatgctgcccctctcctccttagttgaaaatttaaaatataataaagtctctatttttctttctacttaagaattcctgtgggtatcagcaaagttgcttttctttagtaaaagttgaatctacagtgctacccagcttattcattgcatcttcatacagcaacaactttgattaaagacaatcatttttaatatgaagaaagtggattaagagtaaacataagaacacaaagccaagggattgttttataatttattcttgcctcacatggctctaagtgaattagaaagtctaccagccctattatatcctggtttacccacgccctctggcttcctcctctggcaaaagctatcattctctctgttcctagcaaaggcccaacaacccctctactggtctcagagtcccaactcctcttgcctcctcatcaggcttccctccctgctcttccactaagacagctctcatcaaagcaatcacaaccttcgtgttgccagacccagcagttgtatttttatgttcttatccttcttgacctctcaagaacgcttgatgaaattgaccactacttccttctcaaagctcttgacttttgtgacattgccatctgttttcaccttcctcattgctacttcttttcagtgtcttattctcctgtttttcctctgctaaatttggagtgccccttggagaagttattggctaccttctgttttgtatttatacatcatagttgatctcattcagccccatagctatgaatgccatctcaatgccaatgatgccccccacaatctgtacctctagtctcaactataccccagaactccagactctcagatttgtctactgaacattcccatataagttggaacttcttctcaaacttaataaggacaaaacagactctagatatcccaccagaaagctcgttttcctcaccacatctcagtaaatgctgtcaacacctactcagactcaagccaaaaatttaggagacactcattatttcctcctttccctcttcttaatatataatccatatacaagtcccaggagatctacctcataaatcctggatcaaatttcttcaccctgtctccaccactaatattttagatcaagtcaccattgtctcttttccgtagtaatctccctagctggtattcctgcttccactgttggactgcctacaatccaggctcttcacagcagccagagagacctttacataacacgaatctgatgattatgtcaattctttatttaaagccctccaatcacttcccatcatacttagaataaaattcaaactgtactctgatcatacctgccaatctttcagactttatctctaaccattctccttgcccattacatttctgcacataattttttttgtttcttgaaccaactggtctttcttcctggaatactcttcctcttagtttttataagattaggtacttcttttaactcagatctcagcttcactgactcatccttagagattggacttactctcacatttctctttttttcgttctctacttggcaataatctgataaaacatctgatcttatttattggttggttggctcatttttctgtctcccaaaacctccatgacagaagaactttgtctgtactgttttcttctctagtccctgtgcctctaaccattttttaatgaatttattgtgataaaaatacataacataaaatttaccactttaaccattttgaagtgcacagttctgtggcattaactgcattcacgttgttgtgcaatgatcataaacacccatctctagaactttttcatcttcccaaactgaaactctgtacccattgaacaatagctccccatcctcccaggccctgtcaatcacgattctgttttctatctctgaatttgactacactaggtgcctcattgtgtttgacttatttcacttagcataatgtcttcagggttcatccatgttgtaacgtgtgtcagattttccttcctcttaaggctgaataatattccatcataggtatatgacacattttgcttatccattcatccctgtatgggctctgtatactatatgctatcggctattctatatgatcttcccagaaactgtaagttcttctctcactatttgatatttgaaataagtgagcacttttgaaggctaagtgtttgttaagggtcacatggtgaagaaatggggttgttgatgggcaaacttggacctgcctccctcccaagcctgttctttccctgctgcccaccatgctggtgcatggcaaaaggcttttcagtctgttgtcaggataaccataatcatggatataaaagggctttgaaattgatagatagcttaatataatatcatccttgttaaaactgaatatttttgaaataatattattaatgtgtttttgagtagttcaaagaagatttgctgttataagatgggatttttttcacaaaataagaaaagcatatttcctgcaggttattcctatgggccagtttctaatctggaacctcgcctagaatagacattctgtaaatattagaatagtaacaggcaaaagatttccattttaagagctgtttccagtagttatgtaacaattatttctcagacatgcctttttgccttgtggccagaaggtggagaaagacgatgtcaaatacttcacttgttgtttcctgctctgaatttttctcaccaatcctggttacctttttttaccatgtcctaatctacttcaaatgtacgattgaaaatagggtctattattgatatatgttagtcagtgttctccagaaagtcggaaccagtaggaaaggtacgtaggtaggtagatagatggatgaatgagtggggatttattaaggaaattagcttagcaatgatgaaggctaagtcccatgatggaccttctgcaaattggagaacctgggatgctagtagcatggctcagttcaagtcagaaggccccagaaccagggaaactaatggtataacttttagtctaagcccaaaggcctagacttttagtctaagcccaaagaccctagagggtcactggtgcaaataccagaattctaaggctggagagctggagttctgatgtccaagggtaggagaagaagagtgtccctgctccaggagagagagagagagagaaaacaaaatcacctttcctttgccttttgttctgtctgacctccagctgattggatagtacctgcccatgttggtgacagcagatattcctaagcccactgatttcaaatgccagtctcttctggaaacaccctcacaggcataataagaaataatgcctttccagctatctgggcatcccttagttcagttaaattaacacctaaaattaactatcacacgatatatctcatatcaaactcatatatcaaaactttgatcaaaagtattttatgaacgtttatgtacagaaaagaattaaaagaatgtatgatggaggaaatagtaaaatgttggcatagttcctggcactcagcaggctctctgctcataatgtacataatgaactaatgaatgagtggtgcatttaagagcctgttatagatgaagatatattggaaaaagtgatctagtactttcatggttgcaaactgcagatgcctttcttggcctgtactctcttgacaatgtggaatgaacatggagagtctagtgtatgtatatatagtttgtgtattagaaatgtgatcccacaaaagtcaattgaaaacattaatttaactgctgccaaaatgggttaagtggtatttaaagttcatgaaggaattaataaaactttgaaaggtgaataataatgtaaaaataagttcagtattatatttctgatttggttatataacccttccatacttactaaatgtgatttttagttattgctttcatatatacctgtacaattttattcaaaagaaagtgtatctatggaactcggtggttaaatgagaaccttgagaaatcatgttagaccatttcgtttctttaaacagaattgttaatatttgtgtcttcccctaaagactcctaagggaaaaacaacattttccttcaagtaaatcagtatatatggaatctattttattagtataatttaaaaacacatcttagatagtggcaaatgatcttcatttggtttttgcagtttgatatgtctctatgaaatttatataccctaaaatgtctcccaagacccagcattttatttaatgactggcctttccttagctcatacttcattttctgacatgtaagaacaatgtgtaggagtaaacaggataccaggcatccatggaaggatgatatttttcttggccaaactatctcctgttggaaaaataaaaataaaaacaaaacaaatagaaatttttgtttccttgccaagcctctaaccagttttttttaaattattattccttattgtctggtattcatggtggttggataactcagtcagatagagaaccaaggcagagaggccaaggagctgggttccttctctttgtgggctggcagctttgctccgtttgggtggcaggaatctgtagccaaatcttggtcaatgcactaagagtcctagtggcagtgcctagcatctgtctttcaccattactagaaaacagtaacaatgctgggaatattgcaatgacatagagaatcttctatatgtgaagggcagcacatccagctcttcttttgcaatatagagaagtcaggctaaagtgctcagctagttagtccccggcatccaaagcaggacaaagagaacccgtgttgctgtgtgagcgactcgccagctggtaccatctgcagcaggttgccacaaagagcctgcagtcatcacagctgtttagcctcatatcggatggctctaaacatgtaaacaggtacctgagcaaaattatgtagagctgaacagtcggagccgcccgcagggaagtaataggagcattgtcgaaggactttaaaaggctctctccttgaggtatctgacagaggcgcccttgaaaacataaaatattcgtgattccagaaggactctgaccagaaaatcctcagaagttgttttataagcagcttccctcctgagggaataatcatggattttgtaaatatccatctcaacatactgatgactgaaaaatcaaagctgctgttttccagatggacaatttcagtgctggatggcatttgaacttccagttactcattctgtttataatcctttggggcatgccaagtttttaatttttacgtagcactccatcaatctttttctttttactctttctctttttggaggcacgcttctaaaggtctgctgcatagcaaaattatgcaatctcacctttaggctaaggtttgggtttccaaacttggttaaatataaaattataaaatcacctaagtacatatttcctgaccctgttgcaaagtaggacattgatgtatatgaaataaaatgatgcacaattagccatttggaaatggattcccttctctcaactctacctatatttttaccacctcatcctccaagatgcactccttccataaagcagttgcccatagcaagacgagctctttcatttttccaaagtatgtatttttctgcttttactactactgtttgaatgtgaacttttaaagatgggatctttgcctgagtcggcttggaattttccatggggacttgcgtaaaacaactgttttaaaaatgtttacatcatcactggctttttcatgggaaatcaagacttcatttttgctaagatctttgtatgagtggttgctgcctgcatagaaaggatgtgatttttaaaaacagcagtatatactgctcttgattgactgcattagctttgtacctggtttcatctaaatttagctctaccaaaggtcctgaaagggaactctccctgtgttgtgtttctgtgtgctgatttttatctcctgtggtgcttctccctcttttctactcccctgccaggctatggctcctttaccaaacagttcagtgatatgagttgactaggaaaatagcccctgaatgccttccaggcactggggcacagtaagagtctcagttccatgccccaggagctcagactttgctttggggttttggagtccattttagaagtctctgtcaccttatcagacaggaaaggtctggagggaccagtttgggggtatttgttactgaatcgcccagcacataattgtgtacccagtcttctactgaaatattgtaatttttatcttggggaagctatctgctacctgtctaagtttttgtaacataaagaaatgagaataaaatataaaatgtcagggattaaagggctgtcgtttacactgaaagttccctgataatttatagccaagccattcaaggaagtagcctctataagtacataatgggtctttcaaagtgttcactgccaatttatggtaaagcaaaggcttttctaaaagaagaacattgaaacctgtttctctctgagttacttgtaagcattaagaaaaaagagagctgacagaaacattttcttttaattgccctaaaattcaaatagctgtccttggtctcctatcaaaatcattaatgccttgaaggctgagtgatcagtgaggactgaaccaagggtttattgctttgataaacacatttgaaccctaagaaagaaatgaaaacagaccaaaaaatagctgccagaacttaatgagatttggaggagtgactttatttgggaaaattaggtcatatatatacattttaaaatttgagtatgcatggagacccttttgagaggtgacagcgtgctggcactcctcagagccctcgcttgctctcggcgcctcctctgcctgggttcccactttggcggcacttgaggggccctttggcccgccgctgcactgtgagagcccctttctgggctggccaaggccagagccagctccctcagcttgcagggaggtgtggagggagaggcgcgagcaggaaccggggctgcgcgcagcgcttgcgggccagctggagttctgggtgggcgtgggcttggcgggccccgcattcggagcagccggccggccctgctgccccgggcagtgagggacttagcacccgggccagtggctgcggagggtgtactgggtcccccagcagtgccaacccaccggcgctgtgctcgatctcttgccaggccttagctgccttcccgcggggcagggctcgggacctgcagcctgccatgcctgagcctcccacccactccatgggctcctgtgcggcccgagcctcccagaggagcaccaccccctgctccacggcgcccagtcccatggaccacccaagggctgaggagtgcgagcgcacggtgcgggactggcaggcagctccacctgcagccccggtgcgagatctactaggtgaagccagctgggctcctgagtctggtggggacatggagtctttatgtctagctcagggattgtaaatacaccaatcagcaccctgtgtttagctcaaggtttgtgagtgcaccaatcgacactctgtatctagctgctctggtggggccttggagaacctgtgtgttgaaactctgtatctaactaatctgatggggacgtggagaacctttatatctagctcaaggattgtaaacgcaccaatcagtgccctgacaaaacaggccactgggctctaccaatcagcaggatgtgggtggagccagataagagaataaaagcaggctgcccaagccagcagtggcaacccgctcgggtccccttccaccctgtggaagctttgttctttccctctttgcaataactcttgctgctgatcgctctttgggtccacgctgcttttatgagctgtaacactcacggtgaagatctgcagcttcactcctgtgcccagcgagaccacaaacccaccagaaggaaaaaactccgaacacatctgaacatcagaagggacagactccagatgcgccgccttaagagctgtaacactcaccgcgagggtccgcggcttcattcttgaagtcggtgagatcaagaacccgccaattctggacacgctttcatctatgtttccccaacccgttataagatagtagtgtgagtcttagcagattgcaatttatcagtgtcatattttattgcaaaatggtttgcattcacctgttgtttaatctttacaatacactcatgagaacataattggttttcttcagtacgtggaagaagaaataaaaacctgtggtgcagtcatatatgggttatttgcttttcctatagatttccatggggaaactgatgtagcaatgtgttaagaaatctgatgatatcatataataaagatttcctggactctgacctccatttctctaccaggttagcctctatttatttatttttgtcttagtaacatttagcatccagcaatttgtttgtatcacatctaaaaagaaattggtagacacaagatcaatatatttagcttataccaagaaatatatttctaggctatattaaagatatacatattttatggtttctattaaatttctagaataatttttgttcaaacccacatttaagaacttgatatataacgtatagtaaggtactctagacctgatttgaggataaatgttaacaagagtagggtttctacaactttaaaatgttttcaacaactttaataagaagggccccaataacatgaacaaaaatatatttaggtacttactttacctgtaatgaattacttttatgtaacaccatagatgtaaatacttggtggctataaaattgtaaagattaatttatcaagtcagcatggtctatgatcaaacaagcactcatttccctcttccaaaatcacctctttttttttttgagacagagtcttactctgttgcccaccctggagtgcaatggtgcagtctcagctccctgcaacctcagcctcccaggttcaagcgattctcctgcttcagcctcctgagtagctgggactacaggcacgcaccaccacacctagctaatttttgtatttttagtagagacgggatttcaccatgttggccaggctggtcttgaactcctgaccttaggtgatccaccctcctcgacctcccaaagtgttgggattacaggcgtgagccagcgcacctggcctccaaatcacctcttacacacctttccaccccacctcttatgacacaaatgaggatccaacctcacctcatcggcccagaacacctactgtttctggaacactctacaattatccaaggagttttttataaaacttttttttgtaaaacgttttttactattaataactcactttgtgtagagatttattttaaacagcaggagcaggtaaagctagataggaatgaaaaatattttctagattctgtcctttgttggtagattctgctaaccttatctaaccagcaggtcttaaaaagcctgaagatccaggatcaagaatcaactaacagctctctggcttgcagaattttttttttttttttttgatacggagtttcgctcttgttgcccaggctggagtacaatagcatgatcttggctcactataacctccacctcccaggttcaagcaattctcctgcctcagcctcccaagtaactgggattataggcatgtgccaccatgcccagctaattttgtttttttagcagagacagggtttctccatgttggtcaggctggtcttgaactcctgacctcaggtgatccacctgcctctgcctctcaaagtgctgggattacaggtgtgagccatcgtgcccagccacagaattttttaaaaatcaaacgtaggctgggcgcggtggctcacgcctacaatcccagcactttgggaggctgaggtgggcggatcacaaggtcaggagattgagaccatcctggctaacatggtgaaaccccgtctctactaaaaatacaaaaaaattagctgggtgtggtggcgggcgcctgtagtcccagctactcaggaggctgaggcaggagaatggtgtaagcatgggaggcagagcttgcagtgagccaagatcgcgctactgcactccagcctgggtaacagagcgagactccgtctcaaaaaaaaaaaaaaaattcaaatgtagcatagcaacctagtatgtgtgttgtaggggccaagggcttggcactgtgaaagtctgctgaagtatcacctcagaaagggcagattaattggagagaaaggcatacaaacattaaacgtgtatacacaggagccttcagaataaagacccaaagatatgggggaaactgttcatttttatccttaggttcaaaaagtatggccagctgtgtagaaatatgtttggacaataagggtgtactctaatgttactagacggagtgggaaaacccagcagggcttgtctgtctagaagactcctcttgacctgtctgagcagtgttccttccttctgggtgtgcggcaggaccctctctgcaatgggggtcttatgacctacagtcaaataagggaggtcagatagttttgttatggccagttttacatgggaaggcagagacaaacttagagtaatatttttaggttttatggctggctttggggaaaagggttctggtttctgacttgccttggggaagagggattctagtttctatgaccaagctcaggggagaatgggactgagcaactggaaggcaggagggtagaggaggctcctgaggctgctccagaggccttcccttcggggtatcattttctgagccccaacggtgtacacacacaacacacacatatatacacacgtatatacttacctggacatacaacacacacacacacaaatttttacacagcacataataagtgcccagtgactccatgccggttggtaaactgaatccagctctttcaggcctctttgttgcttaaacttttgctgcttcagctttccagttacacacattcttaatatttaatggaaacattactcattttcccaaataacaagcactgttttttatgtcttctgtatttgtctatgtacttctacatgcatctcagactctcgatggtgtttttcctgctgacctgccatgacatgggctttgcatccaggcctgcttaggctgagctcacaagctgtgtgatggagcctctgccctgtctttcacaagtgtcctgttgcaggggcttgatcagatgtgtctggggaattccagttagtctccccccattatggaggcagaagctcagatgtcttacttctctggggctctcatgggaacagaaggaaggcacctgcttttactattactatatctatggtttagagttagtttgccacataactaaagatgtgctgacaattgtggaggatttagaaagcttcagggaaaagttaggatagacattaaattaacgctagctacttccacccgtatagttcgcagattacttggaaacagacctgagtacactgaaattgaggggcagcatggtcagtccccattattatataaattcaagcaaggacactttcttctggggaagaggtatgagggatcttttgctgtgcctctctctctcaggacatctcaatacctttgataattagagctctgaagatggatggatttatttgcacaaagaatccaagggaaggcacctgaatctctactgtctcccccatgttcaaactgtagggggacccttgtgggccctgacaaaggcccaggggtgatcagcaacaaagtccctaaagcaaggcagaaagagacagttctgtggattggtccctgcctaggttggaaggacagaggagggacaatgattctgggtccatgaggttctgatccaaacctgttggcaaacttgtgctccagggaagagttttgtgagtgaacagaagaagcagtaactttcccagaatgttcaacccactgtggacattgggctcctcatctgggtctaatttaactcctgggaacgtggctgtactttgtaccttcttgattatactaggctggtggttcttagaatttaatgtgtataagaatcactgggaaacttattaaaaatgccaagacctgtgtcctttcccagagattctaatagactttcctggaatgaggctcagaaatatgcatgcttaacaactatcccaggtgtttctcatttgggtggtctgtgaagggcgtcttttaaaaagcaccttgccttccatagggaatagcaaccaagatagagacccagccattcttttcttacaaatgttagggctacaaatggcaccaccattttaccctgctgctgtggggcagtggcccctggagctctgggcccggtctctcccaccatggcaaggtggggaaaataccctggaatttctgggccagtggatgagagatgctgatcctcatccagacgcaaatctggaatgactgaagatgctctttgctaaagttaaatcactgatcacattgtggcctgcgtactgagagctgagggcaagttctttcgagtttggcatgtctggtattcactactttctctagtggaaattctgcaaattttaatttgtgcagggatctatggtttttactagccagatcctggggaagggacaagagaaaaaaagcatcagcagccagggaactaatgagagagattgatttccaggcagggctggtctgccttcgcttctaagaacagtttagttcccagtattggatctctggtccaagataaatggtagtctgaggaactaggctgaaggagggtgagagggacctggtaatgagctttctaggaagcctggacccagaaggcttgactaagtgctaaggaaagtggaagatcatgtcagggagataaattggtgaaagctgggcagccccctcaccccacagtagaagtgatcatctgaatgggcaaggcagtggggaattgcactttgaggcagagtatagagatacactagaggtggaaaccagaggtgggatccagagcctggaagaatttgcagatgcaggagatgtgattctggttttccatggtcttatgtgaggaggtaatctgtgagacacatgagtgctgagccacctcagggattttgtgtgcaggaaagttcactttacagcttagtggtatggatcatgacaacccaacagaagatatgtccatccagaacctgtgaatgtgatcttgtttggaaaaagggtctttgcaaatataattaagttaatgatctcaagatgagatcatcctggattaaggtgatccctaaatccaatgacaagtgtagtgtcctgagacaaggtgaaagagaagtgggaaacacagaagagaaggtggtgtgaaaaaaatgaaggcagagattggagtaactcatctagaagccaggagtggagggattgctggcagccaccagcaggaaggagcaagtagtgagacataaaacagatgcacccaaagggtctccagagggaatcaaccctcctgacaccctgtttttagacttccagcctccagcactgtgaaagaatacatttttgttgttgtaaaccaccagatttgtggtaattggttaggcagtccagagaaacaaatacaccttgcctgcagttccccctgttaacagatttgggttgtaacagggggaattgcaggcaaggtgtattagttttcctggcaccttcctttgaaaatgcaaatacctcacaaaaaattaagtgtattagccattcaaagcagcttttattaatttaaaatatttttatccttctaatgacctgggaaatagaaatagttgtgaattactagggattggaggagaaagatcagcgatcttggcatcagacatgtctgctttggtcccattttgttactagctgcatcaatgagattaaatgacattttagtgcccaggagtttatgtagtttctgaaggtactttattaatactcagggaacagctatggttctagaagaatgtttctcagacttgaggaatgtgcagtctgaaaaggaaaaagattgttgtcgactccagttgatttaacatttttgacagtatgctccttaaataagtataacacaaaacaaaatagacacatactcactattcttattgcttttatgtatatatatgtatatatatatatatttataaaagaccaaaacaaatttacaaatcaaatacagtaaaaactataaataaacactataatgcacccattaatatggaatgactgaagatgctctttgctaaagttaaatcactgatcacattgtggcctgggtactgagagctgagggcaagttctttcgagtttggcatgtctggtattcactactttctctagtggaaattctgcaaattttaatttgtgcagggatctatggtttttactagccagaaatatgttgttacatttgactctgtattattttttctcattggtctgtgagaattaggacagtggggcttgttaaactcgcagccataaaaataaaagcaaatataggcagtggccatctttgttatacctgctgagatcgtgaagatgatccagaacatgtctatattactgggttaaggttagcatcttaatgaaaacactacatcaaaaattctcataataataataataattggccactaagaaattatctttggacctccacgggctcactcaccagagtttggaagaaacactagtctacgaggaacttggttataatatatacattgctttttcgtcttacatttattacaaacataatacatattcactgtagacattttagaaaatttagatgtcaaaagaagaaaaacaatgttatttgccataacacagagaaaaatcaccattaacatttaaatatctgttctttccctatgcatacatatatatttgtataccctatttaaatttgttttcacttagcaaaacatgagagcagctttccaaattatgaagtattcctctgaaataacatttttattgtcttcacttcgctaattctgtgtttctgtcaaaatgtagtaaacaagtcacctattctcaatattttgattgtttccagttttcggccatgagaaactatgctgagtgtgcctattgttagcgcacttaaataagtctatttacctgtagaatattttactagtattagaatttctgtaccaaagagaatgcaaaatttaaaagattttttcacgtgttaattatatgaatcaaacatgttaaaatgaataaacatgtggtggtgataacttcatagctgagtggggctgcatggcttaggtgaccatcagaactcattcattcattatagactactttgggatgagagctgactaataaaatgaaaagtgtttaatattatagggcatttatttttttacatgtaaagggtctattattattttaactaaatcaatgcataacatttttctctttaaaaggttaaaaaataattatagatgtatacaaagttgcaaaaatagtacagaaaagtctcatgtacccttcaccagcttcccccaaaggtagcatcttacttagctatagtacattattaaaaccaggaaattgacattagaataatactcttaactagacttcagaccttactcagattccaccaacttttacagtcactgtggtgtgtgtgtgtgtgtgtgtgtgtgtgtgtgtgtttctgtgaaattttatcctatatggagatttgtgtaatgattataatcacaacagacacaatagagagctgtttatcactgcgtgggaactcccctatggtacccccctttgtagttaccactcccctggaaaccagtaatctatttctatctctatattttgcccattttggaatgttacataaacagtcacactagagcatatattgtgaaacacagtaacttcagacatatgttctaggttacttttttattttttttgaaatagagtttctcacttgtttcccaggctggagtgcagtggtgtgatctcggcgcactgcaacctccacctcctgggttcaagagattctcccacctcagtctccctagtagctaggattacaggagcatgccaccacacccagctaatttttgtatttttagtagagacagggtttcaccatattggtcaggctggtctcgaactccgacctcaggtaatctgtcagcctcagcctctgaaagtgctgagaatacaggcctgagccaccgcacccagccaagattactatttactatttggatatcaagatggttgtaatagagataagaagggatagatgcctctttgaaatcattaaaacaaacaaaaaaacttcaaaagatagaaatgtattctgtttactttagtatctctaacatcatggatgatattcataatatgtaacagcatttatgaaacaagtactaaccaatcagaatagacaccagctgcaaattaccagtacagccgtgccagtgggcacagctgaatctcaaccctgcctacaccagatcaaaaggagcaggtatcaagcacacataaacgcatctcaaaacacactgcttaaccctagcacagtgccagcgaatggtagggtcaaatacgggtcttttgaataaatgagacatatcagccctctttaatggttcctctagccctcacctccaactctgaagctcttctgtgtggtattctcgcagctaagtaagaataggctatggatccttcatagttctgagcaccattcaaacaaaccctaggacagaagctttaggtgttatgcactggaataaagaaatccaacctgtgcttggtcccatcactttcatggaccttaagctcttctcttgtcgataaaaatgattctaaaattgtaaccaagattcagaccaaaaaaataagaatgcagaattcaatcaagtagaaaagacattagttgaatccagttgaggcatgaaagaaattaactgcaacttggttaaaggcgcagaatttcgtctacctaaattaggtgataacatgttgaaataaggttataataaaaattgattgaaggtaaagcttgaaatatgttctaggaaatgtgtgacgtgcagggttgtgaaactaaactccagctggaagatataggcatggggtaccctaatgacattgcacacagaactcaacaatcagaacgggatcagcttgttcagttagaatttggagagaatcagctttgaggtacgtagtggccaggtctcatatgttggtattaaatttgacaggtaaataagtatattgtaatgtggctccactgatagagtaaatgtttcctcctagattgcgaaaatgaccttacaacctgtggagtagagaagggataacatgagccaaccctgttagccttaacgttaagccttaatgcttttgtgctaagtttagcagtacatctcataatcattcattttatttgtggttatttatttttaaaggtatattactgaaacaatctgacatattagagtatctgacaaattagccttgagattttgatttgaaatgtgtaattactattagatgtgttattttattttgaaaggagtaaaagactttgattatatttgtgaattggtttagaatatttaagagaccagccttagacacatgggttgttcgtcctttgttgaaaccttcttcatttggttcttaggactccacctccctttgtggctccttattgctcctttgttgatttctcctctttctccaacttcaagttaaagtgcccaggactcagcttgcatcttatctttccctcctctcttaccctatcatgtctcatgcctttaaacaccacagatgcactgcagcttccttaatgcatgtctcttgcctgagttgcaccctgaatgcctgacttggatattcatcttctacttgacatgcctacttgatgtcaaggcatttcaaacttgacgtgtcagaagtcaaataaattcatgatctatctccaacaccctatcaccactcctggcaacttctctcaagtcttctccatctcaggaaatagcaactcttccttctagttgctaatgctgaaaatcttgtagtgatttcaggggattcatgggtttttttcttacaatgtacatctgctccatcaatacattcatttaatgcttccttcaaaatataagattcctatctcactatgtccactgcttccatcttgtttggactaagctattgtcatctctttattattatttcaatagcctgtgtattggtcttctttctttgccttgattcccatacagcagtgagagagggatcaatgcaatgagaggaatcctgttaaaaggtaaagcaggtcctccctcccctttgctcaaaatgctccagtgactcccatctcactgagggtaaaagcaaaaggccttacaggctataaagtcctaggtaatctactttttatagagaaaatttaaaatgcaaagagagatagagggaatgaattgaaagtatagcaatatctcggtcaaggaagaatttctacttataagttaagactgggcctgccttttggaccaattctttatccattccactttgttcagtaattacagcattctatgcttttatttctctagcatgcccagccacattttaagctttaaagtcataaatgtgaaactaacataggcagtaatgaaaagtaattcaggagttattcagcacatcttactttgtgcaaatgccaaatcataggactctgatgtccttcagttaagacctttgtatttcaagcaccttcgtgtccagatttactgctactgaagaattgagttcttgaattctgccacctgtcacggacttaaatctgatcactgttaatgacatcacagtatcactcctactaaaggagagaagcattagctgtagttagaacaatgcattcttttgagtagacactgctgggtattgtcacagaggatgagctgtggagggctgatggcagctcagctttcaaacatcggtcatctttcacattgtttgagctttcagacttgaagtcacaggcctaaggacatgaatttccacagcatttggacacaatctattacctggtaaagaaaccgagccggatttgttgatattaatgtcaaaggttcttatcaattttaaaaacttgctaagagtgttggtcatattggcagtggcagacagggcccggaggaggtcaggagaagcaacacccttggtacactgacaagcaagcttcaggtggaggagaaaatggaagagttccaagagttaagagaaaaagtaataggtggttggcccttctacaaagaggtgggtgagtgccagagaaggcaggcaacagaagtaggagcctaggaaaacaaatgaaacaggagcagagagaaaaccatccttttggtaactagttgtgactcttgtttatttctctggtaatagggggcagggtacaagtattacaagccaaataatctattctgctgttggaaaatagagtatttagaaaatggtatgtactgacatcattatccattagaaatgcccctcatcccaccgtttcccctgggacagaagatctgacaaagggtgggggtggctatcatttttattgaacacttactacaaactactcactgcatcaagtgcttcaattgtattatctcagtgaactcttgcaacaccatggatcaataatattatcatccccacatcacaggaacaaaaaccaaggttcatggaagttacataatttgcccatagttagttttagcctcagctttaaatgcatagacaccaaccccaaaactacacacaaaagtatcctaaactttaataatacataaacatttaaaacatattagggagcccttaaaggtcaagtggttctgtcttgaaattctagcctatggactgtttctggccagtaatgaagtttttgatggtctgttgcgaaattttaaaagtaaggccaatattaggaaattttatataaccaaattcacttaacccaaggaacattttattctgatgtcattcctttattatagatcccttaaaaatggcctttatatttttgaaaagtttcagttttcctttaatatactagacctataaaaatttggcaagcttatgttggcacctaccactttaaaaatttatattggtctatgaattccaaagctctttaaccattgatctagttctagctccaattcatcaattttctacaactgtcctaaaagatggccaaggaggatttgtttttaaacatttccagtgacagaattcactactttttgacagagcccatattctgttgggagaaagttcttcctttaattgaattattatctatctttaactcatggcacaacaaataataagtatatcccactaggttttaatgcaaatatgtgaggataaacaccaggtacagttccatccttcccccaccagacattattttctgtgcttccttgttatggatggtcttccccatcctccattaagtgttaggttccagagggcagtgaccttactgcagtatctaggacagtatctggtacagaatatgtggacaatcaatatttgtaaaatgagtaaatgagcattttgcaagcagcagacatccaagaaatatttaacagcttcagtaaggctaattcatcttctacatggcagtgcttcagatatttaaacatttgaagtcgactcttctgttttcaataagatttctttctttttccataccaagacttataaatcccttgacttgctgcccctatgatagaactttcaagcccttgctggcgttcctcctctatatctactccctaaaactaaagatgggcttggccatggtcaaccccagagggtctgtttcctctctgaatttaatagcatggcttacatgtacatttttaaactcctactaaaggagagaagcatatggttgcctattaagcttgtaattaatgacatctcataaatctttgtggcatttatttctgctgggcaaaatctccaccattcggcaaaacttgacatttcttccctctacagctcatcctgattttgacctattatttagcctattgacagctttgtaaaccttgatttttctcttgttcattccttcaaccaataattactgagcatctacaatgttccaggccccatatgcaagcctttcctctcctccacctcagtgtctcaggtaaacacaaacacacactctgccttgtcaccccccttcaccttcataatcctctaagttggcatcttctactaatcaatagtagagaatggtacttttatcttcaataaaagatgattggttgtttaatcaggtataactcctccaacttccactgtcacagcccacagcagaccttaggatagaataagagccatgttcatgatattgctagttttgctctcaagatttgaagtgtagcccccaagaaacatagagcaaattgtctactaaaggagaaaacaaatggcagtgtactttgctccccatgtcagcgtcctgagaacaggctcttgccctatctatgtgcagcttccaataagccaaatgaggtaccataacacttcccaaacaccctgagctgaacacgtcactcctagcaccccagttttagccctgcccccctgcctatcagctgcagttaagcagccacatattttgagagctcgttatgttccagactctttgctttcatgatctcaatcttcatgcgatagtttgctgagaatgatggtttccagcttcatccatgtccctacaaaagacatgaacttatccttttttatggctgcatagtatttcatgatctcagctgcatgaactgtagcaactgttattatcccagtttcacttatgaggaaactgaggcacagggcaattgtataacttgcccaagtctcaagagttaaagaaagtggagctgagctatgagcaaagcctcctgactcctcagaatacacctctcccctctgacacaggaactgtgggttttagacaagctggactttgcctcagcttcctttgtctgcccaggctgccccaagactccctggtcccccctgccactcatttggctgctgtgatacccaagtagtctactgggcacttcgcattcattttctcacccaacctcatacaatagagttattattgtatctgttttgtgtatcaggaggcagacagaaagtaacttttccaagatcgatatacttcaaaaatggctctcattgctccaggtcccaatatcactcacctttaatcttcttgcttcttggttctctacgtgaagttattctaaacactctacttatgacattcctttacagtctagtaatcctacagaatgaagttaatgtgactcaactggacttttgtaaagaagtgaaagtttgtggtaatcacagatgttcatttatttactgatcgatttttaataataagaggtcactaactgacaagaaatgcattaggtaaaaataacgtaggaaagttccaaatgtcacattccatagagaacccacctgcagttatgtttcatgcagagcaaagtaaaaagacttttgactttgtatttggaaaggctcagccctgggttttggatctgtatgaaagagaccacaaatgcagtgagaacaataccctgctcacatggtatatttggcattccattcatccatgatgtgtagactattaacaattgtgaacaaagttgtcagggggaacttggaacaatgtcatattactgaatcagtggcacaaaatttatcttcttcccccagcccaagtcctcttcaagattcttctgcttcatgaaaaataatgctctgatatcaactgccttgaaaatttccccttgttttcctgtgatttttcagacttcttgcttgtgacatcatgcagacatttaatgtctaaatatctaaccacgataatttcaaaaacagtagcctggtcaattttcaggagtttgatttttttttttttttttggtctcgaataataatgctatatgttcatttttctttgtttttgtcatttcatttggtaaaggatcatcactgaggtgagtgtttggcaaaattacttcttcttacagaatagaagaattttgtcagccttcctttagactttattccaaaaggctctttggaaatctcactacctacttgaaacattgttccatcagaactcagcaacctaactaaaggcatggctgttggctgccgtaaagacggtggaggatctgaatgagtcctgagcagcctcaagcgggctataaggcctcagcagcctcaagcgggctataaggcctctacgactttattttctttgcattcataagccacatagcataaccagctccagaacacctatataatagtctgacaaacatttattgtgcatcagcaaagtactaagccctaatattactgggagtgcagagatgactagcacatgatctagccctggaggagctgataggcaagtgcggaggctggtaccccagcgggtaatatcgctgtcatcagtactttgggaagcacctgggcatggaggattgagagtgccttgaagttctgggagccctccctgaaggagatgattcctgagctgagtctggaagaataaatagaaggagaggaaggacattccagtgagaggaaacagtgtaaagaaaactggggagtctgaaacagcaggctgagtgagtgcaggtagctgcaaaaaaattgctatcatcagaatgcaaagaaagagacagtagtgatgggagattaagctgaagcttgcatcaaactttgcttgcctttctcctatggaatctagactatatcctgtggtcacaggaagcctctgaaactatttttttttcttttaaataattaggatagtattcgtctgacctgccttctggtttcttttgccttcaaagttgcccaaagagtaccattgaggtaattttctacctcatgatatatagaaaacttttgacttatttacatgttttcataggttttacatctcttctttttttaaaagttttattttactttaagttctgggatacacgtgcagtacgtgcaggtttgttacataggtatacgcgtgccatggtggtttgctgcacctatcaacctgtcatctaggttttaagccccacatgcattagctatttgtcctgatgctctccccactctgccggctccccaacacaggccccggtgtgtgatgttcacctccctgtgtccatgtgttttcattgttgaactcccacttatgagggaaaacatgcagtgtttggtgttctgttcctgttttagtttgctgaggatgatggctttcagcttcatccatgtccctgcaaaggacatgatctcattccttttaatggctgcatagtattctgtggtgtgtatgtaccacattttctttatccagtctatcattgatggacattaaggttgattgcatgtctttgctattgtaaatagtgcagcaataaacatacatgtgcatgtatctttatagcagaatgatttataatcctttgggtatatatccagtaatgggcttactgggtcaaatggtatttctggttctagatccttcaggaattgccacactgccttccacgatggttgaactaacattcccaccaacagtgtaaaagtgttcatatttcaccacagcctcgctgacatctgttgtttcttttttttaaaatttatttattttattattattattattatttattatacttcaagttctagggtacatgtgcacaacgtgcaggtttgttacatatgtatacatgtgccatgttggtgtgctacacccattaactcgtcatttacattgggtatatctcctaatgctttccctcccccctacccccaccccacaacaggccccagcgtgtgatgttccccttcctgggtccaagtgttctcattgttcaattcccacctatgagtgagaacgtgcggtgtttggttttttgttcttgtgatagtttgctgagaatgatggtttccagcttcatccatgtccctacaaaggacatgaactcatccttttttatggctgcatagtattccatggtttatatgtgccacattttcttaatccagtctatcattgatggacatttgggttggttccaagtctttgccattgtgaacagtgccacaataaacatacgtgtgcatatgtctttatagcagcatgatttataatcctttgggtatatacccaataatgggatcgctgggtcaaatggtatttctagttctacatccttgaggaatcgccacactgtcttccacaatggttgaactagtttacagtcccatcaacagtgtaaaagtgttcctatttctccacatcctctccagcacctgttgtttcctgactttttaatgatcaccattctaactggtgtgagatggtatctcattgtggttttcatatgcatttctctgatggccagtggtgatgagcattttttcatgtgtctgttggctgcataaatgtcatcttttgagaagtgtctgttcatatccttcacccactttttgatggggttgtttgtttttttcttgtacatttgtttgagttctttgtagattctggatattagccctttgtcagatgagtagattgcaaaaattttctcccattctgtaggttgcccgttcactctgatggtagtttcttttgctgtgcagaagctctttagtttaattagatcctatttgtcaattttggcttttgttgccattgcttttggtgttttagacatgaaatccttgcccatgcctgtgtcctgaatggtattgcctaagtttttttctagggtttttatggttttaggtctaacatttaagtctttagtccatcttgaattaatttttgtataaggtgtaaggaagggatccagtttcaactttctacatatggctagcccgttttctcagcaccatttattaaatagggaatcctttccacatttcttgtttttgtcaggtttgtcaaagatcagatggttgtagatgtgtggtattatttctaagggctctgttctgttccattggtctatatctctgttttggtaccagtaccatgctgttttggttactgtggccttgtagtatagtttgaagtcaggtagcgtgatgcctccaggtttgttcttttggcttaggattgtcttggcaatgtgggctcttttatggttccatatgaactttaaaatagttttttccaattctgtgaagaaagtcattggtagcttaactgttgtttcttgagtttttaataatccattgactggcatgatagcgtgagatggtatctcattagtttttagtttagttttttttttttttttttttgtgagacagagttttgctcttgtcacccaggctggggtacagtggcgcgatctcggctcactgcaacctccacctccctagttcaagcaattctcctgcctcagcctcccgagtagctgggattacaagcacacaccaccacacctggctaattttttttttttttgtatttttagtagagacggggttttgccatgttggccaggcttgtctcaaactcctgacctcaggtgattcactcgccttggcctctcagagtgctgggattacaggtgtgagccaccgcacccggcctccttgtggttttgatttgcatttctctaatgatcagtgatgttgagctttttttcatgtttgttggccgcataactgtcgtcttttgagaagtgtctgttcatatcctttgtccactttttgatggggtgtttgtctttttctagtaaatttatttaagttccttgtaaattctggatattagacctttgtcagaagggtagattgcaaaaatgttctcccgttctctaggttgcctgctcgactgatgatagtttcttttgctgtgcggaagctctttagtttaattagatcccatttgtcaatttttgcatgtgttgcaattgcttttggcattttcatcatgaaatctttgcccatgcctatgtcctgaatggtattggctaggttttcttctaggatttttatggttttgggttttatatttaagtcttttttttttttttttttttttttgagagagagagagtcttgttttgctgcccaggctggagtgcaatggcatgatcttggctcactgcaacttctgcctcccaggttcaaacgattctcatgcctcagcctcctgagtagctgggattataggcatgcgccaccatgccctgctaatttttgtatttttagtagaaacagggtttcaccatgttggccaggctggtctcgaactcctgacctcaagtgatctgcccacctcggcctcccaaagtgctgggattacaggcatgagccactgtgcccagccctacatttaagtctttaatccatcttgagttaatttttgtataaggtgtaagaaaagggtccagtttcggttttctgcttatggctagcccgttttcccagcaccatttattaaatagggaaacgtttccccattgcttgtttttaggttttgcatttcagcttcttactaatcatgctctgccccttctagcctgaatagtatttatagtgatagaaaagatgcaaatttggagcagggcagtggtgccttgtctactgtgtgcagttccttggtgtattgtagaatgctgctaattctctgtttggctactgaatgctctccttgcagatttgtgcctctcctgtattttccttgggttggagtcatcctcctgtatttgatatactttaaaatggtttgaagcaaagtggttagtggaaagaacataagctttgaaatcacagagacttaaaggttccttttatgattttagaaaattttagtttggaaaatttcaaacatatgcaaagtaaacagagtaagtataatgagcccctagtagccatcacccttgtccagcactaatcaacattctgccattcttgtttcagtcctaattccagtccctcctcatttcccctggattattttttcagtgctttaaattcatttatttataatgtacctacatggtgatgcactatcttaagtgtgtgattttgacgaatgtatatatccatttgcctcacactcctttcgccatagagaacatttccatttctccagaaaagtcccttgtatcacttcccaagcagtctgcttctccctctggatgcaagcatggttttgacttatgtcaccttagataagtttgacctgttttagcatttcttgtaaatgtaatcatacaatatgtcctatttttgtgcaaggctccatttgttcagcattttagctttgaatttctcctcttggtatccatctgttgttggctgagacttagcctctttaaccccagttcccttctctagaaaatggaaaaataatagcaataaaaattaacaaaaattacattggccttaggataataggaatgtcctctctaatacaaacaaatgctaattatgttgtacttgagatgcaggaatatgaacaccttcaaaatttactttttgtccggaaagatattccatgtttgctagtgttctactgataatccttgttttgaaatgtgatgcttgaatatgtataatatattggtcaaggtccagtcaggaaaacagatcttataccaggtagttcaatagaagggatttaacactggaaattaattaaaagctgctagaagagctgagaagtcaaacaggcaatggcgaagcagatgagggattaacaatgcaggaagtcacccatacccctaatactaaaggagagtggggaaaaggtgctgttcccagagcccagcagtgaggtccaccaatgggccctggaacctcataggaggctgctggcaacagaaaggagatgcagctactgcgcgggatccctcctggctgggtgggggagtatgtagagatgaaccctgtttttccttttgtcctgctattgtatccactgtccagagaggcggggaagcagcagcaggagtcagtaatccctggtacagggcagaggaggggaaggcagggcccagtgagaaaatgatcagcagaaaaaaaagaagcatatacagagacagttaagaaaattgaattcaataatacttagcatttgagataattcttaccttccagaatagtactgcccatcagaactttctgtgataattaaaatgttctatatctttgccatccggtaagattggccagtagccacatgtggcaactgagcactagcaatatggccagtgtaactgagaaactaaatttttaaatggtattttattttaattaatttaaatttaaataaagctagtgccatattgcacaatgcagcttatagaaaatcatcctttaattcatatatatttttaatatacattccttgggcacttagaataacacatgagaagctgagactatccagatgactagaattatgcttctaacctttaatattcatatctttcttgcccaacaagaaagatttgaaaagtggtatcacaagaactatttgttttcacagatataaagtctgggtaaaaaggaagcaaaaaattacctacctctgagtcttcgcctaagctgttcctgactcccagatacgcttcctcctccacttctttcattccactcatgcaaattctattcattcttcaaggcgtacttcaaatgcctcctcctccactaagccttctctggttgcctctcctaccatacacacgtacacacacacacacacacacacacacacacacacacacactacccaggctgcacgaatcttttccttcctttgaactctcctgatgttttatctctactcttatcacttttattactttgtacttcatgttcaagttcctgatagaaattcatttgtctctcctactagacgccttgagggaagattttaggatggttctgtcctttgcccacacagcacttagcaccaaatattgtgtataataggttctttgtactatttgaagatcatgctgagcaatgagtcttccatttctgtgcctgtaactatcggtaggtgagcaattcaaggacaccattcaaagagaaaggtttatttttcccaggctacatgtttccaggaagcaattgtaataagcaaacaaaccggttttctgtttccattccatatgcgggtattcttttcatccacatttaaaatatttcttgatctaatattctagagctagactaatttctgtgtaatcttattattcttaaacatagttaaaaacacaagatggctatagcagtatttaaattaaattatgcattggagcgcttttattattagaaccatcctaaatatgcaatgtggtgttgttgttctttcttgttttttaactcacctggagtttgttttgctgaatttgtacagtttgcctgtgtgctgttacatttgcctgagttcagtggagtacaaactgttttcattttcctgggaattgtgatttttttctagtattcaaagaggaatatttttgtcccagcatagctttctaagggttctaggacttagctgtatgtagtttccattacctacagagtagctggaagatgagcagcacatttcaattgagagctcttattacgtacaaggtactgacctaggtagtgttttggatacctaacaaagaatataatttaatattcccgataaccttatgagaaaagaactattagtattcccattgtataggtgtgcaaatcatagcatacagaagttaagtgaattatccaaaatgtaaataactcttggaagacaagagggaatcctaatccccagacaatctaatgcccagctctcccttatccttagccatctcactctactgctccacattagcatatcagaattggaaatcatgaaaaggaagggtgcattatgttgcttaggggctagtttttctatttccaggcagctccttgtgttctgagaatgatggcacttctaagggcttttgatctatcgacatattggaaaccacaggcctgggtgaatataagccatggactctggagagcagtttaccttgtaggccagttcttccagccagaagcccttgaagacctggctttaccagataagattttttaaaatgccaaaaaagggcttgagtaggacagctctatgctgtcacctctggtccgaggtgagcaggtagaacaggatgccgtgacctcagctaaaagttaagcactggactgtggccaaggcagaaaggagaattcttatatggactgagcctttcctgagagacttattttttccaatagtaatagtagcactataagaagctaagtgtgaataaagagctctttgtctgggggaacgagaacgcctagtaggattactgtgtgagggcttgataccctgaaacacaactcagcttatatttctcttccctacctgggcttgtaaaaggcgatatagctcatctcctgttcattctcagtagatttgtatattgtcacatgtgtcctcagtttatagaatctgatttcagaaactggcaaaataagcagtggataagagaaccgagccacaggagcagtgcttataactggaagctgatgcccagagaggataaagtgacttgcccaaggttgcatggggcagaggtgggatctttccattgtattatctgcctccctggattgtttactttgccattcatagcacagaagtccaaacagcagaacatgtaatctgtctttcagcattgtttgaaatcttttctgaaatgagatgggggagggaatatgaaaatgcacttataaatatacttcacggaatgtgtcagtcttttgcacattgtcatgttttaatgtgatctgattgaaaatatgactctgggtctcccagagacaggaaacctgaattagatggcattgtaagtttatttttcttatattgcttttccaggcacagatgtagcattttacattttcaatttgtttactttctgtatcacatagcactgatctgctgattaacttttgttccatttaacaatggtgttattttatccttattttatccttattttaaaatagtatatacacattatagttatctatcaatcttttttacatgcgttatctctttacatctacataattatcctaccaaactaaaagggcaggtagaattatccccattttgcagattggaaatcaaaataataaaagattatgtgtcatagctggttaactaggactcaggtttctttagtcctagaccagtgtttatgcttgaactcctccaggagtggttcttaacctgctgtgggtttcagaatcccctgcagagcttgctaaacacagacaaattgctggctctgcctccagagtttctgaatcagtaaatctggggtaggggcctagaacttgctttactcacctgttccctggtgttcctgatgctgcctgtcagaggacacactttgagaactactgatctaaaactttgctctagcatctttaaacatttggcaggtaatcaatcccttatctgcactactgaaatccaaaaatctctggaaactgaactttttttcactgaaggttggcacaaactcatttggcagcaaagcctgacctgaactgaggtgagactatttatagtctttatcccttggtgtgactgttcctacagtttgctgcagaaatgttaatgtgttgtgttataggggtttccccagacctttctgaggggggtgtgttttataacaggcacactgtaattccttacagaatctgaaaaaccctgagatctaaagcatatctaatgccaaagacttcagataaggggctgcaaatttgtgctaacctagccaacaggaaaagttttttgcttttgatgctgcaaaaaacctcaccatttttagatagccaccagagtatacacatttgaacttgatatatgcctcttgagacatctttttggaaggtttttctaaagcttctgtcctttagctgcagaaatgatgcttcatgctgaactgcaagagaaagcattgagccatccttcccagtgagctgggcaaatcccaacgacacagtgatctgaaaggagtatttcctgatgcttacacttagtaggcatgccatcaataacgacattcacacccttaaccacactttctctaaaggttggattctctacctaggaaggagatgtcattaaggctgcagagtcgggtaacgaggaacagagaagagagcttagtatttttatttaataatgaatcaggcttaaatcatgagatgattgttcaaatcccccaaacatcatttcatttaaatgagaatggtttttagagctattgcaaaaccatcaaaagcatattcatcaggaaacactaacatattgtaactggattacatgaaattgcccgggctaaaatgagttacagagaaaatatattttaaaaaccttcccaattcatttatctggagcatataattttgtgttctattcctaggactgttgacgttcattgccactgagctgatgtggctgtgttccttagccgtgctttcaaaaccctctctctcctgggtgatgcaggagagacccagagcagttaatcattttcagagactggcatctcatgtccacagagtgacttgcctggaagtagcctttcctccccagcagcaaagaggctctttgtttcttacattgcagggcccagcaggtttgatgtacccacataattggcaaactaccttcaccctctaggagacctaattctcacagttttataattcttactcacctgcctcctattttatagatccatagacactcctcaactagagccagaactaatttgattgatgagtcatatcaaacttaaaaagcttcttgtgtcctcatttggctacagtactctgggagtcctattttgcacaataggccactgttcctattcaagtgatttgattcaatgtgcatgttaggttcagaaccctctagattgaccaaaagtataatctattcagttttccaaaaagagtaactctctagtccatcagtatcacaagccaattagtttgccaaatatctcctcaaactttatgccaacattgttctaaagaaacttctgttctgggtttagtgtctttaatgagaagcaagaaggtcacagatactctagagtatctgtttaacgggctgctacagcagcatcagtttgcatactccataaccctaggagcagcctgctccatgtgactaacccccctgaggcttgtgcagtgtacaacctgcacaactgaatatggcagctctttttaatgtctcacatattgtaaataaatattccaagaatacaggatttgttggaccatcatcaccttcaaacttcccaagatgtatgggatttacataaatccagcctattaatactctggtaaatcctgaatttctctctggacaggatcactataccagaagaccagatctcaagctcacacagtagaatgatgagactaatagcacctaccatcttttgagtgatttagacattggaccaggtattcataagctttgctaagcagtctctagctcaagttgagtaacattttactcaaattactcaaactgagtaatgttttctaagctgtctttcatcacattctattttctttctcgtatttatccactcataagaagccatttataaatgacaagccttgactatttaccaacaaatcatgagacccatggcatctgtgaggcaagtctcagcctccctgaactggcaccacgattagcaaatgaatggccatcagcttaattgcaagaaattagctaatcaatcagcgaatatttagttagtgcctactatgtacagctgttatgacagggcttgtggatacaggtaattatggaagtagctgacatttttggggtgctcatgcattatatttgtagtgaccttttaatcctacaagatcctacaacaagtttattaggtcactggcattgtatctattatgtagaaaattgtggtatggagcggatatcataacccaaggtgatataattaacaagtgtttcatgtgggtttgaactcaggtctttctgactccaaatttcatgctctgaattagtacccctccctttctttcctccctgacttcctgaacttgtcaaaatttagcctccatctttataacttgtaccagagaggactgatacaattttaaataaagtagatgcaaatgcttcataacaagcaggaagtaaggttctcatttatgccacctaaatagtattgatagggcaaattgggagtgacctcaacaggcaatctcttctgttagccagtgtctgccagaaaaagacagctgcacccttggcttcgagggtcttcttcaattggttaatgataaataacgctgtacaccaagtctctttagttttttacttggggctacgtttcacagctgactgaccctggtagttccactgggaattacgtgactccgtttagtcacgtaagaaagtgccatggaaatttccctgctgccaggatggggcactgcccacacccgttttccaagttaaagtagtttctgctaggctctttggaggaggtctctaaggtctgaattactttcttgaaccagggcttgaagcccatccaggcttccccttgggcataccagcgactttagaagtaggttaccttgagcatccagctgggggagactgtgttttgcccccacccactttcagaagagaatgtccattccaccaccccggcataaccatgggtatatcctaagttctgtttttgtttcaagttagggctccagaaggcaacatttaagtgcctttttttcctcatgaaattgcttttgacattttccaacttattctgagataaagccttataaaattacatctcttttttggccagtataaacagccatggagggcagtgtttaatctgtcaccaaatgccctatctacacttccacatgagcaactgcttttaaaacttaatacagctgtgggggagggggtgcggggcggggggaagtgaaaactgaaacaaaactttgcctctgttacagatgtagcccacttcctcctttctgataaataagacctggtcattgtcctctttccctttttgctctgagtggaggcccagagcctaccgtgttttttttttttgtttgtttgtttggttttttttgaggtggagtctcactctgtcctgtcacccaggctggtgtgcagccacagtggcgtgatctcctcggctcactgcaacctccacctcccaggttcaagcgattcttctgcctcagcctcccgagtagctgggactataggtgcacaccaccacacctgactaatttttgtatttttagtagagacggggttttaccatattgaccaggctggtctcgaactcctggcatcgtgatccactcaccttggcctcccaaagtgctgggattacaggcgtgagccacagagcccactcttaatgatggcatcagttgttgtggtcagctcgccccaacttttatggttttagttcttcaatttgattttgttatcaacactctaggttttgcaaagaggcaagggatagattttcattattaaataaatacttactgaggattgtgtgccaggcattacatagcagaagttggggagggctgtgatgttcttgtggagctgagttagacacaggatcacagcaaatcatgatctggagagctcataaataataacaatcagagctgactgcgttgtgtaccttgtctggaatataaccaacaagaaaggaaggagcagggaatcacctctgagaggaattgatacctattccagggaaaatggtgtttgagttggacattgaagaatggaaaggaactcagagatgcgttgaaaagaaagacatcagaggaagcatgtatagtgtcatagaacagagattggcaaactgtggcccattgtgtatggtctaggagctaagattggtttttatatttttaagtgattgggaaaaatcagaagaagtacatttaataacatatgaaaattctatgaaattcagatttctgtttctataaataaagttttattggaacagagccacactcattcttttatatattgtccatggttgcttctgcactaccatgacaaagttgaatcgttcgacagagacggtatggcctacaaagcctaaaatatttactccctggctctttatggcaaaagtttgctgatccctgacatagaagcataaatatggaggattgttttcctggaatgacaaattggctgatgcagttagtatgtggggcagagaaaaatttcagaaagataaactagggccacattcaagaaggtttttaaaagcttgttgatcttttggactttagtttaaagtaagagttgccattgaagaattctgaacaggggaaagatgtgatcatggggaataccatgatcatatctgtgtctgggaggagaagtctaaatgctgcaagagggtaggatttgaagaggaggccaagcataagtgataaatgtggggagaatatttctcaactagctttattttgcaagtaaccatttgggaatctttatggaacctcatgaattgaacttcacactgcgagttgcccaggcatggtggttcacacctgtaatcccagcactttgggaggccaaggcaggcagatcacttgaggtgaggagttcaagatcagcctggccaacatggtgaaaccccgtctctactaaacatacagaaattagctaggcatgctggtggctactgggctgctggctgtaatgccggctactgggctgctggctgtaatgccagctactgggaagactgaggtaggagaattgcttgaacccgggaggcagaggttgcagtgagccgagatcatgtcactgcactccagcttgggcgacggagcaagacaccatttcaaaaacaataaatacataaacaaataaataaataaatagctgtgagttaacagaagtggatttttttttcttttgccagcaaaggtgttttcttttatcgttctgtaactgagctatttgaaaaacatgcattgcatttctatggcttccaaattgtatgcttacaaatatggtttgataaagaaaatcctggactgtgtagagcaaacagaggcaggcttgatgaatttatgtttaaaataggctgaaattttcagattggttttgtttattttcattgtcaaatttaggcctctttacagtattacacccgtggaatctagaaatcactttttatcaaattttagatccatagggctacaaatggttaagcgttgccatcagcctcatattttaaccattcatttgtgcaaaaaatatcaagcatcaagcatcacaatggcaatataattatactacgttctgtggaagagaattctaaggaaatataaaaaatgattttctgtttgagagctggagcaacatgtatgaaatgttaaaataatagtgtaaaataaaagatgattgtgcatcatagaaattcagagaaaggagcaattagggaggcctgagatggattctaggaagattgaaggatttgtttagcatgaaaagccaggagaaagtattctggtaggaggtattgcatgtgaaaaataaaaggagttttgatataataggtactgggtgaactgcagaagattttggagtattcacataaccaataatttagtagatgtgttctgtggactaagcactgtgctataccatggagaaatcaagataagtaagacattgtccctaccctcacggagtgggactgtaaagccttcaaggggaaacaagcaattaagtaattacaatttacattaaattctataattcaggcagcctcaaagtgctgggttgacatggtagaagtagaatcttagggatgttgtgatgacatctgttggctagaacattaggggatagattattcctgtcaagacttcccctaaaacatccaagactgccctggggttggttctaaggggaagggagtgggagataggagtaggggtggtggagaaagagagagacagagatagagactgattcatcttctcatacgtcaaaagtctcagtcaaaaagttcttcctgaagactctgttatgtttgctactgtccctaggtacctatctcccttgtttgtgtcttaccagataagtaacacatcaccatcttcattgattacttatttaaagataaggaaaaaatgtgggaacaaagtagtgatacattttcccctgcttaaggacttgttaatttttactttatgaaaaatagtctgggcatggtggctcacacctgtaatcccaacactttaggaggcctaggtgggcagatcacttgtgcccaggagtttgagaccagcctggccaacatagtgaaaccctaaaaatacaaaaaattagctaggcgtggtagtgcatgactgtaatccccgctactcaggaggctgagccatgagaatcactggaacctgggcggtggaggttgcagtgagccaagattgcgccactgcacaccagcctgggcaacagagcgaggctctgtctcaaaaaataaaaataaataaaaccaaaatactaacctaataaaagaaggagattctcacatttatgtttcttgaccccgtagctttagtttacctgccagcaactgaacttataataaaacaacaaaaattaattaacagtaatttcttagaaacccaaagaaagcaaccttcatgaaaaaacactaaattgtctggctccctcactgtagcttactgctaggatgtgttggtaactctgaaaacatacagaggaaatactggtctaacagtaagatgctggtcccagctcctatattcactacgaatgtcatttgagacaaggaatttcctttgtctgagactcattttcctttgacttcatgatctctaattctccttccagatctgaaataccatttagtttttattttcctgtaacatgttcttggggagaatactattttccttattttacaacccagacttctgatagttaaatgggaagttgttttcttggctggaaaatgaccagggaaattctggggcaggttttgctccaggacttctcttataggtgtgactagaccaaatcctttgcatcatttttcagatgtgaatatccaaaaataattgacaagggcactttctggactatcatatctcaaataattctgagcacttagcaatttatataatgtgtgtcacctagagatattgcctaggaaaaggaatcctttagaatttctgactttgcagtagaggaccaattggagaagaagaggagtccctgagctggtcttggtttatgtccacaactcttagtttggggactgtgacagcccatggttaagagcacaagctgccaagcgacatgcttgtgtttacaggtaatcttgggcaacatgcttccacctctaagctttaattttcttgtctataaattggagaaataatacctagctcatagaattattgcaatgcttaaattaaataatagaatgcatttcaatgtgtaacacagaacctagtacaaatgaagtgctcaataaaaaataggtgcttctgctgttgtgacagtgctgggaaatacgattgttgctgtcatgtactagtcatcagccttttgtcttttccatggttaataagaaacaccatgagcatgccatctggaagataattcttcctttagttatattccatgtagttcctttaaattaattttgaattagagtccaaaggggtctctgtccaaccctggttctgggccatgcatatgatggttcagcccatttggtttctgttcaacacatatttaaaaacatgtttattgaacatctgtgctctgttccccatttatgaaattcaaatgatcaacaagagatctccatgtcagactaaaatgttatttgtacaagaactgtggttataaaaagaggaacaactttaaacatggcaactgtactgggcattgttggttgcccacccttcgatctcctttcttcctaagaaagccccatttttgtaggtgtatccactttcccatattcaattcattgacacatgaaagctgactccatcttgatctccatctaggcctgattagtggaacagtaatcctctctcttgtcagtgattggctgactatgggcatctagccttcaagtcctgtaaacaaaacagtctacatgttcaaaccagttttagtagagtattctgttatttgaagccaagactatcctgacaccctcacttagcatgaatcaattctgtttataaatgtaatggagtttttcactccactttcttattcctctacaagttgctcatgatgttgggtggtaaatggctatgaatagagctggcctagagataccatgagatatgatggcggaagcctgacccagaggcataggcatggccagcagccctgtgctcatgcttcccaagtgtcacatgaaagatattaagggatgtgacttaaaatcttatgtaatttaggacaagaaagattaaaaaaatataccattttttagtgggaattctgcctctctctacccctctactcaccgttgaggaggtaaagtgacatctgattggtaaatctggggggaaaggctggtctcaacttgcatatgttcctttatatctttagttataattaatccctagcctttaagtcataggtcctttgagaaggtgatgaaagctatgggtcctctccctcgaaaaatgtacatacatactatacaatgtcagtgtatgcactgtccccttctactccccaaatctacccacataatttatagatccacatatctcaggttaaaagctctgagttaaatccccagaagctagctcactaaatagtgtaaattgaggaagaaggaagcctgcacaggacaggaatgtgatgctgaaggtgacttctagtggtgccctggggaaggacatccaatgaggagtatacactatgcagtgggtctgaggaaaccacaaaggtgaaaggtcaggacatctattagtcaggattccagcagggaacgaaacccttcaggtctaagcaaagaggctttaatgaagagatcacacactgaaatgcaggcagggttaagacagcaaaccagagtagagtgtcagtgcattcagagactggcaacagtggaaaggtataactgcctgtagggccaaaggaggaaggagaataaatagtgtcactaggcctagtaagagcttggatatctaccgggaggaagcagaagtcacacggaaatgcaaaactacctccaactctttctttccctgtctactgatctgctggtgactcccatttgctgaatttaactggaagtcagaatacatgggagctggggtcagggagggaggtgcattccataggggcagcttcctgggacacagagcaagacacagaagggtagagaatgaatataggatgcaagcggagaataaccagaacaagggatcaggcaaaactgaagaaatgaacaagggaaggagtctgaatgatgcacgtgggtgttaaggaggcctggcaggggcttagtcaagggtacagatgacttagatgtgtattcaggaccaagtccagaaggagagtgatttgaatgtggaagaatgaagacctaactgggcagggaattcagactagaactcaccagagaggagttctctaaacttctgagtagccaggtagaaaccaagccccggatggtcagttaagagctgttaaccacagacctgagacctgccccctgtgccgttagactgttttcctgtggaagggccaagcagagccaaagcagtgtcctccaagccctcctgattgcttgctatgaggctgtggaacaccctaccctctaagggttctaagtgttggtccttctttttggtttggaaagatggcagactggaagaagtgaagggaaaggccattggaaaagtgattagctgctcttgtcgttaggaaataaaagattcatagttttgttttccaattttaatctctaaagcatgaatgatttaaaactacgtctaagagctgggtttcatttcagcgacttaatcacttttctgattcattgctatcattagaagcatgtcttctctaagccttaaacatatacgtgaaattgcaattgcaaatgttgcaaactagtacagtcatgtgctccataatgacattttagtcattgatggaccacatgtatgacggtggtcccataagattataatggaacagaaaaatttctgttacctagtgatgtggtagccatcctaacgttgtgatgcaaggtattactcacgtttgtggtgatgctagtataaacaaacatattatactgtcagtcatataaaagtctagcacatacaattatgtacagtacataatactttataatgctaataaatgactatgttaccagtttactatagtatactttattgttgctttagagtgcactcttattacctatttttttaaaaaagttaacggtaaaacagcctcaggcaggtccttcaggaggtattccagaaggcattgtcattataggagatgacagtgccatgtctcttactgcccttgaagaccttccagtgggacgagatgtggaggtggaagacagtgatattgatgattctgacactgtgagacctaggctaatgtgtgtttgtgtcttagtttttagctaaaaatttcaatagtaaaaaaaataacaatttaaaaaacataaaaagcttataaaataagggtataaagaaagaaaatacttttgtacaattgtataatgtgtgttctaagctaagagttattacagaaaagttaaaaactatttgaaaattttaaagtttataacattaaaaagttacagtaagtgaaggttaatttgttattgaaggaaaaatattttaaaatacatttagtgtagcctacatgtacagtatttataaagtctactttataaagtgaatgttctaggccttcacattcactcgccactcactccctgactcgtacagggcaactcccagccctaaaagctccattcctgtaagtgttctctacaggtgcaccactttttattttttatgctgtatttttagtgtaccttttctatgtgtagatatgtttacatacaaaaatgtgtattattgtgttacaattgcctacagtattcagtagagtaacatgccacacaggtttgtagcttagagcaataagctataccatatagcttagatatgtagtaggctataccatctaggtttgtgtaagtacactctatgatgctcatacaataacaaaattgcctatttctcaggacataccctgtcattaagcaatgcatgactgtatgcttaatgctggtggggaaaggggtgtgtattttttgtttgagcagagctatcgtatggagcttgaaagctcagcatccagagtcaagttgcccaggcatatgataccagaaaggtggtagagtgcaacagtaaagcacacagagctatcatcattctaacattttaaaactgaaacacaataggcactttgcagaaaagtatgtctaagaagtaaactctggccaactgcctgtttttgtacataaagcttgattggaacatggaatcaccaattcatttacatgttgtttatgtatgccttcaccctataaaggcaaagttgagtagttgccatagagacaatatgctccacaaagcccaaaatagttactatctggcccttcacagaaaatgcctgccaactttggctctagactggaagctaaacagctcctaaatgatatagctggccattatatataatttagagcagagagtagagacaagtttgttggagccagttgaattgaagaggaattaggagaatgcaagccacagtacaattttttaaaattatagtttccctcatgtgtatttcaaaatgctataattaattgccatctatgtaaacaaaaatgggaaattaaacatagcgtttaaagaaaagtagaaaagtaaaacatcagcatgtgtgtaatttattttcctaatcttgtaatctgagattatatgtgtttcaaagataagaaaaattaaatcagaaagaaaaatccctatgcttagtttaaaagatgatgtgtaaaatacatcatccattacccttgataagacagcagtctgaaaaagaaaataaaagaatgactctccatcttgactgaaaataatgggtcagcataattaaatgatctaacttgatcttgaactgacatttcaaatttgtcttcatcagccaagcctttgaagttccacaggggcataattttaatactgggactttcaagagctttctaaataggtcaacatcttttataatcttcaggccgtcactggatatttaggatatttgttgggaagagcaggtgttcttttgaacctcctcctttgaaaaacaaaaacaaaaagcaaacagtaattccacctgatggtatattatgacaagcctagaattatcaacggcttgtgaagaaaaagaaccaaatagaatgcacccttgacagtacattcagtcaagacttttccacttcttaagccacccttaagccaatattaatttacatgttgagatggtagcttctctccaactgggacacccccttgtgttataaacagaagtccccttgcatgttccatttaaatttgtatgtaattttataattgttggaccatcagctaggatatatatatatatatatatatatatatatatccatcccagataactgaaaataaaataaaaaagaaagccttcaagtgggtggggagttgggctagtgttaaggaaaaatatatttgtgtatttgtgatgcttacaaaagacagtaagaacgactttattcaaggggctactatccttgtaggtacaaggactactgcagtgatgtcttgcagtagggtagagagatcaggctcaactttgaatataccatgggcaagtgggaatttctacccaaggagaagggtaggggtcattgatggaacatctgagatatgaggaaattctagctaaactggcctaccaggattcctgctgaagtcaggccaggtgatcagacatccctgggttggggggtggtgtgatggaggatgagaagccagattagatatcaaaggtgatgagatataaaggacgacacattcaaaaaccaacttagcagaattcttgctaaacaggtcaatgcagagaagaacatgaaagtccgaaaatcaaggcctaattgaaaagttttgggaagcctgagtagagtttggacaaggagagaatccttgtcactggaaataaggaactgaatggaaaagtgagagttagagtatggccagtgatctttggaatttttgcctggaggggcctcagagaaatggcctcttcttacagtgtcaggaagatgcctggatacttcaggcaacctgagtttagaatttttgcctggggagacatttgaaaaggtcttgcacttcaccaagttcagagtacatgaaagtgggatttatttcgagttgggaatgaaagaggaagaaagcaagaaaggaaagtgggcttcttagggtagtagtcaaaggtacaaattgagaagtaaccacgctgtattggttctgggtgattgctttggctgtaggaaatagtagttacaatcccagaccttgaatcaagcaacttgaattcaaatcctggcctcacacattctagctgtataatcttgagcaacttacttaagcctccctgcacctcatttcctcatccataaactggggacagtaatagtacctacctgggtcagttgttctgaagattaagccaaataatgcaagtagagcacctagctagcataatgcccaacacaaagaaagtcaccaataatgttagccattattatttaagatgcgttatatatagcctgtcctatggaattcctaaactatagtcaattaattgtttgctcatcaaataactagctaagagcaagatacctgatgatttacaataaaagaggggaaatgaggaattatcaaatatgttgagctttaagtataaaatttgagactataaaatgagatcttaaatgcttagataaggaaatagatcattagaagaaattgacaatttcctgttgaaggatagcaatattttgtcatataccttatagcagccgtctccaaactttttggcaccagggactggttttgtggaagacaatttctcttttttttctttttttctttttctttttcttttcttttcttttcttttcttttttgagatggagtttcgctcttgttgcccaggctagtgtgcaatggcatgatctcggctcaccgcaaactccacctcccagattcaagcgattctctcacctcagcctcccgagtagctggggttacaggtgcccaccaccacgcccagctaattgttgtatttttagtagagacagggtttcaccatgttggccaggctggtctcaaactcctgacctcaggtgatccacccgccttgacctcccaaagtgctgggattataggtgtgagccaccgtgcctagctagaagacaatttttctacagatggggtgagggggatggttttgggataattcaagtgcattacatttatcatgtactttatattattattacattggggaaaaataagctgggcagagggataggaagtatcaaagtgcgattagggctgcagttttaggaagggtagccagggaagtcttcatgaaggtgatagttgagtaaagacttgagataaagggagccatttatgttggtacttggagaaagagcattccaggtagagggaacaggctggtgagtacctggctggttcaaaggacagcaaagaagccagtgtggctggtgcaaagtgagcgagagggagaatgttaggagacaagggcatttcttccaggaaccttggcatgccaaggactccagggaatgtggggccttcctttcctctgaaggttagcagtttggggagcagttggtgatagcaccctttgctggggtaccagaactttcagggtgggcaccaacagtcagcatcctccaggtggatgagaggaaaagagaaagcacatagcatgcatgatgttgcaaagactaaatgatgaatttgtgagacgacccctagggtctcaggccaagctgtgtgaggctaagcaggcagctcagtctccgcgtaagcacatggaaacaagagtctgtggagtgtgggttactcagttacccacaggctaggtagtattggagaacttggagatatgtcagattatgcaacttactgataaccctgcctaataattttaataatcagcttgcctttccaagccttttcccttttctgatcagtgtacttttggaagtgatattgaaagggccaagccaagtctgggtttttatctaccatcacaataaaaccaaggaggaaatttacattttgaatgtaaattgaaaatgtgatctgctttcccatgtcatacctttgttccccacccctttatttagttctctctaaaggttagccaacataaagagatttatgggacaactctatatattgcacggaagaattgggaagcactttgaaatgagccaaaatgatgattgggtgtcttagtgaacactggggttgtggaacacaccctttcaggtcatctgtagaaacagatagggtctctaggtttttcatcgtctttgagcgatttaagattcagtgaatttttttctggtgcaaattcaatttgtattcctaccctactatggaagaagcaagttttgcatgcattaaccaaatttatttcagtattcctaatggcttatatatatgtatgctctttggattctcctttaacctggctttaacatcttactggttgccttattaattaatgagttgaataaagcctagcattttttttatttgcatgagaatcattattttactttttaaaaattatcacctttcagtcatactttatagttatacctctataaactaaatgatagaggtaatccccaacgataagaaacgaatgccaaaattaaatacagtaatttttctgctgtgctaagtaattcatttcatttcttttgtttcagggctgagctcctagatgctttcataattaagaacaggttataaataataaattataagtcatgctcatcttttcagctaaattcctattcatgtctttagaattttttctttcctacttactgttatttactaccctagtttcttgctgtgagcctggtttagcttttctctttttttgtaagaaaaaaaatacatttttaaagtgaaatttatttaattgaaaatttgaagattagaaatgatgtctctttccaaagtccccaaagataccaggtggctcaagtatcatacattgtcctccagcttggtgctcagctaaattatactatgcacatatgagaaacctagaaatgtaatcatgatacacacaagacaagaaagccaaatgaaacagcccaatcagacatgtagtgttcttcaatactctttgaaattaaatgatgaattattcatttctgcaccagaaaaggtgatggcttgcacagcagtttgagtttcctacttattcccactttatgcttctggatttctttttctgaagatttaattattctattatttcaaaaggcataattcttatttcaaaaggcataattcttagtgcatgccactaagtaggagtccaacttcctgttaaaaagtccaatttaaaaagttaattttaataatttctgcacaatacaggtaccaggtataataaacggtagttcaaaatctgcatatcattaatgcttcatcccctgataagaggaatgagctaaagcaggtttcactgggttttccatgggtatgcaggagcctaggatgcctggatacatttgaaaatatgtatttttccatcaacaatgaaaatgcatatgaaggaattgctgcaaagtaacttgtcttctctctgtgatcattaagaaaatatcggctgggtccatgtgtcatcatcctgactttccttaggttatttggactttccctctggaaaccaagttacagttaaagaaggaaaaactataaaatgggaatacagaaccatgacagaatcagttttgtagtgtaatgcaggctctaataaaagaaatgatcaactttctgtataatgagtttgtgaagatataaggttgccaccccttgaggatttgtttggtttgtcatcccattgactaacattttcttatagggaatgtgtagattaccttataataccttatattatatataccaatatataatatgttatatccttatattatacctccaatacctcatattaccttataatcttacagcatctacaatttgcagaaaattctagctgattcattcatttctcttaaacgacatccaaactgtttgaattcactccccttgagtgggaaaaagaaaaagacgatatttttttccctacttaaatataaagtcattagtcacttaggttccagaagtggggtgacacatctatagcatgtatatcgtgactaccctaagttgggtcttcccaatcatgatcttgttttattctagacctcagaatccttctaaacacactagtttatatgaatttatcaaagtcagtttgtgaaatgaaactttgaatttcaaattccaagacttgaataaagatttaagtttcaaattccttgcttattgatgtttttctctgtctcttaaaactttctctgctgaaattctccaaaccatgatgatagatgtttgaaaagttcagataaaaatatataaattctcaggattttatccagctaaagataaatgaccatgggattaactgcaaactcctctttaggtatcaacaatatctcaaatctttttaatctctaaaataaaacctttaggagcagtgactccataatagcaaacaacctctcctaccatcaaggtaagaggtcaagaaaattcaaactaatccaatatcaataaatctaggtatcacttcaccccatgaaaaattggcacctagttcttaaataaagtatgctataaaaagtgtttatttaacaaactttaaacgaagtcattttcattaagaagatatgccattttgtttcactgcaatctagacgtattttcaggttcccttggttaagtcaagagcccaatgcagcatcaacatacttttaaataggttgtccaatctgttgttttagataataacaatagtcaaactagttctttttttctttctgaaaacaaaaagcagttggaggggtgaatgttttacctttcccctggagttgtggcattatggaagcccagtgtggcctgggagtcaaaggtgactacagattcctccatctttagctactctgctgggcttcttgtgcacagaggtttcagctcattcattccccctttgatttctggtctcattacatgcagactctcctttctctcacccttcccccaggatagagttctccatgtcacttcttatgctctgggcctgctgtgcatccaaattgattttcacttttccatgtcaaggctgcaatccatatggaaattctggaagcacagaggtgttcagaaatttgtttgaaacaagatctagccttaaaccactttgtgatttaaggagcatccagatgtttagacataaaacactattgctgtgattaattgaatggtttttctgaatactcaagttttacacatacatgggggtagggagaaggcctgttattataccttcactattcaacctccattgtacaaaattcatgatcattttaaaaacatacattagaactgcatttaagagttcacccttctctccattatcaacaagtaagtcacatttctagattacttcccactatagcaaatgaaagctcattagatagaaccaatacagatttgtgttcatttggctatttggtaccaaacaaattgttgattgaccacttaaaagcagaacgtatccacttgtttttgtaccttataagtccagcctctgctgtcttttatcctcagtttcttaaaacagtgatgatttcttcaaaatagtttctcagtaagattttttgtctccctctcttatctacatcaagccctctttttttttttttttttttttttttttgagacggagtcttgctctgtcgcccaggctggagtgtagtggcacgatctcggctgactgcaagctccgcctcccgggttcacaccattctcctgcctcagcctccggaggagctgggactacaggtgcccaccaccacgccccgctaattttttttgtatttttagtagagatgggatttcaccatgttagccagcatggtctccacctcctgacctcatgatccgcccacctcggcctcccaaagtgctggaattacaggcttgagccacagcgcccggcctacatcaagctctctttaaacccaggtctcttaagaccttggtatagaacgtggttcatggaccagcagcatctgcataaccagcagcaactgcatagttggtttgaaatgcagaatcatatgccccaccctagaattttcattttaacaagatcccctgggggatctcatcacattaaagtttgagaaacactaggtttaggaaggctaggaatttttcagagcctattagtagttagaacaaaaagacaggatttgtgtcaagtgaaggacaagagatatggtggtggaaagcacctgggctttgaagttagacacacctagattcaaatcttgggtcttgttcctttaggtctggaaacaaaagatttgtgatctctgaactttggttctagcatctgtatattgtgacttatcaaactttttttttggtgaaaattaaacgagatatgatcacacaaacaggatatattcattgatagctgatgcttaatacatgttaatattcgtttactcattcagtccctactatatgcttcttcctcgttcttaatggttgtcttttcagcatcccaaatcattcagagcatgattatgcactgttttatatattcagacatgtcttgaatgtatctaaatatataggcccagaaaaatgatacataaccaaattcataaaatataaacagttgaaagattttgattaactacactggaggattctgatagaattagaatgaaattagtgttggaattagcatgtgctccaatatttctgctttcctacaatttgactgacaaatatctttagactctaggccgaatgttgacatagatgaagtacatctttgctgtcttctcacttctcaggccatcttctttgcgttttagagcccagtccctgtctctgtatcacaccggaactgtcgaaaagctgtggggctgataattacagccctgtgctactatttttctccatgtgatttttcttttccaacaaaagtcacttgttctgagctctgtactttccagtgtcaaggttgggcacctgttacgccttagagcagtggttttcaaaatgtgatttcaggaccagcaacagcaccagctgggaacttgttagaaatgcaaattcttatgccttacactagatccgatgattcagaacctccacaggtgaggcccagaagtttgtgttttaattctgatgtgctcaagtttgggaactaactacatgagaactaactatagaatggaataaactgtgggactctaaacacagcaggattttctagctgtaatagtcccccagacgtcacctagtttagtggttctccaccctggctgcatattggaatcacctggcagctttaaacgacaccaatgcttaggtcccaaccctggatgttagaatttaattggcccagggtgtagcctgggcattgggatttttcttatctcccaggtgattctaaagtacagccagagctgaggaccactgatcaagaccagccctagcagcatatttaaatcacctgcaaactctaacaatacctacctctcctatctcagaccaattgaaactaaatctcatggggcctgagcatctgtaagttgtcaaaagtcctcttccctgatacatggggaggttgagagtcactcatcaagtgtagcgctctcactttatagatgaagaaacatggaaaattcttccccaaaagcccatgatcagggcttagttcctgctgatgttccccctcctcctgggcattcatattttaactgaggacattttaaataagagtagggatgggagactctcaggcccttccaccacctttggagatatctgggggcctggtgtcttcccctcccctgccactgtccctgctctgagcaagctgtcccagggaagccctggggaagtgtgctcatgatagtgagcaggaggcctccagcatgatcattactggagtgtatttttcattgatttgataaattctgttttactccatgggatttacaaaagtaggagaaaggatttctgcagcagggtctaattctgctttaaaatgccacaaccatctttcctaggaccacagaagtgcttttgcttagataaatgtcattctagacctagggcgtcaccgggattataacgttattgaattttccgtctgtacctctaatttgcatgttgcaaaaataaactaaagattttatacaaaaattagttctgaggtgaccggatagatttttccaattcacattaagccagtgtatcctctggtgagggaaaggaaagataatacctcgtctggaagctggaagagacttcacctaaatttcttcctgccctggacaaggtgaaagcgaaagtactttaaattaatgtttccttgccctagctgcttctttatattgtctgcatttcccaagcaattttcaattctccttgccaactcctgctagagtgttagtaccctagttaataagttattatgaacaactaaaagcatcccagcttcaacatgtactagctgtgtgaccttgactgtgtcaaccctgctgagcttctgctcctctatctctaaaacaggaacactaggacctccatcataaagttattgagaataatggagagtatatatgggttttaaagcactcagtgcctgacatgcaataagcaatatataaatgtttgatgtcttattaccattgcacatttccttttatcatcttctccaaacataaggaaaacaactgaccagtagactcttcattaaaaacaaaacaagaaacatacattaaaattattaactgttactaataacttacccatatctaagacctgattttcatttcatgaatgatcttagtgactctttttttgaatcatctccaaatttccatttgaattttaatggcataagcagaaatggacacttctatcgggtctgattactgtctgttttagtgagaaactccatatttagccatctgaatttcatttagttgccctgaagtttatcttcagctaggatggccaaccattctggtttgcacagaactgagggacaaatttttctaccccatcttcagcctgtggccagctgggcccttatgtcttggcagaggcagcctgatatggcagcctgctccactaaaaattccttaatcctgagatacccaaatacctggcaatggcagtctgcacagctggagagggtcaaatttaccccaacagaattacaagaactgaatgggtaaagactggcttcagaaagtaaatattgggaagaccagaatattctctctacttaatgatccacctgttgaacttgataggtcctttagcccccttggaacttcgcttttcttatttggtagaatgggtataatataatgttcatctgacagggcagttgactgatctgaagaagcaatatctgtgttcctccgtaagtgttcattgcatacaggccctgagttagactctcatttctcccacttcctcattctttgacctttggcaagtttccttcgttctctgagcctcccatttctcatcaatgaaattgggcatcacagcacctcccttacagggcttttccagcccacctgaggcacgaacctgtgcacgttcacatccatccaagcctctgccctgaccacaccagttgcatccatatctgaaaggagtgatttcccccaggaggtttctaattggctgaaaaagaggttctcagccttggatgcacattagaatcatttgaggacacgtaggaaaaaaaaatgccaccctccaggtttccctccagaccaataagtccaaatctcagagggtagctcagagggtttaaacatcactttctaagttttcactgggcttgagggagggcacagagctccccacaaagagcaggtatcaagagaggcccatcactgaccccagacttgtccatgaatatcagagaaggaattcgaatcaagccctggcctttgatatgtgtcagttcagcttactgatccgggcaggtttgtgaataggagcctatagactgttccctcttttccaggcgttccacttcttcagttggtctccaatttactggccctgtttccataagcaccttgtaaagtaagttcaccacatgagtcttttcttgtccttaggagggctcatgtctgtgtctgtgtctgtgtctttacaaacagatgctctaaagtcactctgtatcctcccccttgctgagcaagcccttcggaggcagcaggatggggtgctccagccagctgggttagtagagaaggcatcagccagcccaagtggagcagcatgaggttccttagccacacaggccaggcctggaaatatccccattatttcctcacttcgattttcaagcagtttaaccagaggactttcttagggtggatctacctcaggagataagaccaaactttatctgagtcacaagtttttgttctacaccatttcattctctgccttctttggcactcttgaaactggctagtttcttaggtaacccagcaaacaatggaaataacaaaactgaagatttcccaaagttccattaaagactggccactttgtgacactgagatttgggtgatatattgcctagttggagcatcagtgtttttcaaagcattttaagctgtagggtctgagctgagtgggtctgggtttaaacatgacctcctagagggagaacggacatagacattatcacaaacatcttaacttatagaagaagatgtcaagggctggcactggaagacactagcccaggtggcaggcttccttgaccagtcgagctggagcctcattcccagcctcctgttcagagtggcttctgataaacactggagcccctattaaggggcttctagaacttactagtgatccatgagccacttgtttctgcatcttcctatgggggaagagactccatagtttccatcatgttcacaaagtggcctgtgatccaaaatagctagttttctagcccttttcattataagaagtttactttaaaaattcattcataatgattagtatacatatttggggggtattaaaaagacagtaattatattaccatgccagttctaccagtcacaagtatgaacaggttgagtgattgatgaaggctttatgccatagcttgttgtatttccactactatgaacaattgctaggaaattcttagggttagctaatgtccattccaatacaacctaggaattatttacaaatttaatgtggcattctgcctaacacacacacacacacacacacacacacacacacacacacacacacacatatataatctttttcctgagaagtctctgcaggttttctagaagattagaaagctcataataaatattttgttcaataattgaaatgtgctttattgccattaacatggcaagccatctgtgagaagattgtaaaacatttaaacattgggtgctagttggacaacgttgtgagattttaaagcacttaaacattgggtggcaagatcagtgactacattggcctcactttgctatcacctgggagctttaaaagagactgattctggcatcctacttctagagattctgacttaattggtccagagtatgatctgtgcatcaatatttttttaacttctcattttgaaataattacagactcaggaagttgcaaaggcaatacagagaggttccttgtaccctccattcagctttctccagtggtaacatctctcataactccagtccagcatcagagtcaagaaactgacatgggaataattgtgttaaatagaagaccacagaacttatttagatttcactagtttgagtgtcaggacacgtcacagctccccaggtgattctactaaatagtcagagttgaaaacttctgccgaaagtgctgtttagggtttcttctaaccatgagtcagggattctacacacacacacacacacacacacacacacacacacacacacacacacacagtaaaataacacaccatacacatgtacatgtgtgcaagtgcagaccacatcatgcataggcatcctgaaaacttgagacttttaataacattgcaggattaaagtgactgacatttaaaaggaaacttaactcctggaaaactgtacttcaaaattgtacaaaatatattctggtttgtatcccatgtcaaacaaaagatgtctgccatacccgagaaagtaaaccagggcttatgactcccagaattaaagtccatattagtaatgagaagaaaaatccatgggttttaaaatgtcatttatgcatgcaatttaggtcttaaagcctgataacatggtaagatacttcttgcatgcataattatgtttataaaattgccatttatcatgctccaaatgcatgtaagcaactgctgttctctgtaaataaatcagtgtttccttctctgccgcctgggaaattaaacactgtcctgggcaagtttccatactttttcctctttaaaaagagttgaaataggtattaatcagtgaagcagtgggagtaatgaataaccctcacatctcatcctagcgtctactctccggtattaactgcaaggttaaatagggacatttgtaaccataacaagccccaagctgaacttaagtcagggtacaagaacttaacccccatcttacacaaagagtagatttcttcttatctgggataaaattttcatcaagatacttttggaatttatttactaaggattgtctgtgcaggatctgtcagattccagttgctcccacctgcacctgcactgtctctagatactggtatctcaagttctttcaaattctctcctcccccacacccaaaaagcaaaacccattgtccctgggttttcaggtacacgatgagaaagtacccatttgcaattgttgtaccttgagtgcttgtctcaaaaactaccaggaagaagctcaggcccagaaaaacaaaaactggttggatccagagatgcctgagctggagatgaactttggcaaactcccctcattaccatactaaaaacccacccagggaggagcttatttgccattttctacacatgtgacacatgattggcagctgcgcctgcactgcctttactccacctctacatggaatgactcagctaactaacccaataaaagccctgtttcacctttatttggggaagcactgccctgggagctatgcctggtgtcctcctcacttggcaagtaataaaatcatcttgttaaatcctccttgtctgtggtcattggactgccacccaccaggccatccaacctgcccatcgtgtgggttacagtttcagatgagaaatggctgactcttgtcttcagagacctccctggactccttatctgtgtatcttcttcctttacagtgacaggacctttttttcccctgattcctccagggtactcagtgtcctcatgttcccctgacaacttcctgtttctggcctggatcctgggtctcccaggggaattttacttagatgagttccataaagttctagagcacagtgaatgtttcagtcagttttgaaaatattctttctacctaatattttgaggagaggttcaggtctggaatggcatttacaggagcccagcaaggctcctggtgacctggaagtgactgtgatggaacctcgtgtacatcagccaaggggagaggccgatgaagcctcctgattctgattatataactttcctgctctggtctcaggccccaaaactcagtcctcagaggggaaggaggacggggtgggatggagggaaatggaccattctcagagatttgggtacaaatcatcatttcctcctctttgctacacttattgatccatctttttattttcttacttaattagctgtgaatttgtagcatcctgagtaaattcatttgaacatgttgattatcgtagatcaactggattaagacaacaatattttggatattaccagattaagcctttcctgtgaacagagaaggtgcttgactaattatcatgatttcagacatcccaggagaggcctccttagaatgtccttagcccactggggaataccttaatgtatactcttatgttcatggcttatgtttgtgggggtagtgggtggctgttgaaatcaaactatattcttagacaggttacattattttaaaggtgcgtgtctttgatttacatcttaatggaaggtatctgaccttttctagaggcaagcattgaacagagggaagaggtaaagatcaaagaacactctaagtaaactacactgagttcctggggacacaaaagggaattctagagggctgggagccacagaaaaatgtcaccttcctctcaatttcctcgcttcccaactgccacaccatggtcataaaaataaacaaaaccagtctgtgccatcagcttcctggaccatctaggactgcatgcagatgcattttgttttgttcatccatccttgccagtggtatttattatctggatccattgaatcacttattttcctgtctgtgagctggcctattttgccagtttgatgatgtgtgctgtttactagaggagctattaaatttctcacctgtgtatcttgtgagagctgcagctagaagataaagcttcttggagtgtggagcattggtatgtgagagattttcaaggacatggcttccttcaaatccctgctacacaatctagattagaatctaaataaaacatccacactagctatccttataggtttcagcagtccatcataacaagattaattccaggctggaaacattttgactaggatgctagatcattaacaggttttatatgctgaattaaaactcagatatcacaaagaattgcctaaaagggaacaggaagccttggttgtgaagtgtcaaatgctggaaggattctgtcaatacttgacaatagctagcaaaggtgtaagaacatgaactttggggctaaacatggctgggttgaaatcctggcctcatttaccagcttggtgactctaggaaagttatttgacctctgcattttatccaataatgccactgcaaggtattgatcatatagatataatgataatagctagactatatacccttttttgtcactttatatgttaatttgttaagcctcccaacaacccaagaaggtgatactattatcatccagaggagacagaaacacagacaggatgactagcccaaggtcaagttagtcagcactctcatgagaggcagtttggggcacggttaagtgggtgggctccaggccagacttttggggtttgactcccagttctactgttcactagcagtgtaaagggattagaatagtgcttgctacataaaaactaccaggtagtattttactctgagggaaataggatccttcctcaagctattaaggtaggcagcatctgctgatttcaaagtactttctaattgtagaaacaagagccgtttcaagtcaattccttaagcagcagtgactcctgtatatcctttgcagtggctttattcagctcatagcttgcctcagcatgtaaagaagcagatcagttttaccatttctattctcggcacatagagccaaatgcccagaaataatgtgatttataccaagtgactctcctcaattgctctgtctccaggacactcacttccctcccatgatgcagttattggggttgcctgcccctgacccaggagaacctgccttcgtgataaagcaacactgcccccatctaagctactctctggacacctctatccagcctgctcacctgctcgtaaaccatgcaaattcttcttaacatcaaccattgccctggaagagtctagaagtagggatatacactgcaacacaatattcctagatgttgttcaatatgagatttttactccaatttctagctgtcccctgctccattcatgcattaaatatttattgaggagctgctttgagccataattttttgtagttgctggggatgctgcactgacagtaaccatcattgttcctgccctcgtggatcttacatttgaagagagaaaaccaattaaaaaagtaaacaaataaaactatgatgtgataggtggtaataaatgctactgagaaaaataaggcaggttgttagaggtgggccagtgatgtcaagtgggggccagggacagatgaggtaggtttttaaagaccagagtgaacattttgaatcttattgtcagtgtaataggaagccacggtgagggtgagagcagggaatgatatgaattgattggcttttgaaaaggtggatcatcctggcttctgtgtggaattagactgtattagaactagaagagaagctgggagaccagtcaggaggctctggcattagtccaggtgagagaaaatgatggtttgaaccacagtggtagaggtaagaatggtcagaatctgagattttctttgatggttcagtcaacagatttgtacatgggttggatgtaagtgagtgaaaagagaagattaaaggaagactccggagtagaacagttctgcctttccctgagggcagatttttttttttttctaattttactttaagttctgggatacatgtgcagaacatgcaggtttgttacatagaaatacgtgtggaatggtggtttgctgcacctatcaacctgtcatttaggtttcaaaccctgaatgcattagcgatttttcctaatactgtccctccctttgcccctcccaactcctgcaacaggccattgtgtgtgttgttcccctctctgtgtccatgtgttctcattgttcacctcccacttaagagtgagaacatgcggtggttttctgagacagatgtttctttacttgtgttatctgtgaatgtctttctctcctctagatttaaaattgcttcaggacccagaattcttagatattctggtttcctcttatcttttccttctcttattagtgactcatagtactttacacctagtaaatgcacaataaaagctgtgaaacaagtaagttataatgcataagatgtttattagtaagtaaatgtccgtaaattttaatatttgttctgaatttgctgtatggttttggaaaaatggctcactttctgactcaactgtcctattatgaaatagcgttcttcatgtttgcctttgtaatgtagatgtagtatcgatatacttaatggtaggtggcagacaatttggggatatgggataaagagtcctctattatctgcagtaatggaaaaagcagagggggaataattgggggaatatgtcttacggaggcatcatttaatatgcattttaaacttgcaaggtgcattgtcatcactcccctccatgccactggcagacgttgctgattgtccttccctgagaggtctggaaatggccttagaatctttctcaatataacatgccgaggtaccattctttcctgacacaatcctttcatctaatagtggaggaaattagaacccagatatagtaaatgacttttaccaactcacaaagttcaccaagcagtgggaacaaaattggagcctgagcctgaaccctgattcccatagacagaatgatcagggctccagcaccaaggtctaatggaaggggaggaagctcttggggaatgggaagattgggcagggagtggggccctagagtcagcagtgaggtacagaagctcctcaaaatgtgcttggaagagaaaggggttctagagtccattgctctgtagatgttttcagtaccacagacggacggctggctgttgtctaggattcttatttccctttacaactctttaagaacagaggacatgtataattaaatcacagaggttgtgatctgacatgctaatactgcccttgaatgtggatatttttcttgtttattaaatacttgcagaattaaaaagcaacctctcattgcctattgaatctgagttcactcaccttagacacaccacaaaatggttatttaatttccttaacataaaaagagacacaaacatgatttcaattgggttactagatatgccatcgatggaaatctagtctttatgattgaaatgatggctgcttccatttaaatcacaatgtagtattctgctcaggtcctgtactcggccacgctgtcctccccagactttgaacaataaaaggtcttacttatttattctcacacaggcttgatttactcattactatgccaagaaagaaaaatggcttttgttctctctgaaaaagtttctgttaaacagatatctcttagtgagtcaacccaaataccggatgtgagaataatctttaagctgaactttcccctgggtgaaacctgagcactttgaacaatgactgttttttgtttgtttgtttgtttttgtttttgtttctgttttggcagaaatctttgatagatcattaaacatttttatgtagttgataattctacttgtagtgggttgttttgagattttagtgaattggaatattttaaaaaacaaggtaactattattaaagctaagataggaaatatgttatctccttataaaatacatataagatactttttacattttggttgagattaagattatatttttaagtatacctttaaatacttttcccttgaatgtaaggtgtaaccctgagagtagttattaaatctgaagaattttcttatacctaacaccaatgccattttctacacattgtgtcctaatgtaaagggcatggtattgggaggaggaagatctaggttctagacttcattttatcactaacttgatgcatgacctgatgtacattacatgtgtccacccaggagggagagctccatttccctatctataaaatgcaggcataggactgattaatttgaaagcttctccagagaaatatcattgtataaactgtggtgttgcattatccaaatttttctctaaacaactggttggttggccaggcgcggtggatcatgcctgtaatcccagcactttgggaggccgaggcaggtggatcacaaggtcaggtgattgagactatcctggctaacatggtgaaaccctatctctactaaaaatacaaaaaattagccaggcgtggtggcgggtgcctgtagtcccagctactcgggaggctgaggcaggagaatggcatgaacctgggaggcggagcttgcagtgagcggagatcacgccactgcactccagcctgggtgacagagcgagattccctctcaaaataaataaataaattaattaaaataaataaataaataaaaatttaaaaactggttagatttttctccctactgttattatagggacaaaattatattgcagatgatttagaaaatacaaaagaaaagaagaaaaccgaaattattggtaattgcttcaatccagagttaagtactattaatattttgatgcattttttcaggctttttatatgtatgtgtgttacatataacaggatctgactatataaatattttactaaactttgtatcttttcccatgacactaattcctttaagaacctacttttaatggttgcataatatctcatcccatagatttctcataatttagttatttcctaatggttagacatatattttattagcatttttgctattatcattcttgcacataaatatttatactgatattgatttatttgaagagatttccaagcataatattaccagtaaaagatgatgcatgtttttatcaaattttggcatcaggattatgctgcccttataaaatgagttgggaagtgctccttctttctttgtttcctgagtctataaaattgttgcataattcattgattttacattcttttccttttcactatagagatttgaagctataaatttccctctgagcactgctttacctgtatgccatagattttgatatattgtttcattataatttgatttaaaatatttttaaaatttccttttagatttcttctttgaccaaagggttattcagaggaatatatttttattttcaaattgatttctaatttaattcctttgtgatcagaaagcatattctgtatcagcagttattcaaatttttggtcttaccatctttacacaagtaaaaattattgaagactccaaagagcttttgtttatatttatatttaccatattaggatttacaactgagaggtttttaaaataaatatttgttcatttactttaaaagagcatgttaacacaaataacattattatgaaagacaactatattttccagaacaaaaaatagtgaaaaaagtaacattgatttgtattttcacggatttcacaacttgtctttaaggtctggctcaatttggaaagaacttgatttttatatttgtttcttcattaaatctgttgtgacatcacatgttatccagcctgtagacaattccactgtacacctatgagaaaatgggagtaaaaaaggcaaataatgtctcattattttgaaaatagttttgaccttgtggacttcctaaaagggtttcaggaacccccatgtgttccctgtattatatgacgagaactgcttatttacattatttttgatccttttcaatcttctgagactcgttttatagtccaacatgtggtctaccatggcaaatgttctgtatacacctgtgtacatctgaaaagaatgtatgttctgcagttgttggataccgtgttctataattatcaattaggtcaagtttgttttcggagttgttcaaatcttcatcttttctgatttttattttttttctatcaatttctgagaaaggtgttaaaatatccaacagtgattgtagatctgtacttttctctttagttctgtcaaattctgtttcatgtattttgaatactcgttattaagtgcattcacttctaggtttgttacattttcttgatatgaaaattataaaatatctacatcctaatttctaataattctttttgtcttgaagtctactttgataatgtagacctactgtttcttatgcttactatttgtaaggtttatatttttctaatttttactttcaaccagtctgtgtctttagatttaaaatatgtttatgtatatttaaatagatatcacatgtatttataaagtattatagttttgcatatacataaagagagaaaaagggagattttttattttaatctagtctgttcatttccacattttaattaaaatgtttataattcatttacatttaaataattattaatgtgattgagtttaatctgtcatcttggcatttgttttctattggttctatctggcctatattcctttgttgttccttttctgccttctcttgggtaaacacattttttttagtattccatttgatccctcttgtgaacttttcatctagccctccttttgttattttttaatggttgctctagtctagagactacagtacacatctttaacatattatagtatgccttaaactaatattacattacttcacaaaggaagaatgtcacaacagtataattccattcaaaccacctcccctcaatatttgtgttttgtcatatattttatttctacatatgctgtaaacttcataattcatttttttgcttttaataatcaatagtatttttaataatttttaaaataaatataataagaaggtcttgtctatttacccacaaatttatgccttccagtcctcttcttcccttccttaccaatcttggtgcccattgggtattattctcttcagtaaagaatactttttgtgaaaaaaatcatttctagagggtcagatgtgcagtaggtaaatactctgagcctgtttttcttttttctgttgaaaatgattttcattttgtcttgacattgtttaataaatttattgaggcataaattaactatcataaaatccgcacattttatgtgtataactcaatgattactagcaaatttacagaattatacaaccatcatcacaatagttttagaatagttctatcttccagaaaaactcctcatgcccttttgcaggcagttctttctctttttcactcccagttccaggcaaccattattttacttttatggacatttcatatgaatggaataatgtaatatgtggtgccttgcttcttttaatttagcataatattcttgaggttcattcttgttgtagcatgtcagtagtttattccttttaattgatgaataaactgcattttgattatctgctcaccagttggagagcattcatattattttcattttttggccattataataatgctgctataaacatttaaaaacaagcttttgtatcaacatatgtctttgttttttcttcagtagatacctaatagtggaattcctgggtcatatgttaaatttatatttaacttttaaagatactatcaaattgttttcctggctaggtgtggtggctcatgcctgtaattccagcactttgggaggctgaggcaggcagatcacgaggtcaggagatcgagatcatcctggctaacacagtgaaaccccgtctctactaaaaatacaaaaaattagctgggcgtggtgacgggcacctgtagtcccagctactcaggaggctgaggcaggagaatggcatgaacccgggaggcggagcttgcagtgagctgagattgcgccactgcactccagcctgggcgacagagcgagactctgtctcaaaaaaaaaaaaaaaaaattgttttcccaagtggctataccattttacattctcacgtgaaatacataagggtttaccttcatgtttgaaggtcatcttttgctgaatatagaaatatagttgatagtttatctttttttccttgacttaaaaatatgttgttcccttgtattctggccaccattgtttcccataagaagtcaatagtaattcctgttgttgttctcctgtatataatgtctttttcttcttcctgcttgatattttctgtttaatttagaattttaggagtttatgacacatctaggtgtggttatcatgaagtttgatgagttttctggatttatgcattaatatctttaatcgatttgaggaaaatcttggctattatttcttcaaatgtctctgcatcattctctctctctcttctgcttttaagactctaattatacatatttagaatactttatattgtcccacagatctctttttccctattttaaatctagtctagataaagtattagttttacagacttactctttggctgtgactctttgggattctgatccattattctagcccacatcaaaccataaaagttttctgtgagttcatctggtttctccttatgcctctctatggcaaattctttctcccacaactacaccaaggatgaaagcaaacatgtacttttgctcccatgggaagggcttaccgctttatggaatttggttcatttaggctttcctttcatcagatctctgggtttgaaagaaaagctatgttctatatgtaggtcgtgttcttctggcttattctttctttctttctttttttaagagacagggtctcaccctatcactcaggctggagtatagtgacacaatcatagctcactgcagccttggactactggattcaagtgatcctctcacctcaacctcctgagtagctgggactacaggcatgagccaccagtcctggctaaaacttccttcttgataaggtgatttatgtttccaccactggcattctacatctttctccacttcaccttctataccagatgtctcagagacacagcacaaagaaaactccagccaaatgcacaataactattctttaatagagcatttgccctgatactctttttccttacttattcctattccagggctggttgactttgaaagtaacctaaaagtctttgtcccttttccttgagcctagagccagtctttcatagccaggttcttgtttctctactcttgacactctaacactacactcaaaagacatatctcagtcaaagaggaatgtgatttctcaaagctccagtatttccaaaggtgccctccataaccaaaggcaccccaacccaaatcccaatctaagcagttgtgaatatgtataatcaacctgccattttataacagaaacagccttcttgtgcatttccctgtggcttcttacatttccttccttaccttcctctgtcctagctttttgatttaccacaacccttacctgaaaaggaagagtaaataaaaaaagatataggactgacatttacttttctaaatacctttttttgggacagagtcttgctctgtcacccaggctggagtgaaatggcatgatctcagctcactgcaacctccacctcccaggtgcaagcgattctcctgcctcagcctcctgagtagctgggattacaggtgcctgccaccatgcctggctattttttgtatttttagtagagatgggggtctcaccatgttggccaggctggtctcaaactcctgaactcatgatccacccacctcaggctcccaaagtggtgggattacaggcaggagccaccgcccccggccagtgcctttcttttaagcaagcttgtccaacctatggcccaggacagctttgaatttggcccaacacaaattcgtaaactttcttaaaacatgatttttttatgatttttattttttagttcatcagctatcattagtgctagtgtattttatgtgtggcccaagacaattcttcttcttcaaatgtggcccagggaagccaaaagatttgacccccctgcttttaaggatgaccttcaagtgcttagaaatacagagcaagtcatttgatggctctgcctgccatttttatgcaggtataatctttttaaagtatagggcattggcagcctgcagcttgacaagattcagagatataatcataatgtatttccaattatttcttacttatttgaaattttatcaatgataaatgtctattactaattaagattttttaaaactagtaactttactagaaaattttttctgacctcattcattttaccagttttgctttcatgctcatttcttaagctcagttttctcccttggtctctgtcttgacacatgctatccatcaaataatgatatggctacctgctaatttgctaatttaagacattcaaattaactttaaaagaaaagttttccttcaaggattcattcaaggattaaatcctcttgcttctgtttctatccccatttggcttttgattctgtataaaattagattttgcatttacagcaatacacttcaacacacacacatgtacatacatctgctgtattagttaaggtaatgatttctattttaccagatacactctaaaatttcgagggcttaccagaagagagacttatttcccactcctgtaataccccatcacaatgtgatagaagagggggttgaaggaaataggagtgtgctccatggagtccttcaaagatctagaatgatagaggctctgccatcttcaacacttcgctcccaaggtcagcttgaagaggagaaatgaaggttctaaaggaagttcttatggctgaaagtagcatgaattgttttctgctcccactccattggccagaactcagtcacgtgatcacaccagagctgggccctgattgggaaacaacttttcagaaacaactctgtactatacagggggagcacaaaccttgggtggattttcagttatctctcttatatgcataaatacatctaagacttcatggctaagtccctaaattccagtataaatctctaaaattctcaaagcttgaggaattaaggagttggatagtggagtaggagactttatggcaagcaccgaagactgtcttggtagtagtagtagcaagtggagctgcaactagggtagaagatctcagaaataatctgtccatgaaaggaagcaaagatgtgattagcttatcttatcattcactcatgcattatttcattcatttatcagacattatcttgaatagttgctttatggcaggcaatgtgctaagggctgaggatacaaggataaataaattatttataccatctagtggggcagcagctgtaatggattcatgtacattatgtatgtgaaagtcatatacattattttagtggaggagaatggctttccactgaggtagcctaataaattcccagtgtagtctcagaaacctattttcctattggattctaacatttccctcctttgtatatatacaggccctggttccaactttgcattctattttcacggacaatagtatgataatatttacttagtacaaagatccctcggccacatattatttgcagaatggatttaaaaggggtgaaattgaatgcagggatggtcaagaagctactgtcgtagcttttactggttctctcttctattaggaagaaaatttaaaatcctacccataacgcacaaagctgttcatgtcaagccactgtttaatagtctagctgcttccccatagcttcccacccctgatccctaactccactttgggcagcccaacaatattgggctactcatagtttctcacactttgacacctcattctatgcccccgtttatatataaaagtcactctctgcttggctgcccatttagaaaactaaaaaaccacttacctctcaaaatccagcgaaatgtggcttccttagagaaatcttctctaactctccttcctgcaccaaacttaaatacttctcctatgctcctactgtattttgtattcatatcatttatgacaatataatttatagtatattacataataccacatcatattataatttttcatttctttctaccaagacctctttaaaggaatagtgacttgtcatctttctatggcctgtgcctaggttgatactgggaacatagtatattcaataagtagtcattggatgggtgggtggtggatggatggactgatagtgggttgatatcatcatatgaagaaaccccctttaattctttttttttttttttttttttttttgagacagggtctcgctttgtcacccaggctggagtctagtggcatgagcttggctcactgcaacctccacctcctgggttcaagcaattctcctgcctcagcttcctgagtagctggtattacaggcatgcatcaccatacccggctattttttttgtatgttttttagagactgggcttcaccactttggccagactggcctcaaactcctggcctcaagtgatccacccaccttggcctcccaaagtgctgggattataagcgtgagccaccatgtctggcctaacagcaatggaaaagcagtgaaggtatttgaaccaggggagtggtataattcacagaactagttcacacaaagccaaatctggtggtactgaataagaaggtgggatcagcagggaagcagagtgagtcggaggctgataacagacttttgttatttttgagttgctcagcattctaatgcactttctatactggggaaattcactccccattgcctatggtggggttgttacatgccacaaagaggccatgaagattaagattaccctagccaggcttcctggcagttggggttggggtgtgtgactcgggcttgaccaatgagacaccacacccgaacttttgactctagagggtgtgacacaatgtcacagggacagttagtgatcacttatagcagcacaggagcagtgatgaggacagcattgggagggttccagtggtggtatcctagctacactggtttctgtatcattttggctgtggtcttctgcatcttagaccttcttggtttctacctagtttctgaagctgtttctcaagattcttgttaactctgtaagagccacctgctcatcccctatatgttactgttttgctacttagccaaagatatttcctatcatttgcatccaagtgctctgtcaggtataggaattggagcagtggtgacactggtgggtgctgcccagcatccctctactcctaatctagatttttacttgcatatccttccattcccatgcagcccacacttcagggaaaactgataccactcctcactctaggggtgagtctaaattggctttttcaccagaatgttaaatcagcacattccctagcccagccacagtcatgttcagaggtgaacaggtgacccaagtgtccctgttgtggaataaaataaaggcagagggcactaccggcagctgtcctgggaatcagctttagaatgacactgaccttcagaagacggagctagagagacagcaccttgcgataacttcactgagcctctggcttaaccagccctgaaccaaaatcaagctatggattgccaatggaagaattcaaagatgactaaagttacgatgaaaggtgagtggggtggaaggtggtgtcacagttaaaacaggaaatacagaaagaggatcaggtttggtgagaagattagatgttcaggtccaaatatggtacgtttgcttttctagaagtctttttgcactttaaaatcctttaaatgcaaataaagagtaaggcttatcaaatactttcacatgtttacacctcaaactaaagtctaggcatttttgaaagattaaaaatagctgcatagaaggaccacaattcacagatttctgtgttgcttttctcatgctgtaggttttagcacaagaagaaaagcagtgaaaaggaatctgcttctagagttttgactactcagaactataacagtactgcaataatattcttccttaattagtgccaataaaaacgagtatctcttaccattgtaagaagtaatctcattttttatccttccccttctttttttaattttttttgcttttttttaacatggagataaatgatattagctacagattgaaatgagcaaatgtgtatgtgtgtctcattgtcatgtatgtatgtcacaaatgtactcttgtcatctgtataactaagctatttcagttacagttaccatgatctacccagactgaaacccttagaatctcctttgaacacttctccctgtgcttttttttttttttggtacttccaatatgtttttctcctcactttatcccccatccccagatcattaccttgacagccaattaattgttaaactctaaacactttatctccgtggtgtttcccacattcatttcctttcttatattactactgcatctccgtaatccaacccctattgcctctggcaagagttttggagtcaccaacatttacaatccttccccacttcaatttaacctcttgcaccactcttttcaagaacttttgatagattcacataccttactggatgcaatatgcccactcttaaccctggcactcaaagtcctcagctatgcggccatgaccctcctttccaatcttattgtaacccatcatgccctgctcaggctttccattccaattaaataagctgttcactggtctttaaacacatccctatccttgcctacaaggctttgattcaccttagctctatccagcatccacatcacatgcccttctttttccttgaagcctttcttgatctttttcagtgggtgagacctttcatatctttaaggaactttcccttgtccttggcaccatcttccccttagagataagactttgaaaccttgaccctttagcacctgccttgctgtctctgaaaaccaccccatctagtctagtcactgagttctcttatatttctacaatgtcaccagcagtgctcattgctacttacagatttcaaccaagaaattcagccaagttgatttctgttcttctaaagttacttcgagatgccaatttctttccctcctacttttgctgctttccaactgtgtcttcacatcaccactgtaattctttccaaagtgcagatgtgttcatcatccctcctctagaatgtacaagtttgtatagcagaaatgttgagaagttaagagttcacactttgaagacaaggcatttggatataatttagctcacccactgtccagctagttgtccttgggcaaattacatcatctctaaatggggcctatggtgaagtttaaatacattaactcctatgaatgtttacagagttccttcacaaagttagccctaaggaaatgatagtatgataggatgataaattccaaatttcaactgagataacataagttaataaatatgacattctaaacagaggtaggtatcacaccaaaatgcagattttctaagcaggtggcccaaaaactagatagatagcactatatcctgaaagggagattagtaagataaagggagtggagataaaaagatccctaccaaggttgtctttgtagaaatccatgctgagactcctgttgggacctcaagaggaaggtttaggatgatgcctgccccctcatctcaagactgcttgggagaaggaggagcgtcctttccatggaatcatttgaaaacgtgaatatctagttcccaatgattgactcccactttattgtcctttgttatttaatctaggtttgtccttgtgtgtgtattgaacaggacttttttagttgttagtgacagaaacaatacctgaattgggttgaggaaaaagagaggcattggttgggataatgctagcatattaaaataaccaaaggaagagttgaataatgagactcatggcaggacagggcatcactgggcctccaaagtgactgaaaatgaggactccgatgcttccagaatttgatgtcctttctccactttttctttctgtttctaatttgacttaattcaaaggcacaagagaaaaacacagcagcaacagtcccaagcttctgacatcacaggggactggtgcttttgacccagtttaggtttggaaaatcctcatgagaagtctgaccagccagctaagggcctccttcagacacatccaatatgggaggagaaggagaagtttccagagaatgcaatgcctagaagacagggatgctgagcaaacaccctttttattttcatccctgtaattttttcgagtgtgtcagcttcttaaacatggtactgcccagatgaatgcacttggttctgatattgaggatggaaaggggaaaatatgtcttcctaaagaacgaattaaggcagggataaaactcttggacccggggaggaaggtacggcaaagaagaaatgacagtggcttcttaggagtgccactcagtgattagctgtaaggtatctgtggggcctcagcagcagtaaggtgctaactgggcagtggtggaatgaacactgtccctgagtctgcctgagggcactgcagctgccacttagcatggaccttctacacaatgcggagaatgtggattgcattttgtgcccctcttcctgttttcattgtccctatgacttctcatggacctctcctgcccccaccccaccatccctattgtccagtgacctgagtcatcttcatttacctcagcctcccttctcaggttcactctcctttatagggacctaggttgtagatttatttcttgtctgtgtgacagtacctgttctctgctggctttccaagcaaaagaattccattcattcattcatgtattcattcatccaacacactcactgagctctcactgcatggcaggccttgttgtttgggggcacttggagatatagctgtgggcaaggtagaggagcccgcttctcaaggagctggctttccatggagggagggagataacaactatgcagataaatatacagtgtccattagtggtcagtgcttggaagaaaaataatgcaggctaaggagatagtgaaaggagtgctacctagataggctgattaagacaggccttttgaggagggacatttaagcagagacatgaatgctgtggaaagatgaaccctgccacaatgatgggaatagtgttctagacagagggatggccaagcgcaaaggccctgaggtgagaatgtgtttttgcatgtgatggacagactcaagtgaggtatcataatggaagaaacacaggtgactctttaccataggaacaaaccttaacaccttgctcataataagagaaatataaactagaaaactcattgaggtctctagtgtgtgtttaggatatcttgattgctagtgtcagtaacagaatctgaattagctggagaaaagattggaaggcattgattcagacaatgctggctgagttcacttgtagaaatatgtgcgcctacagaaagagaaatgcaaatcaaagcttcactgagataatcacatcttacccaccagatgggaaaatgtccaatgcattctgaaacacatactgtggagaaacaaactttctcataaattgctggtggggaagaaaaatagtacaattcctgtggagaaaaatttggcaagagctagcaaaattacataggcatttgccttttaacccagtgtttccactctaaaatgtgtcccaaagatacagtaacaaaatatgaaaattcaaagtctatccattgctgcattatttaatagcgaaaggctggaaacaatccaaatggggactaattgcagaaacgttggtaaatccaaatagttgaatactatacaggtgtaaaaaggaaaaggcctatttctacatattactatggtgtgatcgccagcatcacattttatggtgattaagaccaagacagaaaatagtgagcaaagtgtgctatcatttatgggataaaggttgggaaaataatatacacatatacttgttactcatctgacaaagggctaatatccagaatctacaatgaacttaaacaaatttacaagaaaaaaaaacaaccccatcaaaaagtgggcacaggacatgaacagacacttctcaaaagaagacatttaggcagccaaaaaacacatgaaaaaatgctcatcatcactggccatcagagaaatggaaatcaaaaccacaatgagataccatctcacaccagttagaatggcaatcattaaaaagtcaggaaacaacgtgtgctggagagtatgtggagaaataggaacacttttacactgttgttggaactgtaaactagttcaatcattgtggaagtcagtgtggcaattcctcagggatctagaactagaaataccatttgatccagccatcccattactgggtatatacccaaaggactataaatcatgctgctataaagacacatgcacacatatgtttattgcagcactattcacaatagcaaagacttggaaccaacccaaatgtccaacaatgatagactggattaaggaaatgtggcacatatacaccatggaatactatacagccataaaaatgatgagttcatgtcctttgtaatgacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggataactttaggagatatacctaatgctaaatgatgagttaatgggtgcagcacacccgcatggcacatgtatatatatgtaactaacctgcacattgtgcacatgtaccctaaaacttaaagtataataaaaaaaatcagattaaaaaaagaatttttaaaatgagagaggctaaacaataaggatgtatgagaaggaaagaaagaatattttgatcacagggatagaagctggatttctttatagatctgtagttttgatttttgagccatggaaatattttatataattataacacaaaattaaagagaaaaacaatcattaggcatcaaaaacagatgaacctaacttagtctttagttggtggaatagatgtgctattctaaatgactgtaagacataatttgtatatgctttatgggatatactctaaggacaaaaataactagaaaaaaatcttaaactctttctggttgcattaatattgtgattccaaggctgttgtgcctatagtgtgggataaggcaactagccaattatgttgctggtaagaacgaagatatctggtgtgaaagaaagggatacaaatgtaagacttatgtgttttagcagaatctctgtagtcctggatctgaaatggaatgatcaatctgaactcatggcatatgttatctttaaaatatttacatattttctagctctgttcactgaaaaggcttataaacaatacccaacccagtacaaagagctcctgtaagcctctagattgatatcttaaaatatgttgaaatatttaccaagtggaactggggttccttggagaaatgcctgactccttatctaaggcaggaaatgaacaagatgagtctggaacatcttgtcataccataaggtaagtgccctttgaagatttgtcagaggactcaggaaccaacctgattaaactcccactagctaaagatgggcaatttgagcattaataagattaaacctcaatgtattgtagttttatacgtttaatatggttaaccatcacatatgtttaatccatgaattcctaatgatactttaaaaataaaaatgaaaaaaccctcagtgatctttgcaggataatagggaagtaaatcatgaaaaaaaaaaactgagtgcagtgtctcaagcctgtaatcccagtgactctggaggctgaggcaggaggatcacttgaggccaggaattggagaccagcctgggcaacatatctcataaaaagtttttaattaataaaggaaaagaagcaaatatttatttttgcctttattacaaaaaccatggctcaaagtaactaaatagtagatgagaagtagttcctcttaatggaagtgttccatgaataaatgaaggaggaatatcatcattgtgtaaatcctaataaatgaacgcacctaggcattgagcatgaaggcactaataccacaaaagagagacagccagactctatgtacccactgatagaagtacacatagcaccatctaggaaggagtcttgccagacctgaatcccttaagcatctggatctaaacaacagaacctacaggcaacagaaaaatctgttaaactacactgtgtcgagtttctaaatttccactatatgtaaattctaaaagacaaataacatggcttcatcaccaccaacaaactgcaaggaattagaaaaagaaatggaggagaactctatagattaaaagaaacatgagagacacagtagtttggatcccaatttaaataagcaaactattaaagaggaaagaaggaagagaaggaacaccaggatgcgatcaaggagagggggagaaaggatgggaagtgagaggacatcatagtacagctggagaaatttgaaccctggcaggacgtttggtgatactaaggaaatattcttgcttttcgaattgtgtgatggtacgtattgtgatttcaaaagaggaatcctttgtcttttagggatatatactgaaatatttataaatgaaatgatatgatgccaggcacctgctgcaaaataatctggagtgagtatggaagtgggtgaagacgtggagctgtggttttcaggcttgagcttgcatcagaatcacctggagggcttattaaaatacagatactggtcttccctccagagtgtctgattcagtcttgggtggggcccgagaatctgcccttctaataagctcactagtgatgttgatgctgttggtctggggaccacactctgagagtgactagcagagaggaagcaagattggccccttgttaattattcttgcacctgggtggtggatacatgaaggctcattattatattctgtcttctgctgaatatatttgaaattctccataataaacatttaaaaaacagatgatccagaaggccatacagaaggagcagagcctttgacaacccatagctgtaatgggaacttctatgctcattagccaaacaggcttggctgctgctaccacagcttcctctgggattggaaggtgtgcatctcctcctgctgagatggaggtgagtgtatcagctcagctgtccatccttttagagaattgcctgaactgaagggagggcaatggcctctgtccaaggggtctgtgcataatgcatcctttcctcagtgtgatcggtcattgcaagagcagtggtttggatgaatcccaaggttttctggccacttcagctggaaaggacactcctgaacagagctaagccaggactcagctctcagagatgagaggttatcaccgaactcaccatgcctttgcagcccttctgcaaaagcctccctgcaactcctggatctaggaggcacctctattggtttgagtctctctacttgcctttttagattcatttgtgtatttatccattcatctttcagatgtttattagagtaactcctaagtgtcaggcatccttctagcccctgggaataagcagggagcagaataggcaaaaatctctgcttttatggagattaaattctagttgtgaggacaagcagtggacacataaagaaataaatgaacagaataatttcaggtagtgaaaagtgctgtgaagaaagttaaaatgaagatgccaggatagtgattgactctgtgtgtgtaaaaatgtgcacacaatttttattttagctgattggggaatacttttccaaagagatgtgatctgagcggagatccagatgataagaaggagcaagccatgaagagatctgaatattttcagagagagggaatagcaagtgcaaagggcctgagatgggaatgagcttggaagtttttcctttgtttctttctttttttttggaacaccaataaggccaattgggctggaacaagaggagtgaagaaaggtgagaatgatatgagatgaagtgggagaataatccaagtctagtgtttacaaggccttgtagccattggccaaagtgtatctatattctagacacctccaaggctgcaagtcagcccctagctataaaaaaacacattctcggctaggggtggtggttcaagcctggaatcccagcactttgggaggccagcgtgggcggatcatgaggtcaagagattgagaccctcctggccaacatggtgaaaccccatctcttctaaaaatacaaaaattagctgggcgtggtggcccgtgcctgtagtcccagctactagggaagctgaggcaggagaatcatttgaacccaggaggtggtggttgcagtgagctgagatcgtgccactgcactccagcctggtgatagaatgagactgtatctcaaacaaacaaacaaacaaacaaaactctagagaaacaggacactgttataacaggagagcctcctgggctctctagccaataggaaaatgaccatattgtatagacgaatgactattaaaaacccaataagttgggggtttaaaacccactaattttagttcagagttactggaaagttcctttgccccacaaatcatctgctcttgatgcctagaactctgccctaaaaacacaatttgcccaacttaagactctgtctcttattaaaatatgtattcctctgggagggataatactatgagttatcagtcatttaatgcttatacagatgagttgacaactgtccttgaaaagatattttaaaagaggaaagcataaagttagtgggtgcttggatagcaggaaggaatctgtagggcagaatcaaattagaaagggaaagctgaggatacatcagaaaaaaaaaactgcctattttacaacttcaagtagggctttgcttcctggataatgtcctctggtcagggcatatcacagcaatgtttatcttttatagctctttcctaaacataaagtgtgaaataattcatacagccccttatgtaaacagagcaatgattagaatgtgttgcttctactttgctgttgtttcttgatgggctctgggcacacgtggactttgcctctatggatgaactgtcactgatatggcataacgttttcatgagtatgaaacagtgatgtgctggaacagcccgtgtgagcagattacatgcatgtcttcccaactttgtattcagtttgacttcacactgactgctggaaatcagccatgatgagcatatttacaccatagaaattgacgaatgctaaaaattgaaatgtttcttttcagagagctgattgttaaacatttaccagtatgctgtgaaatgtaaaaaataaattttaggatatgccatggcatatgaaaaaatattcatttctttgttttgcctcttgaacagatgccagtgatattcaaaatcacattcatctttgtattactttacattttagctacacttgtacaggtagatcccccatttaccttttcaaaagctgcctggtacttcatgttggccaggttttgcatcatctggctccggctgccttgtatacttcaggctccagccagatttaaccctgagtgagttttgcatccaaatgccttattctttcctttggacatttctagtctgtttttacctagctgaagggcacccctcacttctctgtctgccagtatctttcccgtatttcaaggtcagagcagaaatttcctccccttctttgatgctcacctgccatcctaacatgggatccagcattcagcattcattgctctttctccagtgctcccactgaacacttcctatacctattcagccatcaccatccctgccttgtgaaatgttggtctccatgtcttatctcctcccctggattttaagcccattgatgatagtgacatttgctttttcatcattttatccttgagagtatcagatgcagagctttgcatagtcattacttgatattagttggattatatgcatatatgacttaatatttcccacagtgtcctggacagcgaaataaatgccacttgaacaaatgcacaaagacacacacacacagtttcatcagtctaaatatccatatttgtggcctgattacctttagcatagaaaatgccttgttgaaggggaacattggactcaagtgtacaccaatgaggacaaatgagaaagcttctactctcagtctgaaatgtcacctttctcatctgcatgtaaaattgggaggcttttgtccagtcatatgttagaaaagtaccaatctgttataaatcaggatgttccagtggccactgaagatacaactgaactcttaaggatagatactgctacaatgttagtgagttctactgggacttgtataactaatgataaaataaaaaacaattggaaatttttcctttggtcactcctgtgaaaggaggctattcctgtttgattgatttatttattaaacaagtatcatcttcttgtgccaggcaatctgtgaaagactgaagatataaaggtaaatcatctgtggccttgcccctcagggatttataatcaggaaaaaagcctgagaaagcaaaaggatgtgttcaaagtctcaggtgaagtcaagccccgaggatctgacaagctctgagacacatcagtgagtttgcccgttagaccctgccatctgtccccgtgtgaaatatttgctgtaactcctttccatgaactgcttttggtttgaatgaccttggagacagcctgaaatcctgagcttggaagggtgctcttagcgttactggtctgcacttatagccttcaaatagaatttccacaaacctctaattatctcctcttaccatgctccctaaatgacagacgaccagctctttagtcactccaagaacggatttctattcagcccatgcccgggatgcattaggatgcccagaacatgtgtggctgctctgagtggcacagagcaattaacagaagccaagcaatttgcaaaatgcctcaacttcctgctcatctcgaaggcagaaaattgtcaaaccttaacctcaggaggctcatctgcagaattacacctcccccacctcaaagaagaaactctggtgtcagattcaccccctcctgctttttgcaaacataagcactcggctgcaacaacagctatgactcagttcctagctaacgctgcttgaattgatttagtctgagttcagatttagcacataatcatgttcaatttgctccactgcactgcctagagataaaaggcttggagaaaaaaaaatagcttcagcttgtgtcagtctttgtggtgatgtcattgccatgagcgagccgggccgttcgttactctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggtatgcacctgcaatcttatttttcattgttgctgttactgacgctgcttggcagagcctttttagcatgaagaaataagactttggttaatagttttcagctcatagtctgcgctagaaatgcatgtagtgagtgcatggctgcattaagtagaataagttggaagagggaccagcatattatttttaaatatgacaaggtctgccattgtttcttcttgtcttttttattaggtaatccctggtcagtcctttctgagtagacacattttcatattctcatattgtatctttgtcaataaggagaattttccagccctcaatgtcaagagggattttgaatcaatgattacatgaagaaagcacacataataaacccagcatccaggccagcctgacagtggggcaataaccctttctggcatgtcacttaaatatcctgtgatgtggtcttcaaattaaacaatagctgttctacagatggcagtttcagtccccagctttctggaaatcaaagttggagaacagctgcctaaattttctttgtcaggcaaagaaagcaagtcattttccttgagcagttgttcataaagtttaggcataaatatttcgcatcttaaggcttagtattatacatgctggtcctcactgattgccggcagcagttgttgacttgtcataggtaatcgtcctctgatgatattcattcccttttattttccatttggctttatattatggagaagatgccaggcttgcaaaatggaaatgtttattttttctctcatatttaatagaagaactagctgaagcttcttatttaaacagttcactcacacatatacacgcacagaaggtcagttgttcattgtgtggtgggaggaataaaaggtgaattacattgcataatcatttaccatccttgctttagtcttaacttaaggaaaaaccctgaattctttattgttgggtgtgcaggtgacaccctggtgctttacaggtggggatttatgtgttcttggcatagcacatggctatgtcattcaagattgcagctttaacaatcttttgaaatagatttgataatctggcattttgttcctgaatattttaaacatgtagccctgtatttactaatttttgtgtcagtgccatggaaatgtctaccacctgtcatatgaaggttcagaaaataaggacataaaggtttggcactgtctgtgattgcattgagaatggaaacatgcatgcagagacccacagtcctgccagtcgtacttccatagcacttgagaagggagagcagtcatttaaagccagcgtcaagtccagtgtgggtaaccaggtagagagacatcttccagtaaccactggaacataattccatctatggagaataaaacttcacagctcccttctgtcctcaacagttatctgttgtttacacacttgccctgagaatgtcataaaatattctaaactttattcgtttcagaaaagataatgagaaaatatttattggagatctgcaacatgccaggcattgtgcttatataggaaaaagtttaaaatatgcttatatggcatatgtatctatgatatagctataaaaataaccaactgccgaaggtttctttaaagacaaagaatattttgtggaattaagaggatacaaagttgttacagctggttgtatgtgagtggttggggtggttttatggaaaaatgatacttaaagatgggtagattttatacagaaagagagaaggcacagcattttgcagtctagtgagtcaattcttttgactgcagtaggttctctatgagagattagaggcaaacgggaaaggaggtgagtcagggctagatggtgaacagctgatgctgttcttcataaatttatgaggtttttcgaggaagactgttaccagaaatatgtgctacatgtatttactgccaatagctctgaatcatcatgggcttttttcttttcttttttttttttttagaaaggttacctaatctttctgggccttagtcttctcatataatgtgagaatagtagtaatttctaccttattagcttagagacaagagaattttacatgtagaataattaacacagtgcctgactcctatttaatgctcaataaatgttagctatcaccatcgtcatcattgtcatctttgtaggcactctctgaaagtgataggtaacttttaccagtttatcagaatgtcctaaatccagctgagtttacaatgacagtctagcacacagaaaatgttttccctcccaccccactcccaatacacacaaacactctagccacttagaaaacatggctttccatttttgatatttaatcatctaatgtaaagcagtaacattattaaaaagcaaagatctacgttgtgcttattaaaaagggggaaaatgaacaaattaaggtgggccaaatgttatgtgttaagaaaacctgcgctccttgttcaaaactgaccattactcttatcacgaagaaaggttcaaacgtaaaattctaggcaccaaacaaagcttccccaaaggtatctgtcttcttcattcattactaataactggtggagccaagagttccttcttcaaaatctttaaggtttattgtcagagaaaagggaggcacatggaaagggtctgtctcacctgcttacatccatcttgcttaatctcagtcttgtttgtttaataggcatccccactttctacatgtagcccccatgggcaagcagccatactagggggatgcaaccagcaggcctccttcataagtatgggagtttatttgaaatgggtagaagcatccacaaatctagtttcccatagtgacacagaaagcctcatcctccagtgtggctctcagctgattgtattaggggcccttctgactccagtttcctaaatttcatcaaagctgctcaagcaataatactaaaaagaggaggaaatcagacaaatggaattctgccatatttggctttctctggaaattccattggtggtgttgtgaacttagccgtctgttctgcaatgtgagagttctcagaaagatctagaagttgagagccctcaatagaaaatgctataggggaactgcagaatttctgtgtgtgtgaatgtgcagggttgatgttctccagtattctcatatttctgaaaatagtctacccactccacaaagagccaaacccttgggaaaatgaaagagatccaagagattggtaacgaaatttacatttcactttagtccagtggttcttaaacctgattgcacatcggtgtcccctggagatcttttaaaaatattaatgtgcccaggccccacccccagaacttttacctggctggtctgaatggagcccaggcataggtaatcatataaagccagtgtcttgtctctttcaggcacaagtaggtacaggtgaggtcagccaagaattgtctagagtaagctctgcttaagcacttggatccttatctccccagctaagacttgatgtatgcagttttaaaaacggtatctctgagctgtcagaaatgttgacgctcacccaacacttcagttctccacacctgcagttccttcacctgattctgagccaacagcaaatgctcttctttactgctggccactgtggggggccttctcagagctgcagagtgccaccactctgccagggggcatccaaacctggggctgccccttctctgcaatggtggcttcctgcacagaagaaagggtgggttccttctctctagattggagggcttctgattcatgtaccaggtttccagccttgtctccatgggcatccatgtaggacacaaggaattcacaaagctcccttccgctcattagagcaggcaggaaacatgacaaatcttataagaaatacagaagcttcaaagacccttggcacttgagagatttgttcattcattcaaaaacatgtgtggagcatttattacctaccaggcaatgctctaggcctaggagttcgataaacgtccctgccctcacggagcatatattctaacatgagatgcagacaatgaaatagtaaacaagtaaatatacatggtaatttcagctagtgatgagggctatgaacaaaaatgaagcagagtgagagatagagcattgatgggggaggaatggccacttttgaaaagattgccattggaaacatctctggggaagtgacagtttattaaatgtcattgtttcaatgtcattcagagatctaaagaaatttagagagccatgtacagagctgagagaaaatcattccacatagagtgaatagtaggtagaaagagaggccatcttagccatcttatctgatgtgctcctacctagtccccccaccagcactatttaacctgtttcaatcattcattcatttaggtacccattgagacggtcactgtctcaagctataatttatttttttaaggagactctttttcagaaaactgtacttaacctaattccctcatgctacgttttaagcccaatagctctcttagggtaagggtaaatacaagtagaagtgtgttttcagcacagtaattcttcatatgcttggaatcttaggattgctacaggacagctcttttctcttctgaaaggccaaggcctttttaaggtcactcataaatcctactttctctcctctgcttttgagaatttctcaacatcctcccaatccatgtgacctgggacaatctcttagcctttctggatgcaaaataatcatgctgagaaaaatcccctactgctctgtgcattttatttttctttttacacgatagtatacctgactgagtcagagtctatttgttttatgctgttgtgtgagttatgaaaaagaccagcacatcatggccactgagtacaatgaaatctctctgtcatacaaaccactggacatttcaaatcacttgttttgtatggtgagagtgataggaggagaaggatgaggctgagttggtatgatgcactttgtactctgctttgaggagaaacaagtgacacaatttagtatgtgtcacttgttcaggaattgttttggaagagaaacttaggtgggtgttggtcaagaaagctggttgaacttcatgcccatttcttaagttttttgcgagcactagggtaaggatctgggcacaaccaatcatgacctatggctctgcagagctctaaagctctttaagaattttcaaaaaccattgtgttcactcagtaacttagaagtgtttgagttgtatatgatttaatcctcagaaatggtaaaccctctagaggtattcatggtaattaacgttcagtaaccaaaacgtgaagtcaactgaaatgctcattccctattcaatgaccataatagtaatattaaaaataatattttgtcatacatctctagaccatctttggtttatgaagaacaaaaggcagtgtgtgtgtgaggtggcaagagagatggcatgtgtataacagattctaaccctccagcaaaacaaatgttgctatttctccggtaataacatggactagaattgaggccattttggaaataaatgaattaatgcaaaactgaaagttaaaattaatgatctctaaaacaattctttaagaacttaacattcttaaatgtacaatactaaacattttcttgcctctgaagaaagtagcaaacatctttcagagagagggaagaaatgattttatgaaagtgatactccctgagaaggttcagaggcagatttctcagccacctatcacatttggtaaagacaaggtagaccgttcaactaataacattgttaagtggggaaatcaactaaaaacttgtttatctgtttaaagaatcttttaactgttgagaagtaacagacattggcagttgctacctctaacctaaatgtcagatatattaaaacaaaacagcaattttaatgaaaaattgttttcctaaagaaacagattttaatgtaaaattcagagagtgccatttgcagtcttagtgattctgtttgagtccaactatcagtaatttatatgggtttgttttagtactttctgataaagcttagaattgacacataagaaagaaaatgatacctgaaacacttattatcactttatgtgtttaggtggtaagcttaatgggcttaataggcattgcaactttgcagtgactagcccagctttgcaaggagatcataaactatccaactcatacctggcctagaatttctttatgtaaagggacaaatgtatttatgtaaaggttctgtatcctttcccaatgctaaagctaaactatttcaaaaatagaattttaaaaacacatggagaggtaatttcaactggaaattttgagcaggtacaaagttatatatacccattccactctagctagaatggagagttaattgtcaaagtttttgagaataaaatgtctaccaagttagaccttccctagaaaaggttcgatatatgtaatttcatgttcaccttttgggtaagtatacctgggtaaaacatatgtgtgtacatatatgtatatacggatattatacacatgtgcaaatgtatgtataacatgcatatttactatatatttctctttttttttaaccttctgttaccatagaaggttttttctggatcctctacctattctacaatggcacatctaactagttaatggtaattgcgtgcttttaactacatcaagggattaagggcccaaagaagattcttggcaagtgagttgaatagaaacttgaacaattgctaaaggaaactcccctgggagtgaaggggactaagaaattcattatcttctctttttattgttatataccatagcagtgtccacatccttacagtctagtactacaacagttattctttccagaatctaatatatcagctctgaactatacttttttttaatgtttcaaaaaggtcttgatcctttagcttccagaaagatgactttaacctatctatgcttctgttagattggactatgtactaactttcatttcctaaaacaacatcttcaataatgttttatttgctccaacaataggatactttgctatttaattgtaagattttcttcccctacctctggtagttctatagaaatatgtgagcagtgttcatgctgtaccccaaacatttaacctcaggggactgtttactaagttgagcattaaaccatcccacatgtcaccacatggtgacaaatgtaagctccagagatattcatctccatggatcaatattatatgttatcaaggtgggcaattttaaaacttccaactactgtttccaatcacaaaattcttctaactacaaggcatataacaggtacttcatataatccccattatagcccaaggcatctatgtagttgccccattataaacagattcctgatattcagagaagttacctttttacacaagattacacagctattaattggcagaagtgggacttgaactgttctttccactatcgaaatctctctaaggattaattaataaagcattaatcaattattggggtataggccgggcgcggtgccttacgcctgtaatcccaacactttgggaggccgaggcgggcagatcagaaggtcaggagatcgagaccatcctggctaacacggtgaaaccccgtctctactaaaaaatacaaaaaaaaattagccgggcatggtgacaggcgcctgtactcccacctacttgggaggatgaggcaggagaatggccttaaccggggaggtggagcttgcagtgagccgagatcatgccactgcactccagcctgggcgacagagagagactccatctcaaaaaataaaaataaataaatgaataaataaaagaaaagttattggggtataaagctgggaagataagacattgaactcatatgtaatatttcatctgatgcttaaaacactgtttttgtctatttcttatcagaagtggtgttatactacttgtacataaatcagtagttgagatcatgttagcttttcttaataaatctaatgtggcaattgaaggcatagcatctattttggattttgttttagaatctgtttcaaaatctaattatgccatctagtttgggaaaaagaaaagttttctggaaaatgcaagggtttccctggtttgacatgcgcctggtttgacagctcctccacctccttgcttatgtcaccaagcattttccattgactcagtgagggataatctgtgaagaattgtagggcagaggcagtgaaagcaatattaataatattttacatctgaacagtgctttccaaattatacaaaactcagctttttcacaggaaacctccaaggtaaacaaagccacacaactcataatgggaaaacttggactgggattctttcacaacacaacacaagatctcttggtgtattattatagcctgcattatcagtgcatctaatagaattgatttcatcttctatgactttactgtgcctttgggtattgactaagaaaatctcagcctacctttcctagaacaggacacataacccatgagcaaacttaataatagcaacaatgtattgagcactgactatttgtcaggcactatagaaagcacttttattcattcattcagcaaatatacattgaatgccttctatggtcacggcctcagattaggctctgcagatatagggatgtataatcccattggatacaaaagcctatgtagtgctggcctttattctcctcagttcctttttccccaaaaaggatgatgctgttatgacctctaaagaggcttcctttgctgacgtagggcatgtgagaaggaagtctagtctccagagtgagacatcctggagagaactctctacttgacctctaggccacttgatagtgtgaccttgagcaaggatccttactgctctgtgcctcggtttcctcaactacaaactgatgaaaataatactgcttacctcataggttggtggtgatggctaaatgcattagagtatgtaaaacacttaacataatgactggcagacagaacacatgcaagtaatgtcattcattaccatcatcatcatcctcagtagtagtggactttgtacatggaattctaagttttcttgccagggaagtctaccttacttgcctctcattatatcaaactcttcccctgcagttttcaactcatctttgcacaggggcagcagtgccctcacctcagggacactcagaggtgacagaaccctacatcagaagggactggctcagtttgggagtgaggaattacaggccctcccagggagcagagatgctgcagttcttctcaggctgtgtctcttccaaacctcttttcttgtctcttccaaacctcttttcttgtctcttccaaactcttccaaacctctctagataagtgttccctgtagaacaggagacagcaggaaatgaggggcctggataaacaggaagtatcttcactgtagccacaaggggatgttgtggaatgaagcctccaggaagttgctgttgttgactcagttaatggaaagggaagcagcctgaatgaaaaagcaagtgtagaaccccctccctgaccccaccagaatttagagactccgtggctcctatcacactcagaagaaagcccaatccttgctgtggccctcaaggcccatcagaccttgccccaacagccctgctgacctcatctcctctgcacctctccccctttcactctgctctaacccccacttcctgcctgtaccaagcatcccttggaacttgcctttgctgtgccctctacctggaatcttcttccttctggagcctacatggcttgctcctcactcatcatagagctgttcctgactaccacacctacacagaccacaggccccgctccacccctcatcctgccttgtctttcaacacaatcacaagatgttgtattgtgtgttcatgtattggctcattgtctatctccactcaccagaatgcaagcttcatgagggcaggggcttttctgtgtgtctactgctgcatccctagagatgcatatggtaacatggagaaaatgtgtgtttacaaatgaatgatagactcccatttgcaaaccctaaaacatgctgctagaccaccttctttgaaaaagatggcctagatttctagattcaaggccagttttaataagcattcagacagagtaatgtgcatagcagaatacagatgttttgagacaagatctggctctatcgcccaggctggaatgcagtggtgtgatcttggctcactgcagcctccacttcctgggctcaagtgatgcttccatctcagcctcccgggtagctgagactagaagtacacaccaccatgcccagctaacttttgtattttttgtagcgacagggtttttccatgttgcccaggctggtcttgaactcctgagctcaagcgatctgcctgcctaggcctcccaaagtgctaggattacagacagcgaccacacccacacagaatacagaagttttaaggcaagatgcccatgaaggaaaagagaggttgaactcagaacccatttctttaaaatatatctaaacacctttctttgggcaggaattttacatggagttatggacttgtttcaccgcagtaatgcttaactataattgtaatatttacaacattgaccttcaatttccatttctagtttaaaacagtggagataggtagaaattagattaattgcccaactgagttcagtttttttttttgttttttgtttttttgcttaggaggcatcttatcctaaaaaatctctgtattcggccatatacacctacacacctactctggctgcttataaacttatatcataaaactagtaaacatcttttttgtggttttttttcttttcttttttttttttttttttttgacagagtctcactctgttgcccaggctttagtgcagtgttgcaatctcggctcactgcaacctctgcctcctgggttcaagcaattctcatgcctcagcctcccaaatagctgggattacaggcatgtgccaccaggcctggctaatttttgtgtttttagtagagatgggactttgccatgttggccaagctggcctcgaacccctggcctcaagtgatctgcctacctcagcctcccaaactgttgggattacaggcatcagtcaccacacccagccactgggtatggtgtacccataatagtaaacaattccgatactaaaaaacaaaaagaaaaactaagctaaaagccccccactatttgttgcttgaataaataagagtagatttgaattattaatgagcaagatagtgcatggtgtattttatattctcactgtataatgaagtactccatttgtagtgcttagcaaaatagtattctatatttaaataattcttacatattactaacaacagttagcatttatgtagcctcagaagactggaactcactttgaatgaatgttgcctcataacacctctttgatgtagtcaggaagtatatgattctctcaatgagaaattctggttagaagagttccccaaattatataacaaatcaatagaggagagatacaagtttgcacatttttacttcacgttatgattgtatagttcttgaagttggaaccaagaagccatttgttataaaggtataatggaaagcaacttgttctttggaggcagaaagacctgagttcaggatatttcttatttaagattttccttatatgtaaaaagaagatacaaatttaggttgaaggctatgggatataggtgatcaataaataggagccattattcctgatgccctggtatagcattagtgagacagtcccacttgagaaatgtgatggagcactcagtgtgtagtaggtactgcctccagacatgggaattcaggaatgtgaggcatgcctcctgccctcagtgagtctctaggctggtgaaggagtacaggtagtaaataagtacatagagagtagaacatagagcgtgccatggtttgagtaagcccagtacactatggaagcctgtaagagagtagtctgggatgaggagggaaggctaccccaaggaggtaacccatgagttacagctttataggttaagtaggaatttgccaggtgaaggaaagatgggaaaggaagaggcctacactaaagcagaaatgccagagagaatggtgaactctaagaattagagtcctggatgaacgtagtattacacagaaactggggtcacattatgaaggagtttgggtcttatgtgcaagtctaacaggattgggtcatgggaagcatgttcagcagaggagtggctcattgcctagtctgactggaagtccactctggctggagtgtgaactgtgactgcactaaggccaacatgccaagtagggagcagagccacttgcaaatacctctctattaacagatgaggaggcggctgcagtattgcagccagacccgatgagggcttgtgaaactgcagagtcccagtatccttgaattatgttgattgccttctagttagtcttctgtctttcctttttaaagaagaaagaagtcaaactagaaaagcagccatcttgaggatatgattaagttgccattcaacaagggtaaggtttctggggagacaggcatatttgttggcactacacctaaaatattcatgaggcacatttagttcagcaggaatattgtgattgtcttccagagaagaaggtctaaaatcagaaatccaaaccctggttcctgccctggggaatcacttactctgggcaagggagacagacttacaagcccagacagatatcccttatctaactgttctgccctgattcctcctcaaattcctaaaaactcgtaagtggaaattcagtgatgttaaatgctggacttagaatattctaggcacctcctgagagcaaatacacatgcacatacataataacatctcaatgttattgctaaaatattttcataggggctaaaactcccgaagttgaccatataccacgctaggagaaagaaaagtctgataccatgtccttgtacttaactgttgccatcatagcaccagccttgccttagcatggcatgtaacccatgagttacagcttcataggttaagtatctacatttagtaggtgctgaataaaggttggatgagggcagcaggatggaagaagaggcggaaggagataagcccctctgcctataggggcagactccagaagttacacatatcacttcctctcagattcaactggacagaaaatgagaatatggactcatctggacacaagaggggctgagaatatcacctttttcctgtgtggtcctatgcccagctaaaagtcaggattctattataaacagaagaggaaggtggatattgggagacacataacaatctctagtgcaggtgacaaatgaatcctttaaataaatgaccagaactcaagttctaggattcacatatgctaaacagcaatccagagggagttaataagtcctgaaaacacagtcttaggagaagtttgtcaagatttcatgaaacaaggaagctttgatctggggtttcaaaggcatggcaggtacaaggcactcttcaatcggattacttctttctaggtcagttggagagattacggcccggtaggctgcttctccagtcccacttccatgccttggcacttgcagttcttccatgctgactgggcatcccatgcacttaccctgttgtatgtgttgctgccattcacttaggtaattctgttcatttgcaggtagatctctattaacagatgacaggaccatttctgatcaaacccagagtatcattcacatcttttacagccattggttggggcgtgagttgcatagaataaaccagtaagtttctgcttatgtagatgtgtccatcctcagcctttcccaacccttttagatgcaacagaacccatgatacagccatgggctgtagagagacagaaggagggctgaaccaggaggcagagcactgggtgtagtcttcagaccactcactttgggcatcatggagagggaatgggatttagagccagaccagcgtgggctggaaccctggccctaatagttactaattttgcagtcttgggaagttttcccctctgtaaagtatgtataataatgctactcttcagggtgttgtaactgaaataagaatgtacctaaagcatgtaggtactcaatagatggttgttattgttattattgcctcttctctaaattttgatattgaaaataccttaagttctactgagtctattaatgatatttagctctcttaaagacacagcagttctgctatattgagaatcatctccatccaaaaaatatatggcatttttctgaaattcacttaatttctaagtaaacttcctacatagagcatcatccatttttgtgaaggaataaaagaaaaatccatcaggtctttctaagcttcaaataaaaataactcttagacaaattctctataaggtcactaattttgatgatatcagttgcttcatttggtacaacactgtgccaaaaataaaaaattgtttaaaacagctatttatttgccagtactatggagaaataagccagcaacaatcagtattaattccactaagagatttctttggaagaagtatgaatcaatcttcattcttttttttaaacaaatattagaaaacaaagtttcttcacaagagtgttaagccgggacactgcatgcttctcattcattccaccttctaatttgtgttgtagaatagaaggtctgagcacaaaaattttataattacttcctgatggtattccagcttcagattctttcttgtgcatggaagtaaaataaactcaagagtaccttgaactctttaattctgaatgagcacaacataataccatctgaatgcttcaacttcccttgaaccttctgcttttctgcttgatcctcctacacaattattccaggcaattattgtcattactcaggcatggaatctgaacccatctttactaacttcatatttaagcaaaaccaaatctcttcaggtcttttctacttagtgaaaattcagaaacagtgtttaagaaccgggtatgaattggagcactttgtaacacccaaaggatgggaaacaccttacctcaaaatcttagtctaccagggatgggtagtatataagcaccatgacaaaggtgcaaatttagtaacttgggcttcctcattttcttttaagttgggcaaatgaggaggaccagttctatctaaaaattagcttttttaggctggaagttgcaaaattggccacctgcaagccaaatccataggtgcattttatttggcctgtacagtgttgtttaaaattgaattccttactagtctttaaacataagtaagatttgacattaaaaactatcttccaaattctcttaaaaaattggtagagctggtatcactgggtgtcccttcccacagaccaccattggctcaacatgagctaggtctgtccttttcatagagcaagcactctccaattgagccactccaggtatacacagggagtagtgagaaataatgctgtggaatgaggataggtcattgataggtcattctatggatgaccttgagcaccaacctaagcattgtcaattaattgtatgaaccacaggagaatcatcagagtttcaagagccatgatttaggaagatcatggtgcctctggagtccagcctagctagaagaaaggagaaaatgggggtaagggaaatcagtaaggaggctattacaacttattaaacaaccatgtctcctttttttaacccctctctcttaatactatgtgaaaattccttagagtgaactggaaataattctggactaaaaattagacaactaggctcaaattacaggatggcccttattagcaaaatgcatgggcaagacttaagcattccaggcctctctttgcttatctatgaaatggcaatgagggtattactgacctctcaggattatggtgatgataaagtgagaaaacattttagataatctttgtggactatatcatcattacctcctggcttcatttctgcaaacttctcctgaacagcaggcttaccccatctcttttctattgattagttttgactttactcaagttatttccaagcctggagctctccaggtcttcctgttatattgacctccttaattaaggctttaagtcaagattgaaaggttgaaaaggactgtagagacaagtaagtgtcccctattttatgtaaccatctcctctccagtatttaagcctctccttgaactcccccagtgatggagccctcaatccttattgaaaccattttcatgattaatcaattttttttttctgaaacctcgtaacttcaaactactttcctattactactgtgctccataagccaacagagcaagtctgctctttgccagaaaagtacttttgttctttgaagaaagctgtttggcctgaccacatttccaggtcttcttctcctgactaaatatgggtcttctccagataattctttatatgacatagttgcaagtgccctcctcacatcccagaggtctccccaacgtacactatattttgtatgatcatccaactgttcttcccctttctcatctcattcattagtcttgtgcttagacattttggtctcattccaccctagactgtgctcaaaagcacctctggccctgcccaaccacatttgcctctcctctcccttaatccaaatgtttcctcacatgttgtgttgcaaaaccaatttgtctaagagaagagttcatgctccttagggtcattggtgaaagatctcaataattaaatgtcaaaagttcatatttgactataataataatgtctaacatacattgagtgtttactacttgccagcctctgcacttaagtgactttctatatcatcccttggaatcttcacattcccatatataataagaactgttaggatcatccttgtttcacagttgggaaaagtgaggctttgtgacatgaaggagctcccaagtcacagagccaagaagtggcagagctgagatccaaactgggttgtcaggctgggagcctgcactcctcatcacagcacaaggccttctcacagcatctttgccctgatgcctgttgctgagggtcttttcatttgtttatttgctggataattactttaggtctttcacaggatttaatagaaagtataattactgttataattactgtaacacataaaggcttctttccttcttccaacttgcttgaacaaagcctctgaaaccacaggcgggccaccaccatcttcaggaagattttcaatagaggattttaggagatgacctaaaaagaggtggtaattcaaacccaaggtgttgcagttcattcattccttcagtgttcttcattctccttccttactctattttcatcaatagcgcttgttttctaatatataattcatgtatcaattttgtttattatgtctcctctcactagaatgcaagctccatgaagccagaagtaaatgttgtctgttttgtttattgctgaatccccagattagcatggaacaggagcacaacatatatttgctgaataaataaatgaataaatgacaacaataaagcaatttcatcaccttttggatgtaggcatttaaactttgaggttcatttttttcagccaccaccatgaccccctgcctctcttaacttcccctcacatacactcttcagctacatacactcactcagccttgaagcctgaactcaccagggctttgatttctgccagaggcttagctgatctttgaggcacatacacccctcatctgtgtttccttaatgacgtgtttgtcttgaacattgcgcttactgtgttgtattatagtagtttgcgtttgcaaacatctccctgactaacctaaagctctttgcaggcagagaccctgtcttcttcatgtttgtttccccagcacccagcacagtgcctggcatagtgctcaatatttaattgatgaatttaaaattctgtttccatagatagggatttggaaccacaggggtagacacaagctagttctgcatgggttttagaaacagaaattgccatttgaggatggaagtgctttattcaataagcgtttactgaatgcccatcatttgccaggctctgttctagatataggctgaaattagcaaacaaagtagtcaaaaatgcttttcttggaatattacagtgggaagagagacatgataaaatgataagttatatagtatgctaggagtaatatatactaaagagaaaaaaagtagggcaggtcaaggggacttatgattagggacaggagttagaattttcagtagggtgccaggataggctcatcaaggaggtggcatttgagcaaagacttaagaaggcttccagaaacgtttagtgagctcctatagtgaatgaagcagtgtgctgatgctgcaattccaaaatagagctcatacatactctagtgagaagactgccatgtcaaccagagtgtgatacatgtgagagcagccaaaatgttaatataacagtttaccagtaggctgtcctagagagagctgactttcaatatgtgatgtaaatgtcaccatcactgccctcctcatctctccttaccattctaagttgccttatatcctttgaaactgtgtagaatgctaggagggtggtaactttggaaagcgtgcatttatgcaaaggagttagatggtatcaccctctgggatcggaggaactttgaggtgttacaggacagccattggtctagaagtgctggtgggtcatctttcttcatcataacacagttatggttgggctggaattcttggaggagaaatgtactgaacaggccaaggaataggggatttcagtggagccgtctgttgacaactctcatcgtttggctctttggacatggagacaagccagtcttggagccatacagcccccttagatgccacactgccattggcaccctgcctactcctcaccatatcccctgtaatcagaggcattttgtaaaaaaccaccctgctgtgtagcacactgggtgtggccacagcatactttcattactgcctcaggcagtgcctataaaggttctctcttgaccacctcagcaacatgtactgagcaccttggctcaccaggactgacgccaggcatacaaagtggtaatcatgaaaaaaaaaaaaaaaggtcttcagcagagaacaggactaggcagtgattgttcgggccaatgacttgttcacatttccaggacagtcaactgtttagtatatttctcgtatgttaaattggtttaactaagttcagtgctttgactagctcatgaaccaacatgatggtcttggtccccctccagcagctgtctatggagaaatattttcagctccatggctaacagagaatctcaggtcgattgttgaataaatttcccatgtagctgattggttggacttaattcatataattatgccttttctagtaaaggtgtgagtctttctttgaagttataaaagtgtaaaattggctcacacttgaatctgatgagacaaaaatcaatcaagcagaagtcttatttagtggcatcttagcctactgtctagcagagtctgagatgaaatcttgagcacaagtgctttaatggtgactgggagccaagaagcatgaatgggggccaagtgaagggaagcaaagaaggaagtggagccaacgtgatgacagggaatggagcaggcccctgttatgatgactatctgctggattctgtggaaagcctgagaagctacgtgaagtgtagtatagaacctcctgtccagggtaagaaaatgggaagcatttatccattagctcccagccaccatgcatcaaagtttctctccacagattgttaactccatgcattgactaccaagtggtttcttggggtgcctgcctttgtgtccgcggagaagtctagcatggaaggagccaggcactgatgtgaagtgaggtcctcaggttgcaaactgcatgaagataatcagaattgcatgaagtaacagaattggctatggcagcaggggctagactgagttaggtgggactaggagactatgaagtgatgcactagaagcatctaatacaagcactggataattctatttatttgagtctaccttgttccaatacaggcataagatcgttcacacacctgtcatttgcacagtgttctactgggcaccccccgttctagtaaattgtgcaattgcttagtgaggtgttaaatactgtctttaacgaaagagcatgggcttgatatatatcagacttgtttgatggttgttaactgttattttgtctcaagaaaaaattcccctgcctaccccaattgtaagtccttgattactgcctcccttcccctcctctccacctcctaaaaaccaccagggcattctgtaagtttctccctgcctcagtaccactgtgcttcttttattccgacccctccacatctttcctctcttatatctgaagaaagcttaattgtcagcattttacacactgtcaaataaacagacaacttctaaatggcttctgagcttcctgagtttaaagatacaagatttggagtaagcaaagatttcttaaataagacacaaaaattactaaccagaatagaaagatggataaattagactttattaaaaattaagaactcctaatcattaaatggcagcactcagagaataaaaaggaaagctacagtctggaagaagatatttgtaatacatgtatctgacaaaggacctatttccagaatatataaagaaatcatgaaaatcagtaagagaaaaacaaacaacccaattaaaaatgagcaaaatacttgaacagacatttcaaaaagagaagatatccaaatggcaagaactattagtcatcagggaaatgcaaattaaagccataattaaacaccattacacacccaacagggtggctagaagcaaaaagacagtcaatgccaagggttagtaaaaatgtggaacagctagaactctcctgtgttgccagtgggagggcaaattattacaaccactttgggaaattgtttgcaatatcttccaggcctaaatctatatctactgtatgatctggtatttctaattctcaagataaatgagtacatatttccaccagaagacatggacaaggatgtttacagcaggcttgttcataatagccccaaagtggaaaagatccaaatgtccataccaaaaaatagatgaataaatttagtcaccagtcatcaatgggatggatgactctcacaatttcactctcaaaatgtagagtaaaagaaaacagattttaaaagtacatgcttatcattccatttacacaaaatttaggaacaggcaaaactaatctatagtgacagaagtcagaataatggtcaacctgaggattggaggaggtggttattgactggaagagggcagaaacgagccttctaaggtactggaaccgttttaaatccggagctgggcaggggttacaatgatagtggttatactatttaagaagggacaagattgagaacataaaattggtgacccatcccactagcaaagtctccaaggcctcatggtcaagtaggagaagaagtagcaccataatgagattggaaattattacattaggcatagatttaaaagatacctggccttcaaattttaactgttaactaattagccacgtaatcctgggaagtaacagttttggacttggttttccaatctgtaaaatggctgactgctgaggatatctcatgcccctccaaatcataagatcccagtaagtacacaaggctaatatgaagatatacatctcgtgttggttctgcttggctgaataacactaaggaacgcaggacccagagctaaagagggaatagagtgaaaactctcacattctatttagggctctgtgatggcaaatcttgcaatggccagaactacagtgaacccagaaagtgagttactgcagttcctgtaccaccaccaccatatgggtcatgaatttctttctgcccctcactgaatcatttcctgccatgtcagagaaaacctgcctccaacagtatatgcagtggttgactgaggctcttgggagtcagccccacttgggtttgaaaccctgctctaatacttactgtctatgtgaccttagatgggtcacataagcccctgagcctcaattttatcatccataaaataaggaggtcaccaactcctcagaatttttgttgtaagcactaaatgagataaaatctataaaagcccagagcacagtgcctctctcctagccaatattcaatgaagtatactggttattattagtgtagccagtgtctgctgtggccaccatcaatgccccaagtttcagttgataccatgtttggagataaaaattacttcttaatttcataaggtagcaaagcaggaaataaccttagaaatgatctggttaaacaccaagcatttgtttaggtcctaatgagtggcaaacaatagaaactgaaaagctagcttgcaaaaagcgtaatttattgaaagaaagcaggagtatctcatgcaatcacagcaaatctaaacaacaaaattgcagaatggcagaaatcagggtcactctggtgatctgggcagcagagtctgcagatcctctcttggacatcactataaatatgactcaactctaatgtctcctgttactgagatccaacacatcgcttgatgtctaatatagcattcatacttaacatggccaaaacagaactctgaggttccctcctgcccccaaagtcagctcaccctgccattttctccatttcaggaaactgtacaatcacccgcccagttgctcaggccacagatggagcattcttccttgactgttttctttcccatactctccacatcagcaagtcctattgatttcaccttcacactccacttctctccactcagctctgaccttgatcccatcaccttccttcttgacactgcagtcacttcctaacagtccccttgtttctacacttgctgtactataatccagtctccacttagcagccaaagtggtcattggaaagcacaaattgggttatgttactttatgcacaaaaccttccagtggctccctgttgcgcttagaatgaattccaaacacattaccattgccaacaaagtactacaggattccatctatttgtccaaactcccctctatgtgctcactcccttattcgttattcttcgggacacactggtcttctttccctcctggaattatctgcctttaattttctatgtggttggttcctttttattgcctcccaagagaggtctttctcaccacctgacctgaaatagctactcccttactcagtcacttctcatcacttcaccattgttatatgttcaccattgcataaaatctaatatattcctatttgttaattgtctgtatccaccagtagagtgtaagcctacaaggaacaagctttgtcagtcttgttcaacagagactagaacagtgcctttagtacacatttaatagatgtttgttgaatgaatgaatgtgttaaattgcttatgaaatgtcaaatgccagagaggatttgattgtcccagcttggggagtagaatgtctatcccaggatcattcacctctggccaagttcccagggtccttgagcagaggtactgctatctggagggccatacctgtgtatctttgcagtccttacagctgtcttaagagggctcagtccccattttacagatgcagacactgggaaggaccagagtgaataagaggcattctcaattattgaatcctgttgggttttatgttagtagggtatgtttcatctgttcttgtctcttaaattcaatggtgttaactacatgttgataaatattttccttcatctccacctactctattttagcactagtgttggaattttcatttcctcctacaagaaagaaatatggcccagattttcatggtgggacaagatgtttcagttttcccacgctgatttttttgttgtttgttttggggatttttggcacttcggatttaaaaaaaaaatgacaaaagagtcttggtgtccctttagttgccacaatcttagtttagataacctatctcttttgttttgttttgggttttcattttttttaattaaggcttagtctttgctgacgaaatctgaaaataagacctcattttagtttcttcttctagctaaatgaaatctttagaatgtgatcatttaatagcaaagaatgtgcctaatcattgacaagaatttaaatgtgtttttagctagtcaaaaataatatgcagctgtcagtccaacatttctactcacttattattctattttctctgaacttcagctaaggaaataaatgtcataacatatgatttcaaagaataaaataaaaaggtgttagtaagtattggtttggtaacaatagagcatatgaggcaaggtataaaataaaattaattccattttatttcctaatttgatttatcagggatctgtgggttctttaatagagagttaaagagatttagatatagatatggccattgtgtatttttaaattttatataccatttctatcataaaactttaagatagtcactccatccttttatgattactgtttgtatgttacatcttttcccattctttgactttaaacctatatatggctttgtatttaaaatgaattttcttgtagagggcatgtagttgagtgttgcttttttaatcaatttggtaatttttgtctttcaatttacttgtttagatcacttatatttaatgtaattattggtatgattggattaaagtctatattttccatctttttttgttccatctatttttattccctttttccctcttttttcccacttttgtattcattgagcattttgattatttcattttgcttttacttttactttacatttggcttcttttaaattgctttaaaatttttttatcagttgccctggagtttacaatatacatactatatatacttttaataattactttatcttcgtgtatatcataaaaatgtaatataattagattccatatcattggtatgatcaccttataaccaattaagtagtgaagcttctttcagtccctatgtatatatattttaaaaatggtatttgcaattataataacaattactgagcacttactgtgttcaatattgtattccattattataagaacttttatatttattgactcattcaatcctcacaataacccagtgagggtaggttgtattcacttatcttcatcttccagatgagaaaaataagtcacagagaagtcaaataagttgatccaggtttcaaggcaataagtggtaatactacttttattttaggagaaaataacaggataggttttcatctataaaaggggggccagagaggggaagaaagccttcttagtagctcaagttttcatgtgagaaaatgaagaaaagctgtattctcaggacaggatggtagtggtgagccacactcaaacaatcccatgtagatacagagtagataaccattatgactgttatagttgttactgctgctgctgccataaatcagtcatctctgctgaaagtaactctgcactaaattctctgtcatgaactataagtcctaaaaatgtttgcattagagggaccaccagtactggtgctcttgaaatccatatgcattgatgatgtgactctgggaaatcatgtctaggtttctacttctttaagttaggtgcatctttctccacttttatttgagtttcatggggtatacatgcaggtttgttacgtaagtaaattgtgtgtgtcccatcatccaagtagtgagcatagtactggataggtagctttctaaccccctcctattcttcccccacaagcagtccccagtgtctgttgttcccatcattatgtccctgtgtattcagtgtttagctcccacttaaaagagcatggggtattttgttttctattcttatatgagttcccttaagataatggcctctggctgcatccatgttgcagcaaagacatgatttcattcttttttatggctgcatagtattccatggggtatataaagcacattttcttcatccagtccactgttgataggcatcttggttgattacgtgtctttgctattgcaaatagtgctgcaatgaacatatgagtgcatgagtctttttggtagaatgacttattttcctttggtttatacccagtagtgagattgctgggttgaatagtagttctgttttaagttccttgacaaatctccacactgctttccacaggggctgaactaattacattcccactaacagtataagtgttttaagttgggtaattttttaaatagagattctccaactctgattagtttgtacggtatctaccaaagtgagggagaatcttcaggtccataaaaatattaaggtttaccaaaatctgaaaaattattggtttagcataagtactggtaacatcgcattgtaagaatggagccattagcaaagaatacagcataaattgggataagcctaaggcagttctctcaaaatgtgatacctggtttgctcaatattgccctcaccactacccccagcccaacattagttttattttgagcattgacataatattgccctacactgagtgacatctatgacctcacataaaatcagtcatatttacaactacgggtgacttttggctgagttggaaaggcatgtaaaatatttcacagtattgaaggacatgtacttttataagttaattatttttagtattatttttcccttctaagctgctgagaagataattgcattttagaaaccacagtattaatgttaggcactttgtcactaagcaatagaatagactttgtaatgcaatttacataaattaacgactcccttctggtgcatgttggatctccaggacttaaataaagctttcaaactagtttgatatttggtggaatattaagcatgtgaaatttgtttcaaagtgtttcagttccattttcactcactttctctcctctttagaaagaagttctcacctcagactatttgttcttttccttctcgttctctctataaaacgtttgggccttaaagaattatattcaagtgatttgtacagaaaactagactttaatttgaactaactttagcaggaagcattctgaaaatgtgacacaattctctgtcttaggaaatagttcacatgaaaagaatggagctttcttagcaactcaaagaattgcagagtgttactcctatttccatcagaatgtttagacctgtagtaataaatgttttagaatatataggcaaattcaaatttaatttggtccttcatggaatctgaagaaaatatgtgttctgtgcctctacttgtgggaaatcctggctcttcttaacatttctcctcccctttcctttctttaggcaaagcggggggtgtctattctacccacccggactgtgcagtggttgtcattttagtaagaacccaggattcaggtgggttagcacttctgcaccctctggaggttcaggaaaagcttggtggtataggaccctttcaccataccaggactaagaagctttactgtgattattcgctttttgagagtatcctcacttcttcattccctctgaagtgacaagaggctgtatcttctcatctcgctggcctggcagagcccatgctgagccaatcagtgtctgtagagcctccttttgcactaaaattctttcttgcaaaattggatgccccatggggtacctgctgcagtgaaaatatgccagttctgcagagctgtgcaagttcaggatcaggtccttgaaacatgataaagggacactataagtagtacggagcctttatcataaagttctctgaagcggagttcagaagtgaggaaaaacattttagaagagtttgtactgttaggaaagaaaatgaagaagtaatttcgagtatttttggtggatgtgtctgggtataatggaaagagacaggacctgacctcttgaaggcctggttttaaatctctgtgtgacttgctacctattgtggctactccattaaaagcagaaactggtagcagaagagatttacagatttttttaacgtattgcataagaaggtgattcagtgttttcatgaatcttgtcataggggattggtagctttttatgttgttgatcttctggagatttccataacatcatagacacttgttcaagaaatatgtatgtacaaataagaagctaaatggtgggccagatggcctctgggtatcatataattttatttcatgctgctattcctccctacctaatgatttaatttttaataacatatagggaagataaatcatattgaatttttaaaatgtataaatatgaaattcaattagttacaaagaattatatattatgtaaatgtaaccttaaggaagaaaagagaaacataagtgtctatttattaggtatctttaaagtcagatagggcataataaggatcagttacactctgctaacataattaagtcagaagggaatatgtgatgtcaaaatatgtcaccagggaaggtcacaagaagtatctcaaaggacattgcattggtgaagtctttataatctagtgaatgaccctccactcttttgactcagaaacatggtattgtcaatattccaaaagtggctcaatctctctggactacatgtgtaaaccagaaggtcatctaacatgcagtgagaagtataaccatcaagcaactgggtattcacatgctctgaccagctttcccagtcgggaaatcaacatggcaggccaaagacagcacacacacacagacacacacacacacacacacacacacacacacacacacgaagctattggactgtaatcccaggcagtgtgactccccagcattcttaaccactgcataaaaggtgcccttataatcgatgaacattgctgttaaaaaaaaaaaaaagtttgctcatttctgttccatagcctacttccttgcttccatccttccactttcattgagaacaaatttgtttttggcctaagagaacacttgtgtctagatcctccctcctgctgcttccccaaatccatcaactctcctgaatcttcaaactctgaatctttgaccctcttctcctctggctccaacctctcaatttgcaaacttgcttgggtttcttccatcctaacaactgatgctcttttgatgccatgtttccttcagtcttttttcttctcttaagtgttcagggtctttaaatagtagatttgtcatctctccttgcttccctgcagtcctgcctttatctcctgcctcaaaaactgcttttgcttcctgccaactctggtagacactttgcattcttactctggcccctcttcaacttttgatacaggtgacccctctctacttcttgacacaagtatcctcctaagcttctgtcaggcttttcttttctggtgttcttctgttctccagctactactcatctccattctcatcttctctttcttcatccttccctccaatgccagtctcccaggttctgtcctgagccatcagctcatctctatgtctctcctaccaaagtggcttcaggtttcacatgtatgctgatggcttctgtctctgtctcaggcccagatctgtcttatgaggccaagatctgtaaatggagctgttaactggatgtctccacttgcatattcccaagaaacagccaacaaagcatgcggagggagatatttcctgtcttcattacctcagatcaacttctcccccaagatccaccaagaatttgcaagtcaccccactcctccttcctcctgtgcccctttagcaagcagtatggattttctctcctttgaagccttcttttcttttctatgttcctgccactaagttggcccagacccacacattttctcttttgattactgcagctgcccttacatatggtttttctgtctttattttttgtcactctccaggtcagccttcatattacagataaattaatatttccttttaaaaatgttaaaatgtgaaagtggtatgtgctcatactatttttcttaagccttggacaatgcgttggacacataacaaaaagttttcattatcttaaagcaaatatataaccgtggtaagcatactggtacatttccttccagctttaaaagaaatgcatgaatagtttttctaatcatcattgggatcatgctccatatatcactttattgcttgatttcttcacacaacacataaggcattatcccatatcattaaaagttatcttaaaatatgattttaatgaccacactatagtctagaaaatgaaatggatgaaccataatttaaccactcctctattgttgaacatttagtttgttcatttaaaaaaaattgtgcttaaatctttaactctttcctctcattatttccttgagatcaattactagaaatgaaattatttggttaaataatatgagtatttttgaattttttgatatactttaccaattgctttccagaaaagagataacaaattattccctttgtaatgcatgagattggatgtctcacactaactagaattgaatgttcacatttaaattatatgttttctgattcaataaatgaataattaaatttctaagtgaagttgagcatgttttcatgtttacttgctatttttaaattccgtgaatcatctatgcatgttgtcggtttgtctttatgttaaggtttcggttattctgttattattagtttgtatgacagagtagtcattctgaaattcaagccttgtcaaaatcctgtatcattccctataactctcaggatgaggttgaaatgccttagcttggcacacggtgccccaatcatcacgcccttgactacctgactttgctgctccaagatgcacataaatacagtacaggctattctgaagtctttccaattctcaaaaaaaaagtatttgttctttatgcctcatgcttttgcaacatgctctattttctactcaaattactattctccacctgacctctgttttgcctagccaactcctgctcactttcaaaatcactcaagagttacctcccttgtgaggaagctacttttgacctattagcctaaattatctagccctttctgtgctcttacctgagcaagcctttctcatacccctcaccacactgtattgtctttcctcataaaaagggcaggttttttgtttctgcttccccagggcctaatggccagcagatggtagatactcaataaagagggaagaaggaatgaagctgtcattcttcagctaaaaataactgcatttgcccttggaagtttatcccaatttgaatttcttatttgaatattataatatgttctggtccttcatatgtacaagtagaaagagctctctagtatttttgctaatctattaaagcttctatatataaagtgtgtggctaccatatagctaatgtctatacccacccatgaagttgtagaaaaataattctttggcatgaatttgataatctccaaaaatatttattattatgcacaaagaagtagaaattataaattcataaggtcagttatcatagcatgtagttttttcagcttaattccaaggaaaacacagtaagatgctaagaatattactaggtatatatccaaaggattataaatcattctactataaagacacatgcacacgtatgtttattgcagcactattcacaatagcaaagacttggaaccaacccaaatgcctatcagtgatagactggataaagaaaatgtggtacacatacaccatggaatactatacaaccattaaaaaaggatgagttcataacttttgcagggacatggatgaagctggaaaccatcattccaagcaaactaacatgggaacagaaaaccaaacactgcatgttctcactcataagtgggagttgaacaatgagaacacatggacacagggaggggaacatcacacaccaaggcctgtcgtgggggtggagggctaggggagggatagcgttaggagaaatacctaatgtagatgacgggttgatgtgtgcagcaaaccaccatggcacatgtatacctatgtaacaaacctgcacgttctgcacatgtatcccagaacttaaagtataataaaaaaataaataaataaaaataaaagaatggcaggatcaatggataagtggatggatggtcaataaatctaaaagtttacttgacaagaaggaaacatgttaatttggaaaaataaatttttctattacctaagaatgcttctgtgtaatttcacatttaagaatgcttctgtataatctcagcagatcatttgaggttcaattatatgctaacattaaaataattaagctctaaaagggaaattggaaaaattttgctgtgcaatttagggcaacccccccaccaaaaaaaaaaacaaaaaaaaaaacaacaaatcaactcccaagaatatggcaaaaggatagcataataagaatatccccaaatctactaattatattgggaagccaaccttcactttttaaacacatttgtcttttaaaaagttgaaataataattgcttgcctataatctactggatccacttgcttaatttgggggccaactaatctctcaagtagagttagctaagttttatcaattgtcacacccttccctctaggtagctttccaagcactgtcattgtatcctctctctgttgaacaagaaagaactgaggttggtgttacaccagttgccccactgactaattacaatttagtgtaagaagtttgctgagcaggcaatttcaaggggtatctgcattttaaggcttttaattccaattgcagaatgtaagaaattttaggcatcagtaaactactggaaaaagctgagctacttgtgctggttgccgaatactgtctgcacattcatgtctctgtatcttcgccagtgctgttctgtctgcttaaaacatcatttaccacctcaaattccacgtactttccctatggatcaagaaagtacatgtgccactttatactatgggttccttcttaggtatgcatagggcaccacaaaaactgcatttcaggggcaggtgtatccttagaaaacattgatgagagaagtcctagccaagttaggctgcagaatcacagaatgtttgtgattaggaaatgttttgtcctaagtaagggtgatcttgtctgtggggaaaaaaaaaaaaagaatgtaaggggcatatttctatgaattttgttgttgttgttgttaggaagaaaaagacactaaatgatcatttgctttccttcctaaagcactctccactctgagcttccaatcaaagccctgcagtgcctggagggggaaatccctgagggtgaagtcacctgattccactagcattgtaggcaaacttggttcccaccgctgggactcggtggcactccacagctgcctcccttcacacacttgtcactcagcatcataccttctcctcacttccccctacctgtctttcccttcctctcactcttcttgctttcatttaaaaagcaaaaataacaccagtggaaaaaaaaaaaaaacactggcgaattaacatttaaattctttcagttcagctggattcagctttttttccccctgactctgtggttgagtttttaagatataaataaaagacctcttagaaacacagtgattaaatttcttatttcatcacggaagcttccccttgtcctcttctaccctttcctagaccttggcaaagtactctttgcttctaaacttttaactcctgctgctcatgaaactgtggcttacctattaggtgaaggtcatgactggcctgctggtaatgggctgcactttgtgggccagtcctggctgtattgacccatgagctttcatgtcagggattgtgaggagtgagtgtagtatcaattttactatttcccatgagtttcaattagacttccaaattctaccaataaatgttgtaatttcctcaaagtcattttacttaaatcctattatcctgatcttgctactatatttctgtgtacataagttgactgtaggaaatataattctttcaggcttccgtcttcacggttttagtcatatatctttggctagtaccaattaacttgacagcaccatattaatactgttctaatgattcatttccttctatgctttttctgaattttcaagatagactttgttccatttggtttatttttctttatgattttaggcacaatgatttactgatatttaagattatcctggaacaataattcattgaaaatataagggtgactatgactattttgagagagggagaaagagttcaaataaagttcaaatgctgcaggcttccatttatcactgaacagaacaataaactaagaatagacaaagtggcctcctgcaaatttcatcccaattatgttttctgtattctctttttctcatcatttaatatctcatccctgttttatgatgttgtttattgtttaatacacaagatatagcagttgttgattccacctacaaaattaggatttattttctaatttacattagttcatgattttctatgtttttcctgcatattcttagagtaccaaatggataaaatcctgtattggggcacaggctgagtcactgcagaaagacacctacagatgcagcaccttacctaagatgcatttttttttttctgcatcactgttcagaggtagctggcagtccatggagggtcggtagctttgccccacagtgtcattcagggatcctggaagcaagccctgccatgctccatacttggtcccacttgcgggtccaagttggctgcttcacttgtctctatttcccaaccttggggaatgaaaaacatgaagtagaggacaatctttaacaaggagattgagaagtttcatgtgtcacttccacttgcatttcagtggcacaaacttagtactatggtaatacctaactgcaaaggaggctggaaaatgtagtctctagatgagcagctgtgttccctggtaaaacttgaggtgagggtcctattactcaaaggaagaattgatgcagggtgtcatccataattagcaatgcctttcacagatacttttaaagttagttaccttaatatagatttataagaattttatttttatttgcaaattgcccttaaatgattccccatttcactatttttctactcttcctaaacttagatgcttggtgggaatgaggagctgtcatcttacatactgtctgtgaagaagtatctgcgtgatacccattgtcctcatattcagcccactctctacattagcacataaataacatgaagataaaatatcttttttctccttataacagatgaatctggaaacaaactgatgatttatttacttaggcattccatagggtctacagtataaaaaggacatcttatgtttcctcttgggcttcccaaccagtattaggcttaacaacttaagattctcacaacccaactctttgcctcaataaaagaatactctttctagttcgttgcagttcaccataggctgtgttctcatccagagacccaggcctggggggaaaaaatagtgaagttggttattatctccactagacaagtgatgaaggtccatgtaggagaggaaggaagttggcatcagacccagtttttgaatctgaggtgttgccctgtgctccctgttaaactagctctgtcagtcatagctgatgcatctgcagccacccgtcagccccacagaatggccagcttcccgcatatgtagccccatgacagaaatagttctgctttaaataggcaagtctcacatgtgtgttttaagaaactgtagaattgcagaaagggaaggaaggaaattaactagcccgagcttgatgttgcatttacatcatacttatttattgagtttgctccctgttgggtgttgtactaggcactgtggatatagtgacacagcttctgacctcatggaactttcagtctagcaagttgacaggcatcaatcagaggataacttggctatgtcattagaactgggatacagaaagagacaaagctaagggcatcctgcccaaggcaataggttgccttcctaggccaaaagttatacttcggggatgaaagaggaaatggaggaataaataacgggatcaggattttgagaaactttccttcactcctcatttctgcttctctatttcttcagaaatgcagataactttttgaatatgtttagataggaggggaacaatagttactagtctgtttagcctcaaatcatccataggttgaggattctcccctctattagaatcctcagagggtatccatagagggaatattgaaggtgggtgaactcaagatctgctttaaaatgggcagctggggcagccagccagagttaaagccagtattcccattcacatcacaccttacttgctggtgcctgggattccttaacgggaaggatcccgcatgagagaataagcctcagagccaagaaagctggtctactctccaaaagttactgctatggttacttgtttcttttaatggtttaattttagttgactggtttttattaggtcttcccaacagccttctatcgtttgtgcaggtcctctctggcccagctgcctgttgctgcaacgtgagaacttctgacagcaaaaagagggagtctgctactgaaagcttgactgtgttcttatttaagtccttaattaggaagaacgctcaggaatatattcattggatgaataagagcaaaaccctctcccctccctgcaagaagaaaagagagtgggggtttgggtgcagggaaggatagacattaatatcctcgggtcgtattattctttgtcgtttacagcactttcatatgagtaacttttcaaattagtgtactaacccagtgaggtaggaaagctgatatcatcaccatcttacagataaggaaagtgagatttaagaacagctatttgctcacagcacccacggcctcttccaggaatcccatactctttccagaacacctataaaaagaagctccaagccagaccctgaggaaaacctcacaatttggctttgaatcttctctaaagaggttaaatctatgacaatgaaagcctattaaatgtgtgtatacttaaagatcatgaatattctacttctgtgaaaagtttagagtctaaaattcaatcagatgaagttcaatgaaaagggacccataatggaagtcatgcttctgctaatgatatcacaggacagagaaattcgtttagtgaaatgtacaagtaatctaagagtggaagacgtgtgtgtattttgggaagtggggggtagcacagagggaaaaagagaaggtttgtgtaaacattaaacccttccaggcaggggcctgtgtgatccatcttccttcacaaagtgcccagcacagtgtccagaactgggctacgtaagtgtttgtataactgaacagaaagtggagaccaagttctcctttgaaagtctaaacaaaaatccatttctgccacaatgccatcagaggtgtggtcactcagccctgccacctgtagagtcactctgtgaacaagtcaaaggccttggtgtgctaggtgtgttctcatctgttagcctccgtttcaggcaaagttttgtgcctacctgaaggacctcttcccattctccaccatggcatgatagcaggctctgccagtcacttcctagataaccacagtgagtgaggtttctttgcctggttgggtattgaagtgctctttctttcttttttttttttgagatagagtttcactcttgttgcccaggctagagtacaacggcgcgatctcggctcaccgcaacctccacctcccaggttcaagcaattctcctgcctcagcctcccgagtagctgggattacgggcgtgtgccaccacacccagctaacttttttgtatttttagtagagatggggtttttccatgttggtcaggttcgtctcaaactcctgacctcaggtgatccacctgcctcggcctcccaaagtgctgggattacaggcgtgagccaccactcccggccttgaagtgctctttctaactgcctgggcatgtctgttcttcagtccacagagagaaactgttggaatattctctagcttcccagaagttctgtacatgtctttaccttctcaagaatcatgccaatcctcccaccccagcctggatagtccatctttattctggccaaaacagaatttgatgcctttcacttctcctttctcatatatttctgctatctgtccttagaaatcagcataattgtgtaaagatagtacatttgtgggaaattttatatccttacttttagggaatgagaagagatgcatgatatataatagtgtgaaaagaaaaaccttagacaaattaaatttaagagtttaatgaagcaaagaacaatttgcaaattgccaccgccatgtagtcaaaaaggatttatggagagaaaaaagaaaatgacaaacagaaaatgctagtgaggtgcagaaacagccagattgggtataggtcagcatttgccttattcgaacagtttgaacagttggaggcctttggcacaaactcgctgactggagtttatagtctgtttatacattcagttaggttacagttcactatgcatggagaaacctttaggccacacttcaaatatgtaaggaggcaactttaggctaaacttaattttacaatacctgtttacaacagctgctacatattaataatattctattggccaggagcttcatgcagctcatctttaattctcacaataaccatgcaaggtaatcataaatataccattttacagcttcaaaaacagtgacccaaagaatgggctccttacctaacatctgtgtaaatggcataaccagaagtccagtctgtctaactcttgagctgcctctagaaaaagtaggcctatgtaacaaatctgcacatcctacacatgcaccctagaacttaaaattaaaattgaaaaaagattccagtaacattagacaagaataaaaactcttttaaaagataatacccaataatagcaaagatctggtagaaaaataaaatgattcaataccaaaaaaagaaataaaggaaaagtaggtagggaagacattttcatagtcaaattcaggatgtacttaccttcaagcaactagaagaacttaccaagaaatgcttgttggtcacctactagagaggtctttctcaaactgacccatgtatcacctgcatctgggcctcatcccagaacccctcgattagaacctctttatttgcgactttgcaattgccattgctaacagctctccaggtaattcttacattaccagagaactgtgccaggcccagagcctagagcagtgtttctcaaaatgtaatgttggaccacttgcataagatcacctagagcaattgtgtaaaatccagagtcccaggctccatctctggaaatagggtggagcccaaaattgatttatatttttaaacatccatttgattaagcatcacatgttatcattaatggtgcaatggtggtgaacattacatgttgcataattttacgcatacacacacataactagagattcaataaggttttagggtatgtgtgtgtgtgcatttctaggtgtaaagaaattatgacctgaaattattagtgaactaatatttgagaaagcaaagcaaacatgtatagatcaacaaatagatggtatatatagatagtgtataatcaaatgctacctgtgtggtacagaatctgatttcagtggaagtagataagagaacaattaatgaaggttgaaagaatcagtgctgtttttatggagaacggatgtctcaacaggcatcttaacagttgagtatttaatactttcccatatcccataattcatgaagattgcagtaatatactgcttttcccaaaataaactacaggaaaaaggaactgtgtcagcttttcagagacagagctgcaggaatacagtaggcaggagtagctggccctgaaatgatataggctgtggatgccatgcggccagcactccatcacagtgactcactcgggcaccagcctgttctcacttgtgtctcaggctcccccctcagcagaaaagcttgaggaccacttaggaatagtcatgatgcaaatgtcagtttctcctttgctgcagcagtaccaaaatcttaacaaatgagctgagtcacctggggagctcctgcaaactacacattctggtctattgggttttattaaaattagtgatttttcttccttttaccattttggagttcatgtttgcaagtcattcccttctagatagtcatgacattatctcccccttctgggacagcagaaacattggagtggcctcactgggctggatcattcaccagctttgcaattacacccccacatccctggagtcacagagtggaatagtgatgcccactctgccgagactaaatatccttactccaacctaagagccacctttaggctctaaggcctttcaactaaattgttatttgagttcttaacctttcaccatattttgcaatgagaaggtacaaattttctgcccacattaactctatcgctttatcctttagggcaactgttcaagctatttctcatttattaaaaaaaaattatcaagtattctctgatgttataagccaaatttacgagaatataatttttaaaattcatacaagtcacatttcccaatttttctaaaccatctggcacctgcaatctaaccaactgccacctagattcagcaactaggtctttggaaaggtttgtggagtgttaaaaatccaagcacacagtaggactttgctcagtacttaaaaattctactacttctaccacgaggaaagctcattttgcttctcttcattttaaatcagtgtgatgagtttgtaatattcatacttatatttaattgcagtagtaaagagttattttaaaacctcataataaaatgggaaagtattctaatatctcagttaaccaggcctttgggaaactgatgtgttcaaattatatccaaaggattatgttgatgacaacccaccatcaaggcagtcctgaatattgaggacaaagagaaagtatcttgagcaaggctgcacagatacctagggagggaagtcagaaaatcagagttcttgtccttgccactgacttcctgggtataagtcacttttcctctgggccctggctaatattagtttacattggtatgtgtgtaccagattcttgaaatatggttggattttttttcttaattagagagagacagggtctttgctgcccaggctagagtatagtggtacaatcacagcccactgcaacctcgatctcctgggctcaagtgattctcccacctcagcctcctgagtagctgggactacagctgtgtaccaccatgcccaactaatgttgttttaataggtagggtcttgctatgttgctcaagctggttttgaactcctgggctcaaatgatcctcctacctcagcttcccaaagtactgggattacaggtgtgagccaccacgcctggattgaatatgtttatattggtaaatatcctttacccaggggccctgcagtgctgccttggtcactcagcccctttcctgagattccctggatttctccatcattcagtcagtaaaggcttattgcctccctgccagcccccggtcaggcagtttccatgcagaaagatttccaaatattttgagcatcacctgtgctctgggcttaagatttcttacttctggaatgaaagtttagaatagataaccctaactctggaatgctgaggttttatgttgtacgtttattatttagaggaaaaggcagatttgacttggggccagaaccctgcctttgcctctggaattggctttttggaaaggtgtaaaactatttgcattgaaagccaggaaggacctgaaagcagttctctgccaaattgatctgtacactttggccatcaataacttcaagtataagattacttatggggccatcattgaatcataaagatgaacgtctcctcctaagctctagatcagtggtccaaaaacaggctttggtttcacagtgcgatttagaaatgaacacaaacatattcagtagatgaagatagagggtcatcttttcagagaaatttaaggattaagacagcatcattttctcttgaccagtgtgaccttttgtttgtttgtttgtttgtttgtttgttttgagacagagtcttgctctgtcacccaggctggagtgcagtggcacgatcttggcaccagccaccacagccggctaattttttgttttttttttttagtagagatgaggtttcaccgtgttagccaggatggtctcgatctcccgatctcgtgatctgcctgccttggcctcccaaagtgctgggattacaggtgtgagccaccgtgcccagcccagtgtgacctatttttgaggtatcagtaaccacaataatagagcagtaacacaagttgtatgttggatatttgagtggtctgttttggataatatatgcttattaggggaaatgcgaagtagttgttctaaaatatgtgtcattcaactttctcttctatgcaattaaaacattttaattgggcagtttaggactttgctaggccctgggcaaataggaatgaacaagacagaaagtgtccctgactttatagtgcttccagtataggtggtactcagtgaaagaaagttaccattaatgatgataatgggaggcagatttgcacagtggttaatggatgctagagaaaaactgctacttattaactgtgtgaccttggataaagtaattacctagccacttataagccttagtttcattatctgtaaaatgggggcactaatatttccttaggtctgttaataaaatcaaaaagatcaggccttataatatctttggaacaatgcccaacatatagtaactgttcaacatatggcatctctgattattaataaattggaatcactaataaaaagaaaaataacaaaataagagaaaaatgtttagctcagttctctttttcaagctctctctggagcacagaggaacccattttctataggctaattgatactgtttgaaagctgctacatcactggtgagccttccttttctctgattaaataattcaaatctcccttttcacttgttttaaagtcatgcctgctttcttaaccacaagtagcttcttattgtttgaatacactttttgaagagtggattgaaacccatagctgcttaattgtcacttgggaaacttgtttaaaacattcattcccagatggcaactccaggaatctgtggttctgatgagcaaaccaaggtattttcatgcacagaccaattgtagacacagtttgagaaattctgctcgtgacagctggtcttgcaaacccctataataaaggcagatgccataaactggacatatgtccagggctgttattagtcagcgcatgcctgttgaaatgtcaagctaattccctactgccattcctaggtagctgtggcctggtgtctctgacttttcttctccccctccctcactctaccccaaacctcagctgcctgaccctttctccaggaacctcctgaccaaccaacaactaaagaagtaacacctagcacagcattggcctctgccataggggtatggctaatgcgtactctagaactgtactgattgataatatttttaacattgcctttggaaatgattgatttagggaaaagatgacatctctgttcctcagtaaaatagccacacatacacacacacacccctacacacatgccccacatgtatgcacatgcatgtgtgtccacatacctccctgagacatctcactaaccactctactaagactccttcagtttaattaatacccaacttctttattgaagaggagaaggaatggatggcacaggcttctggcccactggttatgatgaatgaacttctctaccctgatatttcataaaaagctacagcatcttggcagtattctccaaggcttcattggaaccagcagaatcccctttaaaatacagctttatagggagagaaagccctcttagttatttacgttataacatggttattgggtatctggaggtgcctgctatgtactcctgggagtttaatttgccttgctgtgtgtgcttttgtgtgtgtgtgtgtgtgtggtcttctaatctgagtgttcatccttactatgttcacctaagttttcagcaaagatccttttaaccgttaagggttgacatcttgcaaaggttcaatgttctggtgtgccaattcctggctacaacagattaaagtattcctaatacttttctgttctcatttttaaaaaaaatattttcaggagatggtaagagattctatacctttaaatgctcccttgaatggccttagttctgacttctccaattcaaaatgattaatcacctcacttttactgccaagcctgggatattatggcactgctcagagctaacttggtcaagagtttcatctttcctggaattgtccttggtatttcaagctttgtgtggggtaggcagcattttactaggagtactaaggcatggattctgttcctagttctaccattaacttgctctgtgatcttgaccaagactctgaatcactctgtgccatagtttcatcattaataaggatgataacaacaaccactcacagctactgagttatcatgtgccaaacactaactcatcactttatatgcactagctcattcagcaacccttttttggggagttactattcatcagacacatcttgtgcattatctcattaaattctcataacaatcctatgaaggagctgttcttattattcctattttgcagatgacaagactgacagttacaagggcagaattacttgagcaaggctctcctacagtaagtggcagatcaaaaagttgaacccagtatggtctgataaccaagccaatgtttatagccacatatataccatacttcccccgattcaactgacaaatggagatgggtgtgaagaatactttgatcaaagatccggaggcaggaatgtacagagcagtgcttctcaacagggagcaattcctcccttcccaggagacatttgagagtatctgcaaacacgttgtcacaattagggggatgctactggcatttagtggatagaggccagggctctcaccaaacatcctacaatgcacaggacagttcactgtaacaaagaattatctggacccaaatgtcaatagtgccaaggttaaagcaaacctctcgagagcaagactattctgctagtgtatctcaaaagaaggagacaattgggcactcttggtattgcctggttgctaatgtacccacaaatgtccatcaggttatgaggaattgaaactgtcaggatatggggtacagtgagaatcaacagctcttcttgctggcaagcaagactttggcttttattaatcaagtttaatcaagatggatagaatgggaaggtcttcaaactatgtgaattctcacattacaccaaaaaaatttagtacctattcaagggtaagaacaaaccaactaacccctggctacatattagaatcatttgggaagctttttaacataccattgctcaggtttcaacccaagagattctggttaacttgtctggtatggcctaggtggttccaacgcatagccaagattgagagtctctgactatattagatcaaggtgtgcagttaaggagtagaatttggatgaaacagcagctttagggatgagttgataagaaaatgagcatccagtacatggaattttaaaatatttgcaacagggttccagagatgtattgcccgaatctaatcatgaggaaacagcaaacaaatccaaattaagggacattgtacaaaatacctggcctgtacaatacaaagatgtcaatgtcaaagagtgaggaatgttccagatgaaacgagactaaagagagatgataattgttcaatacattatgtgtgattttcttgtgttataaaggaacactaatgggacaattggccataatggaaagtggtttatagattataatattgtatcagtgttaacttcctggtttgataattgtacagcagttatagaagagaatgtccttgattttagtaaatatataaaacattttagaggtaaaagggcatagatctgaaacttttctcaaatgattcaggaataaagtgtgtgggttttttttgtgtgtatgtgtgtgtgtgtgtaaaggatgggtgggacaaaaggataaagaaaatgtcgtaagatatgcatattggggaatctggatgaagggtatataggaattctttgtattactctatttttgccacttttctctaaatcttgaaattatatcaaaatacaaagttaaagtaaattactttaaatggtaataaaagaattcctgtctccagagtccttttgggggctaagatacttgtctgcatttcatggatgtcttaggtgacatcttttgttcaaagaagagggaatggatagaaatgggcaagaggtatcctgaagattatcaggtaattattattattttataatgagggaaaattaattgtgactttcaagctaggagattcccctaaacaggttttctgatagagctaagttacctcttaaagcgcctccgtctttaaacatctaatgtcaagtcaggttcatctaagtcagaatagtgacctgaagagctacagctacttttagtactttgtctcggagaatgcagtttccctctttttagatccttttatcataaggtggggtgagggcatgggaggagtagctactgaagaagacagaaatagattaaatattcaattgagtaaaaccctttaaagcactcccttccccatgaccacccacaccctgccccatctatgcctccctctggcataaataaaaaatatttaggtggtgaaagggggtgcaggaactgttccttctttatagaccaaaaaaaattaagtaaaattaaaacctactttctataaaaaaaaaaagttttaaaaagtgaagtcaatgaatgtttatgggcacaaaatttattgtctacttcgaagaaagtgatttatttttacattgttcttcatgatccattgatagggcaaccacccaccccaactggcccaggacagttcttctgggtactagtcctcctaccataattatcaacaccttcttttacactgaaatgtgtcttagtttgaatatttagttctatagtcatctacctatagaaaaagccatttctcctcctatgagaaaataatttttaccaagaatggtattttacccagatcactgggcttcctaataggaaaattaacaagatcaggtaaatagccatgtggaaatctgagcccatttgtgatagaacagagatggatgtacaaatagaaaaccaacacgttccacaaatgaaacaatgaaagacttgagaacagacaatcaaaggggacagttttgctgtttcttttttcctcaaccaccattctaaattacttttttgatagaacaaaacaatgttttattcttgcccttgcaggcagaggctgcattgccagcatgcatttgtcttccatttccacataaaggccggatagtactgatggtatctgcttaagaacttaataaaactcacacctagtttcaggggaagtcaacccaggcatctgtttggaggctgccactcacctctagccctgtctagctcacaaaatgacatacatgtttgctgctctgttcaacctatctgggaagcaaaggctccatcaagaggaaataaactgtagctgatacatggccaagaggatgatttaatgcagtccagagagctttcagagcaatttcaactcccatgcttgagtgttgaaaaagtgtgactgcagtttaaagtccttatgtacgagcttatgggacagcttctttcaaatacagacaggtttttgtatttaaaatattccccaaagtagcattttgtgggaaagactgtgtataacccttcagatctgaaacagggacagtttgatggtgactagattagagtttaaacacgttctttatgttttggccagtgcagattgacaggtctcatggatgcctcttttgatggtgggatatttaaatcataggaccacagagctcctagttgtggccataccttacatactcctggacacagttgctgtttcttgtggtgggggcttgtctctcctcagagcttgtgtcgtggcaaagtatactctatgatgggcactgctgctgatgcccataattgaaggcagatattccgaggaaacctctcatgatgtaataatatccactagaattctacacaccaaccctgcatagttggtttttgttttgttttgtttttagacagagtctcactctgtcactcaggctggagtgcagtggcacaatcttggcttactcagctcaatgcaacctccacctcctaggttcaagtgattcttctgcttcagcctcccgagtagctggcactacaggtgcacaccaccatgcctggctaatttttgtagttttagtagagatggggtttcaccatattggccaagctggtctcgaactcctgacatcgtgatccaccccccttggcctcccaaagtgctgggattacaggtgtgagccaccacgcctagcccaaatattcttcatttgggaaaagaacccacctcactaaaatggtgatgacctcatagtggatgttcctttactgttgttgcatttgtggaacatcttccatactttaagaaactttctggtcgcatctgataatttttatgtggcatttgcactgatagagcatgagaaattaaccaagctctaagacggaatagtggagaagagcctgtgtctcaatagctgtgtagcaaaataaaggtcttagctctgtggccgtgctacaagcactttgtcatcactagcctctgacaatcaaatagcttttctttctcaagaataaaaaactaggtgatgcttataccaagccaacaaaaaagattttatgatttttagtgtccaaccattaaaagaacaatgactttgggtgccatctgagtggcttagaggaggtctctatttgagagaagatggtggagccaagtccagtgttggcaaactcaccaactgttttgcattgtgattgcattctcatcatgagctttagtggggcatagaggctacagacttcaaaggcaattggctcagggaaacaaaagcaataataccctttattttttgtagcaaaaataatatctactgtaaaaccctagtctgctgatcataagaatataatcttagccacctcagggttttctcagtcaattcagaccactcccaaacagatgctgaatttaaaacacttacacatgattcctgatcaactgtggaaaaaaaaaaaaggtgatgattgcaccactgtactccagcctgggcaacagagtgagacctgtctcgaaaaataaataataaataaaatgaaacccttatacattgtcaaaatgttgagatatggttgttaagagtgacagtgaccttgtttaaatttagccaatcagtatccgccactatattctcagcctgctggttccagtcatctgcatatattcctcatggcaggaagtgcccatgtttccatttgctcccctgttaagaggccacgtggttaccctccatcttccttgtcctggccaaagggtctccttgggtatcctgctctctcagcctacctctgtacccctcttggaaaaattcagaaagtacttggtggttcttccattacactctagaactatgggaaatccactggggctgtctcgggacctctctgcctagatgtccacacaaccatgtctgctctactgttaacataggacatgggagagggattctggaggctggctgctttcctggtcactcctccctctccaggtggtgaggcacaggtgctgtctgtttcagatttctcaactcacttggatcccagaattttaccaccctttgaaggttgtgaccaagatggggcggggggatgcagagcccatactcagagacctacatcagcatacaaccttattgctcccttctctaactctcctacttttccctagtccagagaatttttatcttctctttgatggaacaactgtttctgcaaatatacctccaaatattttgtgctagcagctgtaccttagcttttgaacccaaggccaagaatctgaccttttgttttctgcttccacagttgaggcagtagatgacctatatatagctacctgaatagagtaatgggattcagtgaaagaaaccatcaattaatatattcctctgcaaatgcaaacagcattccaaaaacagaagttctcgagcaaacactttccccttatcaaaggtttgcaggttgaataccttcttgtcttaagtaagctttgtgttaatatgtgaaccacaaacaggaaggcagccaaaatgctgctggaaagtaaaagataaaataatcagagtccaaattttgcttgctgtgtgatccatagtaaacctccatgctgtgctccattcagctgactcctcatcatctttctcagcatcttatgtacccagcctttcatagagacgactacaggccaactttgccctaagaacaaaatgcaaggattaggcttgttcacaaaagaaacacacaactcatgatttaaaaaaaaaagaatctgccacactcttacagctctctaaaaaggaaatgatcatgattagctcaacagctacattttcatttagagaaaatgcccatgccatagatggacacagccattcagccaaatcaatgttgattaatctcttctgcattatataaagagaaaatacctaatggtcctgagatatttataattctatttttatctgttcatgtttattatttatgcatttttacaatgctgcacaagatttttttctcatgtgataaaggagctatggtcataacttttagttattccaactagaatgacgagattaacttcagcaaaggaaaatcacttaagctccttaagtcatattttcttcatctgaaaagtggtaatagtaatgtttcctctgtgtacctcagagggttatgaacatcaatgatataatcaatatcaaaggtagacaacacatgtgaaagcaacttttaaaccctgaagtgctacgcaaacaccataatgttaatgttatcataattagtagtatacaaaacatgttttcatggatgaaacagagagagcagagaaattgtgaattctgtgccctcatctttagtggaagcaagactaaatgtcagaaagtctgttaacccaatttccctgctggccaaaaagaaccatgttggtccatcaggaagggcactagagaaaatagtgtgagcgtgagctgcccacttccaagatgttggaaccgcaactcctgaaattcaaaataccacagctttgggtaccattccttaaaacaaaaacaaacacagacatagctaaggtccatgaaggcttatataaggcaggacaggtaaaatattgaagaatatttgtaaagatcagacacctttaaactctaagcaaaacagctacaatgaaagacgcttagaggggcttagatacggtgaacatggaacttattcataacatcttggaacctccatttaaaacttgcaaaagacaaactgaggaccaaatgaaaaaggaaagagtctatacttttacaacaaagtatctgttgaatataaaatgaacttacgaaatcagtttcttctaggagtgatacagactgaaaattattatcttaattcaaaaaagtcctatttttaacatttgttttttccaattaaacattacatgtttacagaaaaattaaagagtatgaccaaaaagacaaagaatgttaacacagttttataacagaaaagcattttaacattttgatgtatctttttccaattgttttgttttatgtattgtgtgacatttaatatacataaaagtagttatgcatctatatatatgtgagttgtgaagcataatgaaataaacctctataaacctaccacctaacaggattaagtcattgtcccttatttcaagaggccagcaatagtttcacaaggggtagactctttaaagaagcacaataacttgttacaggttctatgatgacagaatgtacaaggttcagtagagagtctaaggaggatgtgatcggtttcactcggctgaaggtgaggggcaggtagaagtagaacgcccttgtaaagggtgtaacccatatttaactccattttgaagctttaggtgatcattaagataataatattttgccatgttcatctttttagcaatattggctattttgtataacaatggacagaactgtgcaagcatttgatagaaaagggcacaagcttcagagacaaacattggtgttaaaatcccagctatactgtcactagctgagtggcttttggcaaggttcttaacttcttcacaattaaaaagtgataatatctgttattgttttgtgatataaagcttatatctgaaatctgaacagtgttaaaggctggctttaccttggcccaattactacagcacagagtctcgtcacctacttggctgctcattatagtggtgcacatgacactggctagtttttcagagatggggaaacagttaaacctaaaagagactggtgtacaaaatacagtattatgtgttaattcagcatgagatgtacttctttctacttcccagaataatcgtgaacattatccaggttatccctactaccactaccacgagtaagggaaaggaagcaagaaaaaagagaaagaaaccaacatttactgagcaccatgtgccaagtgctttgcaagtatcctgttatctaatttttatgataatcttcaaatttttgttatacagctgcagggatggaaatgtggtgggattaggtactggccttagttcaccagtggatttgttgtctgtggttgggtagctgagatggttaattatgtgtcaacttggcagtgccacggtgctcagatgtttgatcaaacattgttttggatgtttccgtgaaggtgctttttggatgagattaacatttaaattggtgggctctgagtaaagcagtttaaccttcatagcgtgtgtgggcttcatccaatcagttgaaggccttaatagaacaaagactgacctctgtgactaagaagtctgtcattatactgtcgttagactggagctgcaactcatcttacctctccagcctgttggcctaccttgcagatttcagccctgtcaagcctccataaacccatgagcctcttccttagaataaatctctttctctcattaaatagatggatggacagacagatagagagataggcaggcaggcagacagatacacatcctgttggttctgattctctggaaaactctgtcaaataggtagcaaattgccccaaaactcagtggattaaaacaacacgtgtattctctcacagtatgtatgaatcaggaatccaggcatgacttaattgggtctttagctcagggactctcacaaggatgtatcacagaactggctgtggctacagtcttatctcaaggtttgactggggaaggaagcacttgtaagctcactcagtggctgttagcaggattcagctcctcacaggctgttggatgagggcctcggttcctctctggttgttggctggtggtcaccccctgttccttgccatgtggggttctccagagggcaactcacaccacagcagcttgcttcatcagaagaggccattgagaggagccagagagaataaaacgaggagtcacagtttttttgtgtgcattcctctcagaagtgacagcccaccacttttgacagattgtattatttaaagcaaatccctacatccagcccatattcaaagggaggggcttgcataagggcatgaatagcaggatgtgaggatcactgggaaccatctgagaagacagccaatcacacacaacgagtaaatacacatcactggttgacgagaagctcagtctgactctggggcccaccttctccacgatgccagctgcaacctcgaagagccgaggggaaccctccacaggaatcagcaatgagagggtggtctgtgagcatggcacaaagtgggagcatcgaatggcctaaaagaatcatccagatggtgcggaggcccattgcccctcagcaaggtcccggcactcctgcagccctcagagtcagcgcttctctcctctgcctgcagcaggctctacctgccccagagtaaagccactctggtgggcttagtcctggggccctatactcacttgactcctcctggcttctgtgtcctgaagcctgtcagcacttcccacccacaagcccaagcccccagtcttcccatccagggtgtagtgaagctgtgatgagcagcccagatcctcaagcaggcccgcagcaatcattcgctacctctaaattatggacagctgaatgttctcagctgagtccctgcatgagaatagcccttagccttggagagctggcatcacctcccagggccatgctccctccccagggatagctctcgacctgtgactgctccatgagaggagaggggaacataagatcctgaactgggggtgcctgtgaagggtacccctcccctcattgccaccttgaatctgcagagacctttgttgggactgcattgagttcaagtcctccctctgcccaatcctgggtccctcaggtctccacaggtgttgatcctgacagcactcctaaatgaagctcctgtacacaaaacctccactcacaggcctcagcctaccatccaagaaaggcctgtatctgcacagctgcagctggcactcctccagccgtctttacttactagcttcattctaatgttgtgaatgcatgaccaaggatctccacgcacttgagaagaaccaacagcaagatacataactagtgagataaaccaagagcacaggtgacctagagtattcagagctatgcagaaagtagacaagatcttttttaaaaaagagatctatttaatattcgcagaaagatttaacaggctatgacagctgtaacacaagaacacagctgctgtgaaaaagagagatataacaaaataagcgtccctgtgctggcaaaatttattggaaaatttagcagaagagttgaatggacctaactgaagaataagttaatgatctgaaaaataatgtgaaaggaattctgagaatacagagtcaaaagacaaagagatggaaaatatggaagaaaagaaaaacagataatagatgcaagaaattctatatccaactaggaatgctgaaggaaggtagtagaagcaatggagaggaagaaattatctaaatatgagtgtgaagaaactatgaacaaagacacaataagagcccactgaatgctctataggaatagtcagcaaatttttttctgtgaagaaccagatagtaagtagtttaagttttgcaggtaatatttcttgactgtattgcagcacaaaagcttcaatatgtaacaaaaacacaatacgtgactgttttcctacaaaaccttattaaacataaataagcatcaggccagactgggcttagtttgctgacccctgccttccagaaataatggggaaaaaaatcacacatctagtcacattttactaaaagttctgaactccaaaattagggaaattctgtaaagcttccaaagacaaaacaaggccaggatctcacttgtcttctataacacagttggctaaaaaacaatggagtcatattctggggaaaattgaagtgattcttaacctggattatgttctaagtcaaactatcagtctagtgtgatacacacgtatttggccagtcaatgacttgaaatgtttatcacctgtcactatcatgggaggagagggcctactcaaagatgttttctcacacaatgtaaaatgttactccaagaaagaggaagatatgagatacatgaaacagctgaaataaccccagatttagatgaagagaaatccagttatgaccattatacagcaggtgaaaaacccgatccattgaaagtgagacaccaactcagagggttctatgatgaatgactttattaaagaacacatttgctataataacacaaatgatagaattaggaacctggaagttcaattttgtggagttaccaatgagataatggcttatgtctgctctcttcaacaccagtagaaatgcatttaggaattttaggaggaaaaaaatgagacagacatgattgtttaatgaagcgagtaaaaatttgtgccgttaatgaagtgaataaaatggtgttttctgaaacagcaaatccaaactcccacaggtcaagaaacttagagttggaattaagagagtcactaactgttcttgtaaatttattttttgtttattgcatatatgaccattacagttacttctctatgtggctatttttttttctaccactgcttttgttacttttatataatattttataaatttgcctttttccatgattttattcttaagtaggctcaggttgtttttaaattagaaaatagaagtcttaaaattttatttagatatcggtattataacatcttctgattttcttaagacagatgacagattttacatctagaaacataaatttatttttcttgagatttgtatttaaagtatagaagactccttcaggaaatgaatatttcttgttttaaagaaatctttttctgaaagtcagcaatttctcatatttcttacatttcttattttattttattttacacaaggtctcactctgttccccaggctggcatgatcatggttcatttcagcctcaacttcccaggctcaaatgatcctcccacctcaggctcccaagtagttgggaccaccagtgcatgccactatgcccacctcgttttcgtttgtttgttttgcagagatggggtcttcctatgttgcttaggctggtctcaaactcctgggctcaagtgatcttctcaccttggcctcccagagtgctgggattataggcgtgaaccaccataccgaccctctttaattctttttttctgataaacttaggtaaagttacatgtaatgcttttcatttaataaaaatattaacagtgattatctttaatgtatgggtcactttgtccttatgtttatgtatatttttccaagtggtctaccatgaccatgttattttctaaaaagaacaacattattcctttcgagttacaatatcattcaaagctagagcttggcaaatatatgaattagaggcttgacgttaccatcacttgcccataacttttaactaatcactcaacctcttttaaccttggttttatgaaattaaaaaattgggttgaaatttatatttgatgattttgaaaaaacttatcctagacctgtttttttgtttgtttgtttgttttgaattgttcaaaccctttgcatcatttacaaggtcatactatatcagggaggattcttgattttaaatgtcggtggaatgtctctgggttttgtgtgtgcctacatttatgtcccaagttctatgcaggtctgcctccgactggtgatggggccttgagcatgtcatcccctgctctgtgctttgcatctttcaactttcaagtcgaggggttggaatcagtcgcctccagtgtcccttccaagaataaagggtaaaatgatgctggagacaaagcttgatcactgggaccctgtgggaaaagtagttacaattgagtgagatcagggaatctgctgcttatatccatgacgcaaagcctgaggatggtctcattctcatggatgtactgcttcatcttaaatgtaccaggattaggcaacacaaaacagcagaaataaattcttccggggatactcctaggcagattgggggtcacattaccaatcagctcaggtcaaagcttgtactatttgaatgtctctgcacattctcttcttcacttgttcatgagaacttccaacagtgtcccacctacccaatgtgttccctctttgtagtggggagaaaactcagtcaaaataaagaacgtgcagataacatgataataatcaaaggaaaaacaatgtcgtgattgtaagaacaaaccagtctacaagcgttaatgcattaattaatgcaaagagctgaaaactattaacacccaagaacagtactggtaattctcagtagcacaattgtataaatcagtttattcagagtcaggaagtgcttaggtcttaaatggtccaacccatgtcttctaaactggtacctcttaaacttcaatgggctactgattatctggggggtcttgctgagataaagattctaaattagtaggtctagagacttgtgacctgagataatgcatatttaggaagcttctaggagatgctgccaccgctgatctgttatccataagttggactataaggatgtaaagcacttagaacagtgtctgcatttaggaagaactggtgttagtgatgattattatttctactagctgcaagaattccaactctccatatgctcatgtgctacaggagtaccaagagttgtgcagcaatagccatatttttaagctgaataactagaatcattttgtaaactcgtttatgaaattttatggaataaaaatttattccgtaacttttattagatcacaaataagcagcccttggtagaaagcacatttatggaatgagcataatttgctgctgagaactgcagagaaggcctgcatattttgacaggttccactcatcaagaggactgtcacgtctctccagtgagctgaggaccatggtttcagaattactaactcagaggaccaaccagttggtgactacataaccagtgtgcccaagacagtcctgaagtcacagcataattaatagcacccctctcctagcttggacaacgcattgtgtagtcatcctaattatagtggacactatctataaattactggctttacccagcttccctagctgtccctaaactttcatttctaccacatggagaaaagggaattctcagtcaaattttcttgcttagctgacaatggttttggcactgaacgatgcctatattcaacaatcctgaagttttgtttgtaacacacacacatatacacacacccatacccacacacacggaggaaaccaagtttcatcaatacgatccaattttcaggtgcttctaatctgagctgcttatgtgaagctctcttccttttgacagaaccagctcctctttcatttccaatcatttctccaggattgcacaagaattcttcatactgctgctggtctatgagatatgcatgagaaaaactagatgaagacaaaagacgtgtccatcccactgggtgagatgcactgaaaggggtgaagccatatcgacccagcttccctctgccatagatagtcctctgggatgaaatctgcattctgtcactgacgagctgaccaccttaggcagatcgtttaatctcttttaactcgtttcttcatctgcctcataagtgtattgtgagaatgagataaattagcatatgtgcggggcctagtgtggacttggcatatagaaagcattttaacctaagtcatatctaataaattcccacatgaaaatgtaaccactgtgcaaagttgcattcccaaattttgggcagtgttagccatagccgaagagtcggttttgtttctagtaaatccacttcagccatgatagatgtagactgtcatgtttcaatttggaaatgctttccttcaggtctcttgtgtcctgaatctgtgatgggttgaaacaatcatttttgtttcaaatcttaaggaatttgaacatgagagatttaattttatataaggtttcatcattaatatacattcttttctatgtcattacataaagaacagaggaaaacaaatagaaaaggtgagatggagaggaggaaaagagattaggagtataacaagctgcacactttctaaatttaatgattgaatcataagaagttccttatatctgcatcttaaaagaatgcaaatgccattttaatttcatgggaaaaataagttaaaggataccctgctgcttttgaaaagcttactttgatcacttgccaaatggcaaaatgaatggattaaattttaaatcgcctgtcttcaaaggacatgatatggaacatatttaggatttagccctttaatttaacattaaacttactaaaaatgtcctcatcaattattgacagctcgattttaaaacagagcctccacctcaatgttgagaaggtagaacactgcttgtttttagaagtacattttctacttctttcagctacaacaccgggtagcattctgcaaaggggtaattttttaaagaggctccaagctggtgagcagtttgcctatctgcatcagcaggctcatgacccatcatttagaactcaaatggaatgtattcagtgaagcatcttgctattaaataaatgttgtaaaaaatgtgtgagtgctgactaataccaaaatctcaaatctcatttggtttatgtttcctgtgattctgtgggtatttaataacagatgttattgtgcaacaaacaaggccattcccagcaaaatatggcttagggccaactattatttttatcctcttcttaatcccttgaaatacctttttttttttttagaaacaacatcatattaatgtaaatatttaaatcctttgataatgctgctctcctgcctggagaattctgaagtcttccattgccacttatttccacatacacaaattctatccatctcttacaggccatttcttccttgaccacccccctatactaacacacacacacatacacacacacacacacacacatacacacacacacacacatacacacatacacacacatacacacatacacacacacacacacacatacacacacacacacacacacactctctgatgacacattactctgaaatatattcataatattttaaatagtaagaggaattggagattaaagctcaatagaagaagggtatttggtaggggagtagtcaagaaagacttccgagaagaaatttgtataatttttattttggcatccctgtttcattacattatggaggatcttaatacatatgtttagtgtgcatttgttgctttggttgaaggatagctttgaagaaaagaacaaattcatcaaacggtagtgtgtgggagggaggactgttctctcaacattgtctggttcatttcatcaccaagtgagccctttccaaagtgtaggcatctgcatgtcacacagttggcactcaatagtgaatatgtgagcaaaacacaaaaatgacaccattactgcccttgaagttcttgtaatccagttaatgatggcacatttgccctcactaacaacactgttatgggagcacagcagaaggatgtctaaaccttaatgggattcaggacagatttcttggatttgagatatgagctaggacttgagagacaattagaaagttatctggaggaaaaggctgttactggcggaagaaagggcaaatgagaaggcttgcaggcacagaataacctgcctttgggaacctgtaaagagaagtttggctggaatataggcaacaaaagcaaaggagaggtatgagattagtggggtgggtgatagccattttatgaagggcctttaatgccaagcagagccttattctaaaagctgtggggagccactaaagaattttatagaggaatggtataatcagaattttctcttttgctttatttatttatttatttatttatttaagacagaggctcactatattgccaaggctggtctcaaactcctgaactcaagcaatcctcccaccttggcctcccaaagtgctaggattacaagcatgagctactgcatccagcccagaattttctcttttagaaagacctctctagcagcaggcttccaaggttgatttttgggtggccagacagagaccagggagaccaagtgcagtcatagggtaagccacaaaattgatggcagggtgaacagggggctgatgggagacgtactgaaaggtccagagaacatagtgcttgttgagtagtgggatgtggaagtgagggagaaagaagagatcaggataacatttaggttgcctgcttaagcaactgggtagagggggccatttgttgtgataggatgagtggcagatttagaggccccagcttaaaaaaaaaatggcttcagggccattacatcaaagacacctattggaaatctcagcaaaacaattgaatatggggcgtggaggtctggaaatgggtttgtctaaaagacagtagaggtgtgttgggagaagaggagaaaggaaccagataggaggggcttacctactctgtgtgtgagcttctgatgttttcaatagtcactggcatctttatcctttgctcactgtctctctgagctccagctaatggtgcaggatccccaaagggaaggattgaaggcaattacccagttgatttcctccttagaattatttaatttatcatgttgttttgtaaaggacatgattaaacctttacagacaaaaaagaaattttgtggctaatttgggctctacattttcagtagataataacatcaataaaatcaagttagtttaattagagttgatttcataggagacattttgctgacattcctataattggtctttacaatctttgaagattatatacaggtacgagtatagatataaatatatagatagatgtagacatagatataatatacttggttccggatatagggatatttggatgtacagctaataagccaaatacaggcatataaacaaaatgtttatcttccaatctgggattagtaatagctcacacacacttactgtgctcagcaaccttttaaagtgatataaatatactaatttacttaacagccaggatacccctatgaggtagatactgtcattatttctattttatagtaaggaaactgaggcatcaatgggtaagtacattgttcaaggttgcacagctgggaccagcatttaaactaggtagtctagctctagagtttgctagtaacataactttatactgcctcttcttacctgtatcttatagataaatgaatatttaaacaaatttaaagtaaaattcctgtcctcttgtgagactggataagctgtaagacaggctatgcatttcatcaattacacatgcacaattagagcctatatctaatcagggctgatgacagccacagacgtttgtacagattaatgatcagagaagaggaattgatgggccagagaaggttgaagctgtcagcttttaggaaatgccctgagccaaggcagccattgatgttgtaaactgaaatgtggcagctataaaaggactgtcagatccttcctttgcataaaaagtatttattaccatgcacagaagcccaattttctggcatgtaacagagatctgtattcataactacttactcaaaagtctttagtatgcctggtccaccctcctccccatcctggggacatgtgggagagctcctttctgctacctcttacattttcatagacccattgggagacttagaagtgtcctggtgcaggcaagagacttgcagccatccacaaatggtaccttgcttggcatagccgggctccatagcctctggtgagtgccccaccagaacaagccctgggttcacgtaatgagagggtcccactcacccaaaggatggacagtcactgcatggagtcagaacaacaagagccctaggcatgcaaactatgctgcctttcggttcctctcttgtcacctgcccctacttattggacagcttccaggacaggttccaagcaatcccctcacttgctcctcttcctcagtctccactttgggtacttacaaagtggatttaggcaaggaaaggatgtactcagccatctataatagggtgcgttgacttaaactttgcggattcaagtctcttggctcgttctggtgtttaaaccttttagggaattgacccttatcagctaagagtataatattttgaatataataagaaatatattttttgtcttcctccctgtttcctggtacacagttccaagaacccctggaaaatctcctcagtgataagtgtctttttgtatgctaatgagaacactaggggccctgggtggcctcaggatggggttagaactttcagcttttcagcctactgtctgacctctgggaaggggagagatgctgaagttagagttgatcaccaattggcaatgatgtgatcaattctgcctgtgtaaggacgccttcataaaaacccaaaggacagcattcagggagtttccaggttgctgaacatgtagaggtactgagagcgtggtctagtccagagaggagcatggaagcccagtgccccttctcgcataccttgctctatgcatctcttccatctgactgttactgagttgtattctttataataaaaggatgagcataagtaaagtgcttccctaagttccgtaagccattatagcaaatgatcgaacctgaggaggaggttgtgggaacttccaatttataactagtgggtcagaagcaaagcctggacgtgcaattggtgtccaaagtggggcagtcttggagtactgagcccttaacctttgggatctggcactatcttcaggcagatagagtcagaattgagttaaagcgtaagacatccagtgggtgtctacagagaactggagaattgcttgctgtgagaaaaactccatgtgttaatgaccagaaatgaagtaatgtgagagtatagaaaaaccaatgttttggttttctttctgtacagtacagtgatagaaacactgtacttgttttagctgttctgaaaacctggactccagattattttgtgactgcacagtacatacttcacactctcttgggcatatttcccaggggttaaatgaagctttagagcccctcatttgcattggtctttaccaagacttaatagagccctagcattgtattcatgtggttatatatttttgcaaaatttgcaaaagttatttcttatttttgttctcattcttaaaaaacaaacctccaatgtttatgtttagttgctttttttgtgttttgtttttgtttttgttttgagacagggtctcactcggtcacccaggctggagtgcagtggcatgatcttggctcactgcaacctccacctcccaggttcaagtgatcctcccacctcagcctccagagtggctgagtccacaggtgcgcaccactgtgccaggctaattttttatatctgtgcttagttttctattattttgcttaaagaaggctccccaaggtgtgaaatcttcaggttacataatacttggattcacccccgctctgcctccctcattcaaaggttattccagttaatagtcctcatacacgtttttatttgtattggaggtgtttgggttattttgtttgtttgtttgttggcttggagttttttcaagttctaagtgtttagatgatgactaagaagaatcagagaaatggaaatttccttaactaaagaaaactaaaaatatacttttgaatagcaatgttattcagccacagtgaactttaggaccgctactgggaaagaaataatagactggaacatggatcatggaacttgctccactgagagaggtgtgtgatgagtccatgaggttttagaacaaagtggcttcttctagagtttgaggctgagtattagatctttgcctctcacaagaactccagggagaaaggataaaggcttctatacctttaccagcaagctatcttttcttgaagcagttatatgacacaatgtctgtctgcttctcttgttagtgaagaaagattgcagttcctcttttcacaatgatttttatttaggtagcatcaggaccacaaatggaacaaagcataatttcatacaagtttggctggcctaagaaatcctgataggttaaagtccagctgtgggaactctcacatgcacgccagttatgcccgtcacataaggagtctgcatcctgtccaggaggtcctcctgagacgcccatcacatccagagtggttcttcaacatgggatttgcccatggcctgtcaatagtatccactgagaagtgataaacctaaaggagtggttttactctttggcagtttctagtaggtattatctgaaagatgagagccttgtgattttgagagatgccaaatttcttattaaagcaatttatgcccaaagggatcataattgtgaaaattgaaaaatatataaagcgtatagcatcatttggaaagctgacaaaagtaccagtggacttccctagtagctgtttcttcaaagtcagcactgttcttttggattgacaaggaaagctggttttcttattcctgtttggagacttctcactcctctgcatgtatcagtgatatttatgcagtataaataacttgaactcactagttttggttttgctaactggctagttgtgtgacttagtgtatgtgattagcttctctggctttcagttgctttctaggtaatatggtttggctcctcgtccccacccaaatctcatctagaattgtaatccctacatgtcgagggagggacctataatccccacccgtctagtgagggaagtgattggatcatggggacagttttccccatgctgttctcatgatagtgagtgagttctcacgagatctgatggtttcataagcggctcttcccccttcactctctttccctctcctgctgccatgtaagacgtgcctgcttccccttccaccacgattgttaagttttctgcaacctccccagccatgtggaactgtgagtcaattaaacttcttttctttataaattacccagtctcaggtatttctttatagcagtgtgagaatggactaatacactgggtttctcaaggacaacaaaaattccaattcttgctcaaaggacttattgaggattcagtgagataatattttagaagttatgatttgtctgccacctgtctgatttagagttaaattgagggtaatattttaatatcctaatattttataaaatacttttttatattgaccaaatagaacatattgagcactccctgagtactgaggtcactgctgaaagctattgattgaaaaaaataataatacttgcttacattctgattggaaactctaacagaccaatcgctgcttgtttcatgttctgtaattactgaagacagtgctctccgcataacaatatctttttaatgaggatgctggacagatccttctgcctggtttttagatcaggcccatctttattccatagaccctgtgaactgtataactgatgagggttactctatcctgttaatgttaagaaagattacaggcaaaatgttggcccactcattgtgatattcaaggatctatgagaagcttttcagtttttggaacagacctccttcttggcttcaatgtatgtttctacacttgtttccccctttttctcttctcgttttccattttactttattttattttgccataatatatctttataagccatgtttgagtctttttaaaaatctggggcacaaataagaaacaaataattatagtagaggtgaataagatttaaggaaaaccacagtaagcctctctaagacagcaataaatacctgtgtccgtacatctcagactacttaagaaaagcaaatacatctaaaggtagaagtagaagccttaacatccacaaatgttcatatttgacactatataatcattttatttcaaatatggcctgagttcggcctggatctgtgtttgttatttggtaagcagcacatgcacatcttcagacattctacctggaacatattttattttattttattttattttatttatttttcttttttgagacagaatctcgctctgtcacccaggctggagtgcagtggcacagtcttggctcactgcaacctctacctcctgagttcaagtgattctcctgcctgagcctcccaagtagtagggattgcaggcatgtgccaccacgcccagctaatttttatatttttagtagagacagggtttcaccatgtcagctagtctggtcttgaactcctgaccccaggcgatcctcctgcctcggcctcccaaagtgctgggattacaggcgtgagctaccgtgcccagcctccaacccctattctaacctctcccactttcttctctagagtccattattgattttctcagagtaccatttgtgctctacaataatcactccatatcctctccttaccaagtctttaattgctctgagcaatgcttattccctcgcaattacacattgctaggcagattattctccagttccctacctctgaagcccagaatattaggcttagaattctctggcttcctcctatgcttctagactgttgttccatccctttttatagatgatctctgtgaagcccctgccctccagttgaactcttttcttcctgtctatgctgccataccctgcggctctccaggtcactcctcctgtttctcacgcagcttatctggctcatggttgtccctcaactctgtttcctgttgtcctcctgagtcggtggtcaccgtgcaatcctcttacctcgctattctttagcctctattcccatcatcctcaccctgtcatccatcacaattccattcatgtgcctcatgttgaccctaagggcatctgacactgaaaaccttctgaaaccttaaacttacaaaattatcttttgggtttacaatttttttgtcttctacttttcccactatgtcattcctacaaaacttatttttctaactcatccagaaccttgaagtctcacatcttcccattctttcagttgaatgtgatactcctggtttctcttctttcctcacaacctctcatagtcgggcatctcattgcctacttgccaagcctttcaagttattccttcatgtttcttctcctatccctcaacacacacacacatacacacacacacacctgtcttgtactcatcaccttggaatgacccaaatatccacttcctcctctcctggggggaaatggtgtaattatattaggtgctctgtattcttcccagagtcatctggttctgtaggtctgcaaggctgcctatatttgtttcctggggctgttgtaaccaagtgccacaaactgagtggcttaaaacaataaaaatttattaccatacaattctgaaggctaaagtccaaagccaaggtgtcagcagtgcggtgatacctctggatcccataggagaatccttttttgcttcttcctagcttctggtggtttgctagcaatatttagcattccttggcttgcagaggtgccacttcactgtcttcacaggacactctccctatgtttctctgtcttcacatggctttcttataaggacactagtcaacttagattagggtcccataccacttcagtatgacatctttttaactaattacatctttgatgaccctatttccaaacaaggtcatgttctgaggtcctggggttcagacttcaacatatccttactatctcttctctctccctctttgttagtttcatttcttcagccaataagtgtttccccacactaccaaaaatctgcttgtgaccgtgactgcccacatagttagcccagctccctggttttcattgccaaactctttttccagctttttctctgcccttcactcctccatctgtaattaatctattacacatctgttcaaacagctctctcagtaaggtcatcagcatcagcccatttgtcaaatccagtggtgtcatctccatcttcaccctatttgaccttcctgcagcattcaataccagtattatcacacttccttgaagggcagctcttttctgaccattatgttgtacccttaagggtctcactagacctcctgtctttccccaagccaactggatccttacttctgagatcctgttgtacagcagtgttcagtgtgtggtttatagactcatgagggatcccaataccagttcctatgttgtcaaaactattttcatagtaatacaaaggtatcatttaccttttaaattgtgttgacatttatacccatggtgcaaaagcaatggtagttaaaactgctggtactttagcatgaatcagtgcagtgccaccaaattgtgctagcagtacagtcatgtgtcgcttaacctcaggaagatgttctgagaaatgtgtccttaggtgatttcgttgtgtgaacatgatagagtgtatttacacaaatctagatggtatagcgtactacacatccaagctctatggtacagcctattgttcctaggctacaaacctgtacagcatattactatactgaattcggtaggcaatttttacacataagtatttgtatatctcaatatatctaatcatagaaaaggtatggtaaaaatatggtattataatcttgtgggaccacagtcagatatgcagtccattgttgaccaaaacttcattatgcagtgcatgactgtatttctattcatcacagccacacactcacagttaaaaaaagaaaaaagaaaaaaagcagaaaaagaaaatgccaattttacttagaaatgtccttgataaggcagtaagttttattcatttttttaaccctttaaccttaagcacatacctttgtaatattctgagtaaaaaaatggaaagtacacatgagaagcacttctgtgacatccagaaatacaatgtttgactggaggaaacattctaagctgtcctaagctgcccttggtacttttctcatggaacaccatttttacttgaagaaacaactgacaggcaaagtatagttatggacactttggtatttggcagacagtttctcaaaaatgaatgaaatgaatctgctactataagaaaaataactgaaagtgtgtgttgcccaataataaagaatgagctttcaagcaaaaattaaaattttggaaaacttgtatccaccaatgtgaattccacagcttttgaataagatagatggtagatagattaaaagtaatggcaaaaatcacaattacttttgcaccaaactatagtattaatgaatgtgatttttaacactgtattgaaattggtcaagttggaaaagttatataactcagggaaccaatattgtctaaatgattaatgtacactattatgaaatcattgcatgggttaaaatttattcaaagtgaaaaatagataaatggatcttaataaaatcatataaaatgttatgtgattatgcagtacactttaagaaactactacttattgagttttgatgagatatcaatgaagaatactcacaattatttgaagggctgttaaaatactccacccttttccaaccgcatatttggatgaggccagtttttcttcatacccttcagtcaaaacaacttggtgcaacagattgaatgcagaagcagatatgagatccaggtgtcttctattaatgtggaaattaaataggtttgcaaaaatgtaaaacaatgtcaatcttctcattaaactttttcttcttttggaaaacagttatttttcattaaaaagtttatgttaacaaacaaagggcttattattattacttttaaatagatttatatataaatattttcaagtttctcagttgtaatttctagttcaataaacattgttaaataaaacccacatttacaaaaattctttaggatcctcaataattattaagagtgtaaagaggtcctgaaaccaaagagcttgagatcgctgctgtggaactttattcaaacaggatgctacaaagagaactaacgatcgaggagaaattaataatttattggatttgttgggcaacacaactggagaaaaatgggagccagaggacaacaaaatattattgtgtccctggtgagaacctgcacatcaagaccacagaagattttctgtaatggcaggtggagaattcctacagctagtgcttttggtgacactgttttgcctcagtgtacatctggtggcttcattgtgctggatctgcctctaactaatttggtctggtatcttgttgcctcagcaaatgatatgtgtgtaatgtcaccaatggaaacaaaaatagagaaggctagcaagtccctattcttggacaactgtcacccctacaaataaaggtcccaaaaggcctgaaaagagaggacatgctgagtaaatgtcagctgtttattattatcatcattgtggactttaagccccatatgatccagtgaaaaacctggtgcctgagctctggactacaccccaggtttggtgcaagagctccttttgtttttcagcctaagcccaaaacaaggaatatcaaagagtttcacgtcaacggccaattctaacttggtgggagttggtgcctggagccttctattgaggatcagtgggaacaagatgttctcgatgtctgccaatgcctcaccaaggaggtagcacattgtcagcaccctctaagcctaaaacctggagtccttgattctttgctcctaatgcagtctcttgaggccaaactgctctgataaactgagatgtgaagcataaaaatgaaatatgaaatgaaaaggaaggaattagactcaaaggaaaaagcacctcgctttcaaaagctagacttaatggcccaagctcaggcattggagaggtgatgagaaggtgaaactcccaccctggaaatgggaaaacataccagccacaaagaagacccaaggattctgtccttaaaaaaatattatactctatatagaaacaagagtttttaatctcttaattctcctattcctgaaaacttcccaaactaatcaaactaccagctgtgacttgaccagttcagagtactctcattgtgaggaaacagaatgcattttagtcatcagtattcctgctcaggaaaacacagtattgttgggacacaattccgtaatgagactacttggagtggtagctgaagccctgagtctgggagttggctgatcccaaggcttaagagatgaagggagacaaaaagcctgctctgcataagacaaggaaaaattcttgttttgttcgtgatgggaaaaggagtataagaaaaaaactgaaaatgcgagaaagaacccctcaaatctccacaaatgtcacaaaaaaagcaaaagcttttattgtattctttggggtccttggactggtataaaagagaagagtgtgggcagacaaaggagtcaaagataggagggggaactgcagcctggggattctcagaaatgggcagcagggtatggaatcatcaccaacatgggcttgaaggtctgatacaagttgatctggatgcccaagaggcaggaagaccttccctgacattcgagttactcctcctgtggagcctcagaagtcagtgtttttacaaccccacctcactatgttgattctcttagatgtgatctaattaaatataaatgctcttattaaaataagcatctcctcctatcaacctgacagtataattctttatcaagttgacagtatctctctagtcagggtcacaaggactttggcctggtcctggctctgctactgactgtccatgtgcccatgggtaagtccttatcttttcagatctcagggttctgactcgtaaaatgatggaggtgaggaggaaaaggttgagttcatcatctcttaagtccattcctagttaaaattctatgaatcttgcagtattaatatttcatgcatctccatccttacttgtactcactgttatgagaaattaccttttactgttgaaataaaagaatcaggttggttgtatatataatttccttagtggaagtttctctattaagaacacactagcttataacatatactagttttcttataataaggatatttttatggctaagaggaaccagacagatcagacagatggtattaacataatgcctatatattttttcttttttaattctctagttttctgttatgcctttctgcagtgttctgggtgtcctcttacttgtgtgtatctgcttcacatgttagattgttagatggttgagggtcagaacaatgtgatactcatctctgtatcctcttaaagtcttgagagagaccatgcctcatacaaagtaagcatttaatagatacttactcagttgaattgaaattgtgtattgagtctaaagtttttaattactgctttgtattgtgatagcttggttatgctgtaggaataaaataattctcaaatctcagtgatttaatgcaatagagattttttttttccttgctatggcagagttggctatagaatggggttggagtcgggagaaaactatttctgcttcatacagccactcagggacccagagtgaagagaatcctgtttctgacagctgtaccttttgaaacacatggcctcttcagagaaataaactgaaaaattactcgagggctttcttctgcactctacacgtatttcattgaccaggactaatcaaatggtactgcctgactaggaaactggatggagtggatcccatatttttaggcaagaaaagtgcccacccctccctaggcctggcatggtggctcatgcctgtaatctcagcactttgggaggctgagacaggtggatcacttgaggtccggagttcgagaccagcctggccagcatggtgaaaccccatctctactaaaaaatacaaaaattagctgggtgtggtggcacatgcctgtaatcccagctactcaggaggctgaggcaggagaatcacttgaatccaggaggcgggggttgcagtgagccaagatcatgccactgcactccagcctgggcaacagagcaagactctgtctaaaaaaaaaaaaaaaaaaaagaaagaaagaaagaaaaagaaaagtgcccccaagattggtaatcacaatatttaccatatgctttactcagtagctccagtattttggagataatgaacttctttgagaatctaatgatcattatgatccctctcctctacagaaatactcaacattttgcgtaatttcccatttgtttcatatactttgaatgctattcactggtcctctagagaaccttggaccaagattataaatcattcaggcatgttttgcacctggcaacagatctacagatgaaaaaaatacattactggtgttctatttaaaccatatgttattaacagcctatttatttagttgtttgtttttatcagatatgacatcatacgagatccatgccatggccaatggattttcctctgtgtttgtttttatcaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggtaaggtaattgtttaccaaagttattctttttgccctacattattttttaccattttaaaatgtaaatgaagccctttctattttcagattggttggtagtctataaattaattcactgagaaatagacccacatcatgatttccagacagaaacagcttagtggcttagaaaacaggctctgagagctgcctaccagagcaagttacataacctcactggggctccttattctcatctgtaaagtggggatgatcaagatctacaccccatactgttatgaggattgcatgaattattgtgtgtttaagtgcctaatatttggcaaatacacaataaatgcccgctagtagttataataagaatgacgtaatcacagctattcctaaccttcctatcagggttataattaaaacttaaatcatatgacagctttagtggaatgtataacttttcaatgattcatatttatgagaaaaggtgacaaatatatggaaattaatttgtttcatccaaaaatcaattctagctcttccaaaatgaaatgagtaattcttggcaatgcttatgaagttcacagcaatagaaatcaatatccatcatgttccattagtgccctcacctcatcactagataccttgatccatctcttaagtgatctgtaagtatggtttccaccttcagattctacagagatggcacagtgaaaagaacacagacattggccctgcatccatgttcaaattccatcattgctattctaatgtgtgtgatgtggacaaacctcagtttcctcgtctttaaaatctcactcagttccttaaaaagttaagcattgaattaccatctggcccagcaattcgactcctaggtatttaaaacaggtactcaaaaaaatacatgtacacacacgttcacaacagcactattcacaatagacaaaaggtggaaaccattcaaatgtccatcaatggatgaatggattagcaaattatagtatgtccatatgatggaatattattcatccataaaaaggactaaaatactgataaatgctacaatgtagatgaaccttgaaaacattatactaagggaaagaagccagacacaaaaggtcacatattctgtgattctacttataggacatatcaagaacaggtaaatctgtagagacagaaaacagcatggtggttgccagtgaccagtgggagacaggaatggtggtaactggtaatggtagtactggtagcaataggcagaggagttcctttaaggtgatgaaaagagcttggatctggatagaagtggttgttgcaggttaggaatgtactaactgccactgaactgttcactttcaagtggttaattttatgttatgtgaatttcaccaaggaaggaaggaaggaggaaaagagagaaggagagaaggaaacatttggcaggtgcgtggtgggacagtggactggcagccaacagcatagcctggggatctattagaaatgcaaaccctcaggccccatcccaggcctcctgaatcagaaatgtaggggatagggctcagcaatctgtgttttagtaaggactgcaggtgattctgatgtacagtaaaggttgagatccactattttcaggattaaataaggcaattgagcacatggtatgtggtaagtggtaattattattacggtcgggttcatcggttcatttgtcgcaggctgaaactaaacccatgttttaatgtgccaacatgacacatctgaagccatgatgaataagtttcttcatctctactctatttgaaaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggtaagctttgcggtccattttaaaaataaacgtttgtcagcaacctagaaaagccaaatgagattaacaaccttgagatcctgggttcacagtaacatctgcatttctaatagatttattcctctgtgtggacaatgagagggaatgatggatgagaatgcagcatcagactttgcacccgttcaaaaagcaactcaggaacctgtactaaaatggtgtcaagtccatgaagcttctggattgcaatgcagatattttaagatccaacagcactacctaattcttgtgggatttaactctatcccaggaggaaattgtttcctcagaacagacaaaatgaaccctaccagctggaaggaggcatctatgctgtgcaacccagttttattgctgtcacagtgctagtacacactcaggaaccccttgttacaagaaaacctgcctgccaaagtgaacctccaagttcctaagaagtcagtcacagcagcctctaactttaaaaaaatcttagtcactttgttctgatgttggcatatgtagctctgattcactcattctcacgcagtatagcattctaaaatatgaatctaccaccacactttatttagccactctcctgttgatggacatttagattatttccaggttttttgctattacaatcaaagtaacagttaacattcttgtacatctctatgcacttgtccaaaagtttctttaggctttgtagttagaagggatactgccctcaatttcagcagatgatgacaccttgcgccccaaagtatttttttctgtgttatattaggagaggaaataatagaaattgaaggggctgaaaccaggtggcagctgagatttttagcactgtgaattgagtggtaactaatggccattatgtctgctctgtctactgctggttatcttgggataggaaggagctttaaaaatagaatctgaatgcctgaccccaccccaagagattctaatttgatgtgggtaaagttcaggtatcagtacattttaaaagctcccccactgattctaatatgcagataagttcaagaaccactggtagctaaatgccaagtaccaagaatagtcaacttataagttcttaccagcatttcttaatgtagcaggaaaacatttggcccagagtcgcccaccccagaaatctgcagttttgataatcacatctgttgatccttgtatacgccaaaacctgagaaccctaggaattatggtgaccaactgtcctggtttctccaggactaaggagtcccttggccataggaccttcactgctaaaatcagaaaattcccaggcaaaccaagaaaagctggtcgtcttaccaggtacctagattaagatgatgctgatctgattaataagcacttcttgcaagaagattgccagctgttgcatgtatgtcctgaaagttaaattatagaactttcaagagcaagctcactggaggtttccttgtaatcaccatcacatcactcagcttctcaggccctttaaaatggccataagttttaccttcaagaagcagtaggtatgtctaactaacatgtgctgatgaaagaagcaatataataataagagagatgttagtgaaatatgatttcattaaacgtctggttcacatccaggatcctgatcttagaccctcccccttcagagagccacatgtgtgatatgcttaaacactgcacagtgtataaagtaaattaagtctactcacatgaagccttgtgaagccctttcccacagtcattcaggacattgcagaaacaagcacacatatccaaatggaccaatttcagccaaggtccttgaagctgccagtttgactcctatgcacagatattgacaaggacacacttgaacactttgtagaggtgttttgaatgtcagcaaacagagctctttatagaatcactaaggtcttggctagaggacctaggagtctgacctggattttacagaaaaggaaactaaggcccagagcgaagcagggagctgatttgacaatgaaagtgccagagcttccaatgctgtgctcttcctacttcactatttagaaaggaggctcaggctatgtcagactttctaaccatcacaccccagctggactccagctcactcatgtggagctgatcatccagtaaaattcaaatcatttttatcaagaatgtgaaagaacattagttgttgtcagcattcacaaagattgatgcagaaaaagctaggggcaagttccagacacccttactggctgacccagctgagtccaggctctggaaggcacagacagggacaaatgtgacttgggactgatggaggcagaaggcacagatgggatggaaattaggccccggaagggacgctcacagagcctgacacagaagaggaaggaaagaaagagggaggaaggaaatggtcttaaagaggcagagaaaaaaaagcagttggcgatgggggatggggagctcggagtggtaaataacttatcaataatgttaaaaatacacgccttttaccttaatgttacagctaatctatagcacccaccttcttttatcacaataaatgtaccatctaccatttttgaagggccctgctttgtaataaacacagagataggacctattattatccccattttatggatttggaaacgaggctgtagaaagaagcatgaactttcccaaggtgacacagctggttggtgacatcgtcagatttcaaaccctggcgcttctgactccagagagtaaacttcacactccgccagctggccttctattaaggatactggttggcttggctgacttcaggcctgctctgcttcaactctggcaaacatttatttgtttttaaccctgaatcaagaattatttcttggtttttttttttttttttttttttgagacagaatcttaccctgtcacccaggctggagtgcagtggcacaatatcggctgactgcaacctcctcctcccgggttcaagcaattctcctgcctcagcttcctgagcagctgggactacaggcgcatgccaccacacctggctaatttttatattttttagtacagacggggtttcaccatgttgaccaggctggtctcaaactcctgacctcgtgatccacccgcctcagtctcccaaagtgctgggattccagacatgagccaccgcgctaggcctcaagaattatttctaacaaacaccaatctaaacttccagaaagcctaacctagtgtctggtaaatgtgcaaatggagacttgtgcatttggtacaagagcaaatattgagagtttcctgatttttaagtatgactgatattgtgtccatggaacagctgcaatctggatgtattttctaggatatgtttctctccattccttgccagcaatttgggactgtttgtctttatttggttatccatttatcccttttctatgtccttgaagcttcctcagccacacacatgcatgatttgcgtccaacaattgagttgaaaatatcagacgttaaattaaaggttgtttcagctgcaacaatcagggagcagggccacacccttcctcctccccatggcatcctcccccacatcgcgtctctgcccccttcccaaccaggtgccaaggcaagaggttgctccttcagtctcctcctgtcactttgcacaaatattcacttttccttatggtaattttctatcattcaacttactatcttcacttcttactgagggaaagaatgcatgtttcattcattttggtattcccagtacctgaaactacctggcacatagtggatgctcaataaacattggaggaatgaatgtgtgaatgaacgaaggaatagaccagagctattagcctgcctagagatagtttctttactgacaaattgttgctttcttatagctttagccagactcagtcgggaagcattaaattaatgttttctataattagaggacttctagcattttcatttttaaaaaagtgatttagtaaaatttagttttaatcctttggcagaatcatttcagtaacaaattataactaattgcatgttaaagaatgactacctcagttccagaagtacagaaacaaattagaatgggagcagaggaaagcaactcaaatgatcaaaggaatggagttttgcattagaggaatgatgaacagtgtttaattggtagagcagagtgattgagaaggtatgtagacatttaaagctgctgggaaaaagtcagtctaaagaaagaacgttatggagcagggatccagagtgagatgggactcgggctaagtcaactgactggctgcccccagaggcaatgacacagtttattaggaccctttcatggagaacaaatgaaacagtggggatccaggcctcatctcagacaagcaaggggcaaaacagtctgtagttctttaaggaggaatattggtgacctctcagagagggacaagtccaattcctgaaaacttctagagtggtcctagaaacaaacataaagaaagcagtgcagttataatggaaccatgatcagacccaaacctgtgggtgcctattgaaatcctttgaaatatttaagatgttgcgacaggagacgagggccacgttatattcaagaagtgtctctcagttccctttattataccaagagcaagtttatattccgaaaattatgagaggcataattttaaacatccttaatcattgtccccatgaccattctatctttgatccagagagtaagtaaaataggtattatacattagaaaataaataaataaaaatgacttaaaattatgtggggatgaagataaattacttactatgtgccaggcactgttctaaataccttacaatattatttaatgttcacagacaataacaggtattattattgtcctcaattatacagctggggaatgtgaggcacagagtggttaagtaacttgcccaaggcgacacagctactaaattaaaatatgtcctctgccactggcaagaagagtaaaagattggttgagccagcacccttgccctgggaagtgaaacatttttctctagaagaaatttaagattgctgtaaaggagaaatttaagaatacaaaacaacttatgcctttcgttccctcacattttatttctctactttttggcacccactaaaacacactactgcatcaattctttacggtacatttcatgcttttttcttgtgtccagcaggacgtgcagatcaaaatttgccttcctctgtttaaggggcagttattgtctctataaaacacaatccttgtgtgtttctattagtcccttggggaatgtgtagaagcccatcagtttaacagtgacctagacagaataagatgggctctgaccttgaggagaattatgagttgaatatttattttgaaatatctgttgttcctgactccagaagcagtacagtgccaggttcttttctgatgtaaaacaaaataggagaaaataaaaacccagcctggcaaaatagcttatctccaccaatcagcagaaaatggtaaaatagagacgcacgtggcactaactagacaggaaatcagaggtgggaagcaaaatgccagcctttattctgctctctaagatggctctggaaggtcatgttcattgtcactgaaaatgcctgcagggagcgatatgaaaagtcattgtctcttcttttttttcctcctgctatttttagctcttgttaggaagatcaattttagttaactgcagagaagggtttttaaaatggtgcttgagtttcaagttgcatgtgtctgctatatttagatttttttccaaattcttctgtatcaaaacatgacatagtaaggcaattttgctggtgttactgcttggtatggtgttttccccaatgggaaaagatattccattaactaatgtaacctatactaaagaaacattttctattccaggctctgattcagaggtagaaaaaaattcagtttttaaaatatagatgaacacctatgtttttggtgcatgtggtatgaatattatataaggcctcgattctcattcagcaattgctgtattctctgatcacaaaaacaataggcaagtaaaacagtgagtgtccagtgttcccattagcacagtctctctgtgtcataccccacataagggactcagattgggatcctggagcacatgttcaaattttcccattgcctttgaaagaattgtccctggaaaaaaaaggttttttcagaggcttttcttcccagcatatattccattaatctatcttccatcactatggagtagcaatattaaaatacttccttttctaaatttacaggtaaactgtgtacattgtagaaaaacagaagacatatgaccaaaaaatgggaaaatatgaataacaaatcctactgcctataaaaaaaagtactttaaggaagaatcattgtagtgtttacccttgcattttttcttataggtatgtgtgtgtgtgcatttgtgtgtcctcacagttgttgtggaggctgggcccctaatatggggcaagggagaacaggatgtttcattcccagggaggacccagctcacagagggctctcccaggcagctccccctttcttcatctccgccactttcctctcaccccatgtggaggagcccctttactctggtcgctctccctctttatcttcccacctctttcccctctgtggttcccttagttttctttgcctataccttccctccgggattctgcttctttttctcaaccattaattcaggtcctcagtcaatcagttgatcccataaagtactttgggtcctaaatgtctcaggaagggttgaagataaatctccccattcccaatctagtattagagagaaacctccagaagataagcaaatgttcttatactgaaatatatatagctccccttataccaaaactacagagtatgctctttgtcttctttctttcccttgctctcttgctcactctcatcctcccccttccccatcttaccaaggaccccttcttatttcctactttgatatggatcagaactgaggagggggaggaaaggaaagagaaccccaattatttcatcaatattttcttaaaatgcacacatacaaggcctactgaggcagaatgtcagtttacagccctgatgccacctgcagcatcccaacctcgtgcatgcctaaatctaggaagtagtaaggcggttacgctggtcgctcagcagacctggattggagttcaccacttttctctgggatccaccaaagttcaataggagctcatggaaacacaaaagaatcagagagaaaaaaggttacaaaggactgaattccctggactctgtcttttaatcccaaatcctctttccacttccacttagaagataagttctttctctgctcccagattgagcttgtgaataggcagctaccaaatagctatgatttttatgtttccaataagtctctctgcacccagaatatctccttttattttatagctgtaaatggagatccaacatgaagagaggcttttctcttgcctcaggatgatgattgaaacataggatgtgagtttgaatctaggcttctagcctccacattttattagctctgtgaccttgaggaagtttcttaacttctctgtgcctctgcttcttcaatagtaaaatcagtttgtggcaagcatcaaatgagataatccatataaaactgtatatccagtatcatacataggaaaggctcagtgtatgttaactatttattatcacttgattttcaaaccatatattagccttctattaaaatgtgtcactgagtgtggtggctcacccctataaatcccagtctttgggaggctaaggcaggaggatcagttgagcctaggagtttgagaccagcctaggcaatgtaatgaggcccctgtctctacaaaaaataaaaaataagattatctgggtgtggtggtgcacatctgtggtgccagccactcaggagacagaggtggatcacttgagccaagaggtcaaagctgcagtgagctgtgatcctgcccctggactccagcctaggtgacagagcaaagtgagttcctgtctcaataaaaaaataatttaaatgcctgtgttaagctcttagctcagtgctgctcaatgtgaaagctatgatattttggagttgacagtcctacacattgcagtacatttagcatccttgggtctcacctactaaatgccaacatccacccacaccatatgacaaaaaaaaatccatttccagacaccattaggggtttaacattcttatgtgagaaccacactaattatactttcttgaatgtgacaaagagttgtcacaggcatagaggcagagaacgcctagtaaggggtcggcgatgtgtgcagaaagaagagtggaagaggtgagatgtatagaggagcagcccctgcctcccagctttcctcactcctctatgccttcccagacacacacacactttttttccttccctttagaaaactaggggaagacaagaacaatgagaatttgcatggcccatgtccatttatcaattgccacataacaaactatcccaaaaatctagggcttaagacaacagtcatttattttgttcacaaatctgccatttgggccaggctcagggggaagggtcatctgttccatgcaatgtttctggggcagcacaactgggggctggcaagtcaactatgaagatggttcactcacatggttggcaaaatggtgctattagctgagagttcacttagactgtgggtcctggttcttcttaacgtgggcctctttatgggctgcttgggcttccttacaacttggacatagggttccaagcatgagcattctgcaagagcaaagtagaagcgcatagcatatttgttacctaattcagaagtcacactgcttacttccaccacataggttgaggatcccttatccaaaatgcttggggccagaagtgttttggattttggatattttgggattagcgatacacaacaacctgtactatatttgtcaagacaatcattaaagcctgcccaggattgaagggagagaacacagagggaacactccttaatggaacattgtcaaggttacaggagagtatgtggggtgggaaacattatgaccatctttggaaaacacaacctgctaccacaaataactttcctgttgagaattcacccgtaatatgagagatagtacagttttaaaatgagaatgtagaggatcttcttccagagtccaaaacttccttccctaagagatgcagattaactcagtttataatttatagtctcttcttttcataatttattgtgttgtcttttgaggagattcattgtcaaagagaccatgcctagaataactatcaatggccaaaacaaaacaaggcaaggttcagaaggaatacatgatccatctttagctagagaacaaatattcactaaaaatatgagttgccatgaaaatgtattaaaagtgaaagacaaaactaggctccctttcagtagagtcgcttgtagaatatgtaaacagtgggaagtatgagagttagggacagagaggggctatgaacacattctttgaagtcaggcaagcctgagtttaaatcctggctctgccatttactacctgtgtgatctcaacttactgttgtataactagatattatgaaacccacatgacagagctgttgttataattaaagatctatttcatgccaagtagttacagactttcctgtgcctggcatttagtaagtgctccataagcaattgttattatgtttagggaatgtagtgagtttctatgacacctactgtgtgctagcactgatagaatgctgataagaggatagatgcttgcctttaaatggttttccacttagttgaaaagctaaaacttacacaagttaaactataggaagaatattcacgtgtgagtacataccagacatcactcaagtatgttagtaatgaccaagcgtgatgctcttcataaatcaatcacatattcattgaacactaatgtgtaccttaagctgcagcagtcacaaaaggttaagtcttgacttcagtggtttggaatataacacattgctagaggaaataactaatgaataatatcaaaggtgatataattaagcattataaatgggtgtttctatctcaaaaaaaaaaaaagaaaatcagagatctcattaaaacggcaacataagattttctgtctcatggaaatagaggtatagaaaaggttaggaaagaggaaaaaaaggagagaaaattgccagtgatgacagagaaaggggaagtggtggttggaggaaaaaggataggttcattttgaagaccagattatatgatacccactaccgtgggatgcagcctgttatcgttcaccccttactgctctttgcaatggtgtctccactgaggaaaagctctttgcaattgttcagctgcttaattctttgactattgtgtgatgtaatcagattagttaatcatactggaaaccagaaattacttgggggcaacagtggccaaaataatatcgccctaaataatcatagcatgcatcttgggagagggctttatcaagtatttgacacatatgtctgtttcctagtatcccagtgatatgagtgttgttctcattgatgaggaaaactgagattcagaaatgttatataactttctcagagtcacattactcatatgtgataaggtgatctctccaactgttgtcttaggtggcttattctggcacggaagttagttcctgtcgtggggaaaccagcaaagagtattttgggtgggagggttagtcatggatagggttataacaaggggtgtgtagggaaggagcatgcagagaaggtttgacaagcaatgttcaatagtgcttggtgactgattacaaatgatgaaagagagagaaaattcaaggatgactgactctaaggatttgcacctagaaggctggaagaatgatggcaattctaagaagcgtgatagctggtaacggaacctagattggcagagaaaataattctactttagacatgtgagtttggaaaagagtagtcaacttgtagagagacgtcagtaagtcaggatgcatgtgtgagatcaggcctggatatgtagctcctcatagggcaggaactggggctcatgatgagcaagagaaagaatgtcctggaaagaagggcagcaggtgctgagcagagcaaagcttggccttgcctgttagatgtggctgtattttcaaagcctctagttctgggattctatctattgcttggcagtacacatacaaagactttgtccagcaggcactaaacttataggaagatttccccttccttccatcatagagtttttcttattaggaatctaaataatgaatctcaaaagcttctctaatacatagacatgtagctctgtttcatctctctacctttaccttgtctgaattttgctgatttttataaactttgcataatcatactgattattttagaaagaatttaagaggtggccaagtcatggcccgtaagccaaggtggcatgagagagaaactcagtggcacttggactgccagccaccaacacatttctctgcaattgtggcaagtgaggttgtaccatgtcaccaagtttcccagcccctagtcagcacagggactcaccctcctccctcctgagaatgggaaacagcccatgggcaccctcactccctcctccagtcatagaggaattgggacattgtcacaaacctgtctccagccacttgggaaaagacgagacagaactttggcatctaatttaagcaatggccaaacctcagtcagtttcaaaggcctgaatgagaatttaacgttaaccatgtgctaaaaggtttttcatttaattggctgaaagtttgtttcatggaataggtagaaaaccctgaccaatgcacttgttggtgacttttggtcctggcctcctttctgcacacaaaggagaggacagtttcaatactggcagaggagtgagcatgtgatgggtcaaccctctgcttgtcttttcagagaaatgctggttccattggtctgttctcactgcaccatggtgggacctcccaccctgtgtgggtaagatttgacagactctctgtccccagacaagcccagttggtccatgtgcctggtgacagcattgacgtcagcccttgtggtagaggaaatagttgaagcccaaagggaaaaagaggccaaaaaaagaaaaattcaatccaacaagaccaaagctatttctttttattttgtggttctcagcagctgttaagctttgctggctttcgatagtaagaaagtgtccaagaatagaacagtgcaatgtcagagttaatgggatcacagcaataaaatgtctctactactgagcaatctgatggtattaagttgatgtggaagttgctttgcaccctgcacacagagtggactccctgcttgccctcccattctgagtgttcccccaacacacctattctgagaggaaagcaaccacttctaaagtggtaaatgcattgcaaaagaagtgtcttcaggccgggcacggtggctcacgcctgtaatctcagcactttgggaggctgaggcaggtggattacctgaggtcaggagttcaagaccagtctggccaatatggtgaaaccccgtctctactaaaaatacaaaaaattagccgggtgtgatcgtaggtgcctgtaatcccagctactcgagaggctgaggcaggagaatcgtttgaacccaggaggcagaggttgcggtgagccaagatcgtgccattgcactctccagcctgggcaacaagagcaaaacaccatctcaagaaaaaaaaaaaaaaaaaagaagtgttcttcatctcagccagggaaaaaaggtttaatcaaaggcctagctttgttaggtgtattttattacaatttctttaaaatggccagcttcttgctaacagatggaaaaaggggaagggtgtctgagatctccgaattctctggcctgagccttgccctcatctcaaccccaggttctgggtctctgctgcagattcctttctattcctcatttgaggatgacagaggccatccccctttcctcaatgcactccccatccacagagcaatgaatgaaactacagtggccaccagtgtttcttcaaaaggggcttcccctgcaaatgtaagaacttaaaaaaaaattctatacataaaaacaagaatcaccaccatatttgatgactcagcaaacatttctttctctgtctctctttggatggtgtctttcattcagcattgcaagaagttcctgaaggaaagacaaaatttgagaaaccctggatgcggttaactcaatcattgttcaccgtggaactttgagtgacttgatgttctctcctgaacaacaatgagaacaccaaagatgaacgggagctggtggctgggagcgccagagaagccatccaggattccttacctcctttcctttatgcattctcagcttccatccctccattatcctctacctgcactgttaccatttaccattttccagcaaaaaaatatgtagaatggaggaagggagggggcacattgtgtgtgtgccagtatcctcatggggccacagcctcttgctgggagttccatgtaaccgtcaccacccaaacacagaagcactgagaagcacttagggctgatgggtacacatgtagattctactaaatcggaatttgcaggtttgcttccctatactggtaaactctttttttttttttttttttttgagacagtcttgctgtgtggcccaggctggagtgcagtggcatgacctcagctcactgcaactaccacttcctgggtttaagtgattctcatgcctcagcctccgcagtagctgggacttcaggcatgcaccaccatgcccagctaatttttgtatttttagtagaggtgggggtttccccatgttgaccaggctggtcttgaacttccaacctcaagtgacctgcccacctcagcctcccaaagtgctggcattacaggcatgagacaccacgcccgacctaaactctttttttaatgagcactcccagttaattgtcagtgtttaagaaccactgcttagagacacccccaaccagagctgcccactctgacccagagcctttgatacaaccctcagataaagctggtttgttgtagatttctctccttagcaatgtctgcagattatctgtttacccggggacatggattaaaatgccaaaatattttagagagaacagaacccacacaattaagtgaaccttacttagcatcgatacatacagcactataccgcatatgcgtagtttgcaacttccccatggattacagcgtgctgggttagtgccaactatcaattcttgctccgcagggcaggatagcaaagtgatcaggcagtcatctccttcctgggtctcccctgtatccctgctcctgtcactgtcttcttctgtatcagactgggccacatcagcttgcttgtatcagagattcaatgcttgttgatgcagttctccctgcctatgatttcaccacttctagactttaaatacagagtcatatcagccatacttcaatggctgtggctggttctatttctctgtactatcaatatccagggaaatgctggagttgtaacactctatttctgtgaaatatttgctgccctcacccaggaaagcctttactctacacagcaggatgtcaagggcaagaggtgcctaatacagacttctctgactcttaactgaatgagcacactctcagcagggtatggctgtgttcgtttgctagggttgccataacaaaatgcaacaaacctccgggcgtggtggctcacacctgtaatcccagcactttgggaggccaaggcgggtggatcacctgagatcaggagttcgagaccagcctgaccaacatggtgaaactccgtctctactaaaaatacaaaaattagccaggcacggtggcgtgcacctgtaatcccagctactagggaggctgaggcaagagaattgcttgaacccaggaggcagaggttgcagtgagctgagatcacaccactgcactccagcctgggcagcagagcaggactctgactcaaaaaaaaaaaaaaatgccacaaaccgagtggcatttatgacaaaaatttatagactcaccgttctggaagttagaagttcaagtcaaggtgtacacaggaccatgctgtctctgaaggtgtcaggaaaggatctgttcctggcctgtcgtagctttgggtagttccttggcttatggctgcataacctcagtcttcacatggcattctccctatgtatatgtcaatgtccaaacttcctttttctataagggtgctagtcgtattgatgtagagcccaccctaatgacctcatcttaatttgatcatctgcaaagaccttaggtccaaataaagttactttcacagctactagaggttagttaggacctcaacatcttttgaggggactcaattcaaccaataacaatggctgactctgaatgtctacatccttcccagcatcacttagaagggcttcgatatttattgcattatcagtgttcctcattccctaacgtcagcacccagaatttaaaactgtaccttggagagaggttccaagatggccggataggaagagctccagtctacagctcccagcgtgagtgatgcagaagatgggtgatttctgcatttccaactgaggtaccaggttcatctcactggggcttgttggacagtgggtgcagcccacagagcagggtggggcatcacctcacccaggaagcactaggggttggggaattccctttcctagccaagggaagccgtgacagatggtacctggaaagtcgggtcactcccaccctaatactgtgcttttccaatggtcttagcaaacggcacaccaggagattatatcctgtgcctggcttggagggtgccatgcccatggagcctcactcactgctagcacagcagtctgagatcaaactgcaaggtggcagggaggctgtgaggaggggcatccaccattgctgaggcttgagtagataaacaaagcagccaggaagctcaaactgggtggagcccactgcagctcaaggaggcctgcctgcctctgtagactccacctctgggggtagggcatagctgaacaaaaggcagcagaaacttcttcagacttgcacatccctgtctgacagcattgaagacagtagtggttctccaagcacggagttggagatctgagtatggagactgcctcctcaagtggttccctgacccctgagtagcctaactgggagacacctccaagtaggggccaactgacacctcatacagccaggtgcccctctgagacgaagcttccagaggaaggatcaggcagcaacatttgccgctctgcaatatttgttgttctgcagcctccgctggtgatacccaggcaaacagggtctggagtggacctccagcaaactccaacagacctgcagctgagggtcctgactgttagaaggaaaactaacaaacagaaaggacctccacaccaaaaccccatctgtacgttaccatcatcaaagaccaaaggtagataaaaccacaaagatggggagaaaccagagcagaaaagctgaaaattctaaaaatcagagcacctcttctcctccaaaggaacgcagctcctcaccagcaatggaacaaagctggatggagaatgactttgacgagttgagagaagaaggcttcagatgattggtaagaacaaacttctccaagctaaaggaggaagttcgaacccatcacaaagaagctaaaaaccttgaaaaaagattagacaaatggctaactagaataaacagcatagagaagacgttaaatgacctgatggagctgaaaaccatggcaagagaactatgtgatgcatacaaaagcttcagtagccaatttgatcaggtggaagaaagggtatcagtgattgaagatcaaatgaatgaaatgaagcgagaagagaagtttagagaaaaaagaataaaaagaaatgaacaagcctccaagaaataagcgactatgtgaaaagaccaaatctacatctgattggtgtgcctgaaagtgacggggagaatggaaccaagttggaaaacactcttcaggatatcagccaggagaacttccccaacctagcaagtcaggccaacattcaaattcaggaaatacagagaacgccacaaagatactccatgagaagagcaactccaagaaacataattgtcagattctccaaagttgaaatgaaggaaaaaatgttaagggcagcaagaaagaaaggtcaggttacccacaaaggaaagcccaccagactaacagctgatctctcagcagaaactctacaagccagaagagagtgggcgccaatattcaacattcttaaagagaagaattttcaacccagaatttcatatccagccaaactaagcttcataagtgaaggagaaataaaatactttacagacaagcaaatgctgagagattttgtcatcaccaggcctgccctaaaagagctcctgaaggaagcactaaacatggaaaggaacaactggtaccagccactgcaaaaacatgccaaactgtaaagaccatcgatgctaggaagaaactgcatcaactaatgaacaaaataaccagctaacatcataatgacaggatcaaattcacacataacaatgttaaatgtaaatgggctaaatgctccaattaaaagacacagactggcaaattggataaagagtcaagacccatcagtgtgctgtattcaggagacccatctcacgtgcggagacacacataggctcaaaataaagagatggaggaagatctaccaagcaaatagaaaacaaaaaaaaagcaggggttgcaatcctagtctctgataaaacagactttaaaccaacaaagaccaaaagatacaaagaaggccattacataatggtaaagggatcaattcaacaagaagagctaactatcctaaatatatatgcacccaatacaggagcacccagattcataaagcaagtccttacagacctaaaagagacttagactcccacacaataataatgagagactttaacaccccactgtcaacattagacagatcaacgagagagaaagttaacaaggatatccaggaatagaattcagctctgcaccaagcagacctaatagacatctacagaactctccaccccaaatcaacagaatatacattcttctcagcaccacattgcacttattctaaaattgaccacatagttggaagtaaggcactcctcagcaaatgtaaaagaacagaaattataacaaactgtctctcagaccacagtgcaatcaaactagaattcaggattaagaaactgaccaaaaaccactcaacttcatggaaactgatcaacctgctcctgaatgattactgggtacataaggaaatgaaggcagaaacaaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaagaattagacaagcaagagcaaacacattcaaaagctagcagaaggctaagatcagagcagaactgaaggagatagggacacaaaaaaacccttcaaaaaattaatgaatccgggatctggttttttgaaaagatcaacaaaattgatagaccactagcaagactaataaagaagaaaagagagaagaatcaaatagatgcaataaatatgataaaggggatatcacaaccattcccacagaaatacaaactaccatcagagaatactataaacactctacgcaaataaactagaaaatctagaagatatggataaattcctggacacatacaccctcccaagacttaaacagaaagaagttgaatccctgaatagaccaataacaggctctgaaattgaggcaataattgatagcctacgaaccaaaaaaagtccagaaccagatgtattcacagccaaattctaccagaggtacaaggaaaagctggtaccattccttctgaaattattccagtaatagaaaaagaggaatcctccctaactaattttatgaggccagcatcatcctgataccaaagcctggcagagacacaacgaaaaaagagaattttagaccaatatccctgatgaacatcaatgcaaaaatcctcaattaaatagtggcaaaccgaatccagcagcacatcaaaaagcttatccaccatgatcaagtgggcttcatccctgagatgcaaggctggttcaacatgtgcaaatcaataaacataatccatcatataaatagaaccaaagacaaaaaccacatgattatctcaatagatgcagaaaaggcctttgacaaaattcaacagcccttcatgctaaaaactctcaataaattaggtattgatggaacatatctcaaaagtaataagagttatttatgacaaacccacagctaatatcatactgaatgggcaaaaactggaagcattccctttgaaaactggcacaagacagggatgccctctctcaccactcctattcaacatagtgttggaagttctggctagggcaatcaggcaggagaaagaaataaagggtattcaattaggaaaagaggaagtcaaattgtctctgtttccagatgacatgattgtatatttagaaaaccccatcatctcagcccaaaatccccttaagctgataagcaacttcagcaaagtctcaggatacaaaatcaatgtgcaaaaatcacaagcattcatatacaccaataaccaacaaacagagagccaaatcatgagtaaactcccattcacaatttcttcaaagagaataaaatacctaggaattcaacttagaagggatgtgaaggacctcttcaagaagaactacaaaccactgctcaatgaaataaaaaaggacacaaacaaatggaagaacattccatgctcatggataggaagaatcaatatcatgaaaatggccatactgcccaaggtaatttatagattcgatgccatccccatcaagctaccaaggactttcttcacagaactggaaaaactactttaaagttcatatggaacgaaaaaagagctcacattgccaagacaatcctaagccaaaagaacaaacctggaggcatcacgctacctgacttcaaactatactacaagtctacagtaaccaaaatagcacggtactggtaccaaaatggagatatagaccaatggaacagaacagagccctcagaaacaataccacatatctacaaccatctgatccttgacaaacctgacaaaaacaagcaatggggaaaggattccctatttaataaatggtgctgagaaaactggctagccatatgtagaaaggtgaaactggatcccttcctcctactttatacacaaattaattcaagatggattaaagacttaaatgttagacctaaaaccataaaaaccctagaagaaaacctaggcaataccattcaggacataggcatgggcaaggacttcatgactgaaacaccagaagcaatggcaacaaaagccaaaattgacaaatgggatctaattaaactaaagagcttctgcacagcaaaagaaactaccatcagagtgagcaggcaacctacagattgggagaaaatttttacaatctacccatgtgacaaagggctaatatccagaatctacaaagaacttaaacaaatttacaagaaaaaaaatcaaacaaccccatcaaaaagtgggaaaattatatgaacagacacttctcaaaagatgacatttatgcagccaacagacacatgaaaaagtgctcatcatcactggccatcagagaaatgcaaatcaaaaccacaatgaaataccatctcacaccagttagaatggtgatcattaaaaagtcaggaaacaacaggtgctggagaggatgtggagaaataggaacacttttacactgttggtgggactgtaaactagttcagcctttgtggaagacagtgtggcaattcctcaaggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccatcaatgatagactggattaagaaaaggtggcacatatgcaccatggaatactatgcagccataaaaaaggatgagttcatgtcctttgtagggacacggatgaagctggaaaccatcattctcagcaaactatcacaaggacagaaagccaaacaccacatattctcactcataggtgggaattgaacaatgagaacacttggacacagggtggggaacatcacacactggggcctgtcatggggtgggggaagggggggagggatagcattaggagatatgtaaatgacgagttaacaggtgtagcacaccaacatggcacatgtatacatatgtaacaaacctgcacattgtgcacatgtaccctagaagttaaagtataataaaaaaaaaaaaactgtaccttgtgaaagtttgctatttgcaccattaaggcttaccaagatgtgcacagtagcacataattagtgccctgtcactggaactgacaatacttgctccagccatccagtggaggcacttagactgagaatagcagattcctgggctgcatcgggtctagctttgatcctggaagaaggtcaggatttagggaactctggaggggaagtgaggctatgcgaagtaaaagtagctattttggtggccctaagaatgtagctgtcatgattaggggccaacagataaaccagtttgaccaaaacaaagaaggaactgatgcaggtagtgatggaaaagattggtgagagattacgcagggtcttctgtgctagactacaaaatttatacttgatcttgtgagatctagagagccactaaccaggaggatatctgggagttattgtttttggaagatttatcttttgatccatgaaagatgggaagtgaaggatgggatgtccggagaggattaagattagtatgtcaacaatgaagttgaaaagttacaagcatgcaggttgagaataccccctcctcttaccccaccacctggagtccttccgcttgtcttttagacccagatcagctgccagtccactaggaagcctttcagagttacttaccatttgatgccatagtccttaacatacattgccaccatagtgctcaccattttatattgtgatatgttctgtctccacatgtctccactggactgtgcacttgtgaaaggcacaaatactttttattctaccttgtagcctttatgaacagcaatagaccacgagagatgctcaagaaacatctaatgaagcaacagaaagacagaaagccagtcagctaacagccatttgactgtaatatgagccagtcaagaatgtagacacttggaactagaaagggccttgatggtcatctaacccagttacccagtaaccactgaatcctgggcatgtgataaccccaccttattccatcctggagcagctctggctgtaagaagtgtagagctggaggggaactcagaaactaccatattcaaaagataaagaagtgaagtgattggcccaaggttgctcaaaaactagcagcaaagttggaaaatagaagagaaactaatacgactaactgccaagtccatccagtcctcgccaccatcctacagagtggaagtattaccatgttgaaatttacggtaaaggatgtggaggctaagaggtattgagtggcttgtttggggttgcacagttgataagtggcagagccaggataggaggaaattgatctctttccacttgccaacaccctgtgccatccctgcataagatcacaggcttcctgagaccctggaaaatgctcctgtcatttcctaagcagaccctgctccaggatctcttttgaaatccccccctctttctcacttccatttttcttgcttttcaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 36422 - DNA, 177481 bp, Homo sapiens
ggcgcgggcggcctggagccccgggagcggcgcgcgcggtcccggcccagcggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggtgagcagttttgcaacccgcctccctccagttttttcctctccctgcacttcctcacccccgcatccatccgttgcagtcgcctcctaggtgcaggcaccactggggacttcccggcttgcatttgtttttttccttcacgagtacaaccgtcagcacttgaatcgcattgatctttccttcttcctgtcgatttagtaaacgtattccaggtaactcgccgggtgcagtgcgtattaccccagggtgtgtgcagagagatgtagtttccggcaggtataggaggggtgcagcttcattttacatctggataaaaaacgggctttctttagtgtatcatcagttggcagtggaggcgagcaccctgcagttgcggtacacttacacagaacagcacgaggtgggggtttccacacttagcattattagcacaataaaagtgggcaaacctgaaagcttgtcgactatctctgtacagtcagacaagaggtgtgtgtatgtgtgtgcgtgtgtaaaggctgaatttttaatttttaatttttggcgagcgtgtgagatgctctccattccttcttccccacccttcaagatgctgactctcccacccccgtcaagataactttattttggagaggaatacccctcatggcacttggagatttgaaaggactgcaggaaatttggtgggcattattattctataagtgatttatttctacccaggcaataggtttattagatcataagtaacgtgaatttcacttttatggtcagacttactgcgaggaattgcagatggagtttgtaggttaggatcagcactggcaaaattaatttgaccgtgttattgcctcatgagactcccagtcctgcagttaagattgacatcagcaaaagtataaggtcggtgggggagaaaaagtaggaccagaggagggggtaaatacacttgttttctagagtcaaattgttccttttgaagtagaaattattaataaaagattaccctgagttctgccttttctcactaatttcactttagccatttcttcaggaaatacagagttaaatgttcaacccttggatccaggacgaaccttgtaaacatatcaccctattgtgtcattttgttggtgaagaaactgaagcgtggaatggtgaagtgactagtccaaggtcataccgggaaggtggcctgctctctagtttttgtctgcattgtctcagtgacctttgcttgactgcagtcaccctgtctttatgcaatgctgctgaaatacctcctttctaaaataaaatagatctggtataaagggggaaaggatggtggtgactgggtgggagcgttggatttccctccactattggtccctgggcaagaatgtgtgccccagggcatgtaactaatggtggccacaggctgcaggaacctgcatgctcagttcctcttgggcccagatccttgtccccctgtccccaccccatatgacaaatatgtgtatgaacaaaaagaagtcatcaaggtccttgctcttaacagcgacaccagcatggggctgatggagggtgggagaaggaggaggagtggcccacttcttcattgggcctccgcagtcagcccagctctgctgtgctcttgaatcagcattctgggaactgggagttgggggctggtgggagacaatccctcccagtgctcaggtcccctgaagctatagtttaggttgaggaaaaagttttctggtttcaaaaatatgtgtacatgtgccatttctttcttgggtttggtttatgaaaagctccaggggatgtggggcaggttggacatgaactctgttctcactgggagtgactcccaaaccctgggcttttgagtttctgggccagccagattgagtttggttcagctgaaggatggagaactagcagtcaaactcataatgaggaattcctaaccggagggtgagggtacaagggtgagatttttcttctctgtggctgccttcctatgccattgttgcctcttgctctgaggttaataagaagtggaattaatttgaatctgtaaggatttgagtcagataaaaggaagaacttccctgtactgggctttctgccacaagttctatctggtgcagacccttcagaatgcaagcacaggttggtgactgaaggggtttgaggtgcccctcttggaactctggagtaactaacatctatttggaatgatctttctagcaaggatgaccattgcctctgtgtttccctggggcagacctggtttctaagttgtctctggtggttatgaatagcacccccttcactctcaaaagtgtcaagatgtgacaataaattatatggtcctacttttagccttaagccaagttccactttgtaatcacgactttccccttcaacgtttaaacctaaggaatggtgatgttttccaacagtactgcttgacttgagtgtggttctatggaggtgcagtgagctggggaataaaatttcattcctgcttttaggaaatttacaatttaaggaggagagcaagcagatgcagatacaggcatgtcaatgtaccaggatgggaaccaggaaacatggtcacaagaaaccagccacaactctacaatggtgtgataacgggctgtgtgacatgcagcgcatgggagatggagagataaggggtggtgggctcagacactgtccagcttcttgccctctgacctttgagtgaggttaagaggacactggcagcacaggttagggctggaagcagaagctgcctgaaggaagcaggcctagaggcgatgttaaggccaccaccttcagggagaagagaagggaaggctttctaggggaatacttgcatctgagaaagagccctgtgctggagtcaatgtcggtcctttttcctctgcttcgctaatgtcttgggtaaactaggcttggttattttgaccattttcctcctcagtttctctaaggtggggagaccggcttctgccatgattacttaaaggcacatttatgatactgaaatgtgattgtaggggtgaaaataatttgctggcagatatcaggacttttctgcccatgttcaaggctcacgcctgtaatcccagcactgtgggaggccgaggcgggtggatcacttgaggtcaggagttcgaaaccagcctggtccacatggggaaaccccgtctctactaaaactacaaaaattcactgggcgtggtggcagatgcctgtagtcctggctactcaagaggctgaggcaggagaatcgcttgaaccccggaggcggaggttgcagtgagccgagatcgcgccattgcactccagcctgggggacagagtgagactccatctaaaaaaaaaaaaaaaaaaggcaaagtttagaagttgagccccttcttaaaggccaggtccaagaagagggattccctaattcatgccacactgaatttcctcctgatttctcataagctctgtctgtctgcgccatcatacctgctttttcctctgcctgaaatgatcttccccaactcttgtccttgcctgggaagctcttattccattctttaacatccaaggaatacctcttggtattctcaggctatggtgggaagagtttcttctgagcttggaggcagcacttactgccttgtgttagaattgctcaactgtctcatcttcctgtttgctccttgagggcatggatcaagttctcttgtgtttccctggcacttgggaggcccttaatgagtatttgtggaccagccacacacctggaagaagagaggcccagagggtaggaagcacattcacattatataaaatgtatttgtaaggaggaatacagtgaacccacacatggatagtgaaaatgagatggctcattcggtagtgaggatgcaagcggcatggcctacagatagtggagccctgatttgcctgtgctatatgggagttattttcaatgaagagcttggattctattttacagaatcctcccttttagggctatcattctggtttatgctaatggtattgttttggggaaaaatcctttggaataaagcacaaagcctaacaggatttacaggtttattttccttccaacaagctctctcttcataattcctacattttagaagccagggagtattcagtgtcctgatttgagactgaaaataaagtgtctattacagcacaaggccctgggacaaaaggcctcctttgggggtggaataccgttcagctttagatctcttttgagtagattcttccatgatacacttgcttgggaaagaattggctggttgattctgaagttaggatgtttgacctgtgtgcttccagaataagatgagaaggcaaagaatgtgctgcttcaggttggcttttatgtagctgaagagttgctcggggccttgggttggctcaataagggacgtgaccttgaaaagctcttcctggttccacttggcgtcttttcttagggagctctgtgcccagtctctggccgcttttagttcataaatagcttgcatggttagaggcacagaaggtggaggctttgcgagggggaaggaatggaggaaaggggttggtgagaagagtaaggaggcggaatttggagggatgaaataaaaagctgtctgattaggtaatgcacgtttacaaaacaaaatttgtacaaaagcgtatgtggtaacaaatttccttccctctcatgccccctgttcacccagagctcctttccgggtggcatccgttgttatcaatatttttgtatatctttccagaaacagtctatgcatgtacaacatgtatgtacataaaattggaaacttgaattataaatggcttcctgttacctgtagtccctggtatcctgaataatgagattaactttagctctaaattatatttgtgatattatgatggtgaattgttagaaaattacctgaagtatcataatataaaatagatgattactttttttccaggccaggtgagaaaaacctcattctcctttcacttcaagcgttcttgcagagcaggagagcagcctgatgtagcccccttgtaacttggagagatgctggagcacagttcccttgagatgtggagtccaggcttgtaagagcatcagaatacagtgatcatggatcttggttttaatttgtgttctgtctgagaatgttttctctatgttctgtaaaatgaagttaatggtatgcttaataaattgctttgagacttgggatccacgaggcagatccttatagcaacgaacatcccaaggcaaaaggtggatgttgtaggaacatttcattgtcagattttggtctgttcctccttagagatgacagccatcttcatagtgtcattgttgaatcccagggcagagatagttggagccagctttgttccacccactgtaatggagggacacagggggcagtcttatcataatctggagagcaggtaatccaaaaaataatcgatttgcttttgctatgtatttatgtagtcttttttttaaagcattcgtttaccttcctaattaagttttgctcaggtgaatattaaaatgagtttgcattctttgatctattgataagggaaatggctggcctaaatgtattcagggaaaggcagtttggagtttagaatttgcgacaataattcagatgcagataattgagagttgataaaaatgtattaaatgttttaaatgaataaaaatgtattaaaacctgggggcattacattgacctttcctccatttatttggatttaaataaatgtgatggaaagtaaaagagagctcactgcatttttggtttgaatattcagggattagtatttctccagaggtggtctgggctgtgggggtgaggcattctctgttgatgagcatgggactttcctatgcattttctaggtatgccagacactgttggcagatggtatagtcagtctagccacgtacatgcaaaaatcaatttccctcaatttaaaatgagccacagttaatttcgacctaatttattggcttatcgacctgtgaaccctgggccttcgaagaagtggcatgggcggccttcaagcgctgaagtggctgatgaagctaaaatccagaaaaggcagggtgggctgctgagcaagatcaagatttgagtttcctcctgtgttattgtgagatgctcagttttttttaactgtaacatgaccaatgctttgtgcattttatggtgggttccgtaaaaataggactgcgtaacgatcacaagtacactagtgtgttaaaaaataattacaaagttctgttatccactgggtaactgtttattataatggtaacatccatgcccatagcactgctactagccaagagctggaagatcctatcttcctggccgcgtcctggaccctccgatgtggcactgttcaatagatctttctgtgatagtgatgttttctatctgtgctgttcaccatgttcactagtcagatctggccattgagcaggtgaaatgtggcaagtgtgactgaagacttgaagtgtctttcatttaattttaacgaatttaaagttgaaatagccacatgtggctcttggctactgtgtagacagcacaagctttgacaaggcctcttcttcccacctgtaggcaacctctgcttcacccaagagagaagttcctgcaaagacctgctcgtgtaggcagggcaaacagggcaataaaagcaagagtggagggcttgggtctagaccctaggtattggtggctgctgactgccaagttgagtgtcaggagacagtggtccttctttcctaggtaggaactcaccagggggaccgtggagggccaagtgggtccggtggttggctctagggcatgcctctgcacagttgcctccttctgtcagtcacttagtcaatgaaggctggctattcatagggtgaaccagatctctgtggcttcacttctcatctggccttgcgcaaacactgcacttgtatcgggctttgctaaggtggagcgcagaccctgcacgttctgtttagcaatgaaagatgtaaacagtgccttaacagtggggccatctccctgccctgccctttgcttcctgtgcttttgttgacttaccttgatgtagctgggtctgtctttcttcccttcaaccctccagattggcatgaagacaaacactacaggcgtgtggtcttcatctttgcatataaacctcccccacttcttggctgaccttttaacttagcttgccattgctgttgctgctgctgcaggctcttagcttggaaaatcaggacccttcacaatgatttatctccagtcccctgaattagattcaaaacacagctacgaattctcagaaaggcaggctgatgtgattatatcccaaatctgagtggctgacaaggacaataaaaagatgtacctatatcaaatgcatttgtgccgtgtagagaccaatatgttgtttattatctccccccctttctgggggttttttaaatgaagaaggtaactgatgtgacctctattatttagaagagagactagcctgttgagtagaaaccctgggggaagatgactagggtgaatcttacatgaaataaatgtgggggtgaatcaatgggtgggccctcagttgggattttaatattttagggatactgagatgatttccttctgactttggggggctggtgagctgaggtgtagtgtcatgatgaattttttttttttttttttttgagacagagtctcgctccgtcacccagctggagtgcagtggctctatctcggctcactgcaacctctgcctcccaggttcaggcgattcttgtgcctcagcctcctgagtagctgggattacaggtgcgcaccaccacgcccggctaattgttttgtatttttagtagagatgaggtttcaccatattggccaggctggtctcgaactcctgacctcgtgattcacccaccttggcctcccaaaatgctgggattacaggtgtgagccaccgtgcctggccttggtgaaatttttaactctgtgcccagaggcattggaaaggctggtatgatctggttgagcctggagggccctgggttaagagccacctgtggagaaaggctagcttggggactgtggctgggaagactttaataggtacctgtgagatagcaagctatagggttaaggtcccagatagttaaggaccccatttctctattagcccaggagacacatgcgagacagttccacctgtctctgccccagggacctggggagaaaggccagtgctgatctgcccaaggatctcagccaaggagcccgagatggcagggagtggggacagagcagagtggggtgagtgtcctgtgaaaccagaagtgtttggaaggacttgcatgctttgaacctgtgctcaattaattgagtaacctgagactctgtacctatgacttacctcatctgtgtacatttagttccctgaaattctctcactgagtggttaaaaaaaaaaaaaatctgcagttaactgtgcacatggtttgctgaatttggcaaggtgtgctgttggtggtggtggtgatgggtgggctggagggggacggttactgcagaaacaaggccttcaatctctagaggagaaaaatgaagcagtggatgtggaaagttggttagaggtgaaagagctatctaaacagagctgggggagtttagctagcagaccagagcctgtgggacgtccgcctgttgcctcacctcctggtagcccagagggcatctcctattactgagaaattggccaagccatgggtttaatgcactcccccttctccattagtcttgtttatagctgccctcacagggtggtgaagaagccactggtagggtatagaggccttcggttctgggatgtaatgtttacatgcttttctcttggagttaggaaagtgctagaaaacagtgtcgcctctgggctggagccttgggacctggaggttgggtttccccaggtttcagagttcggctgggaatcaaggagaaaactgcctgtgagtttcagttaggcaggagctcctagcttgactcaggcgtgcagtgttttgtcattttatatatgtcatcgcttgctcttaggcctttcgctaatgttaatgttctatgtggagccgttttgtgaggaatggcttattttggttgagaggcatttggtaatgaaaagaaatgatgttttagtgcgtcgaagtttatgaaatgacatccacaggctgcatctcatttgattcttacgacaatcttgaaaaatggggaagataagaatgattattcatctcatttcagagatgagtatcttgaagcttgaaaaggtgaagtgacttacccgtagttagacaggtggtaaaccggagagaacaagactcaaaccaacccgctaacttgtttcagatttatgcaggcatatttgtctatcctaagtaatctagtgaaatttttgatctcaagcagggatccacagcttttttgcagtacttttttttctccacctttaaaacctggagatctcacataattccactttctcctggccacactgatcttgtaatttttcaaacacagcaagtctcaaggcccttctccttcctggcttctgctctgccctgccttaggtctgggtccatgttctctgcctcacttttccatccccttttccctaactcctccctcttcatccttatggtgtcagtacataggtcaggtcttcagtgaagcctcactctctccccgatatgaggttaggtcccctgtgtaacaacagtaattcaatcatcattcctggaattagttgtttaatgcgtgttttccctactatattcagagctatgaggcaggacctagaatcgtgttatttttctttcttttttattttttgagacagggtctagctctgtcgcccaggctggagtgcagtggcatgatcatagctcactgcggcctcgatctcttgggcacaagcgatcctcccacctcagactccctagtagctgggactacaggcatgcgccaccaggcccgtctagtttttgtattttttgtagagatggggttgtgtcatgttgtctaggctggtcttgaactcctgggctcgagggatccacccgccttggcctcccaaagtgctgggattgcagatgtgagtctgccattttactaacacctagtatagcatctggtatatagttagtgcttgataaatacttattgactgaacgcggtgaggggctattcatggtgaagctgcagagggcaagtctgtggtctggaaccatcctgaagagctgtgagaaatgactttgggctcacagggaaatcctcacgtagggcaagtcctggcttggggtgcgctctcttgagggggtatttgctgtgctcactctgactgtgtttcctgcacatggccgtgtgttttcaggcagtgagaaccaccacattgccttaaagtctgtctctgagcttaatctcatttgcaaaaggtggcatttcatttaattgttctctgagattctttctggctttgatattttcctcattttttttttgccaactggtaaattaaggggtgatattatgttcatgagaaagagagttttccacagtttctttttagtagggagcccctcccaaaacagcaaagcatattcgctcattgacaaagtgggttcaccaggacagagtggcacacagaggtaaacagtagataggttctcgctgccaaggatcaatcagaaagggaaataagctctctaaactgatattataaggcagtgagattatgattatcatccttttagcaaagagaaaggaaagggcatatgtgtatttttctctgtagaatggtcatggctccagtgaaggagatagtagtgaatgctaagttctagtccaaggttattctctccttgtttcctcatctggaaaatgggcagcctgaattcatcagcaaagtagttcaggagttctgtaggtgaagcatcttgagcaaactcaaaagtcaagtgagtgagctgagattccatgaactgggcctctcttccgggagtgctcgtaaactagatttcagctttccttctgaggtgagcagtccagggaggataataagcctgctaaatatagtgagaacacagtcttgaaaggggacagtgagaggcaatttgcatacctagcatttaagccatgcaaagggatggtttgggaaaaccttgttctccttggacctcaggaggctgtctttgacttcctcagtttcgtcatatagttcaggggagtgcctggctccttctgtcctcacagttgaaggacaggatatttgttttatgctatattgtagaattttaaaaacgcttctttgtatttcactgctagtgaagcagagaaatgaatcagactgccttatttgtcctccttgtactgcgttttgggaggaggctgtgtaggagttgtgaggactgcaagctgtgggagtctaggacatcctgatttttgggtttgaccaatttgaaagaggtgtagagagggtacctgtgacccattctattcagtggccccacctcctgcataagcctcaacaactatacagatttcggtggttttattggaaacttctcatcattggcttagacttgcaaccctaattcccccagaagtgctctgtgtgagctaacaggtaagaaatgattaaagagcctacagggtgcctggcacctagcagacctcagtgcctacttcatccgcaagtgaacgcatgagtaatcagtcccttcatccaagccattgacttcctcccctctatttataacaacccagaacttgaggactgggtggtagcaggtccttcccctcactctgaataataggaggtgaatcatttcacctctccgggttgccagggcacgcagggggctgagggacaacacttgtggggtgatatggacttgttcgatgaagatgccgaggcgagtcaaggtgtgggtggcatccactgttgtgagctggcggtggatgctagccttgggcctgcggctgtttctccagctggggacagggaggcctgtgcggatgctgtggctctgcagatgccgctgacagcactttgaaggattggtttggccagagacccagtccacagcctgcctcctgtatgactcattctagctgcatattttggtagcatgagggcttgagatgagataaaaggagcacttcttaagagtggaagctcctaggttcttgattagcacttgagaaatataatgttctctgcaggtcctagaggccttaaaaaaatttgagtatatttcacattacataaaattagccattttaaagtgaacagttcagtgaacttaatatcgccgcaatgttgtgctaccatgatttccaaaacatttccatcgctctgaaataaaaccccttacccattaagcagtgattccctcctctccaatctcccagcccctcgtaaccactaatcagctttctctccctatggatttacctattcgggacatttcatataaatggtgtcatgcaatcatgcaatatgtgaccttttgtatctggcttctttcacttagcatattgtttgtgaggttcagccacattgtagcatatatcatcagtatatcctagagttttaatgaccatcccaaatccccaaagacaagcccccccgccaaaaatggtacatctttctagctaccgtcatttagttccaactcctgccaggaggcaggggaatcaactagattcattgtttcccaaagaagctgcattagaaatacctggggttggggtgtgtctcctttttttttttttgagacggagtctcgctctgtcgcccaggctggagtgcagtggcatgatcttggcttactgcaacctctgcctcccagattcaagcaattctcctgcctcagcttcccgagtagctgggactacaggcacgtgccaccgtgcctggctaattttttgtatttttagtagagacggtttttcactgtgttagccaggttggtctccatctcctgacctcgtgatctgcctgccttggcctcccaaagtgctgggattacaggcatgaaccaccacgcccggctgggtgtgtcttttaaaaaagactgattcctgggctccaggcagagggcgacagagccggtaggcgtggagtggggcctcttaggtgattctgaccttcagtggggcatgggacccccctaggccaggtgatctttggggggtggggtgggaggagttatcttgactcttaacgacctgccaatgagccagatgctgtttgttgtttatgatgcagtttctgtgttcagaggtttctgtggcatgtaatttttctctgtttgccttctgaggggaggcactcggcccctccctgctgccttaacagctccaattaattgtgtctcatttatcaagctccagctatgccctgtgagctagacaggggagagggaaggttgttcacaccccggggttgtggttatagctgattgcacgtcaaggttatgttcctgggaaaaccaccctcccacccactcccaggccagtgtcttctgggtgtgggacctgtgtgggggattggcgatggaaaaaggcttggggaggaggaaaggggagatcagggggagatccttggggatggatggaaaaggaaccaaacaaaccggaagccactgattaagtaaagggatctagggacctgtgggttgttcttgattgctggggtctgccctgggctgctggtgtcttggccacatgccatggagagctagcaggaaaagcctgctttgttgacttcttttctttcccctgggggtgaggatgggggcaaggtggagacagaggagacaggtgaggccagagggtagaatgcatgtcttgataataaaatttacttcctgtcagcctgcctgctggctcccctgtcctgcgcgcatccattcctgattcctgcaactaggtctgctgtggggggatgggcacccgggctgccttggggatcagctgtgactcaccagggagttattcttatgaccaggatgtgcctgacatctcgccaagcaaaggagctgagctgttcctgcgagtgcctggtggccctcgtacaagtcatttcttgccagggattttatccccctactgggctgccccttttcagtctgctcttatgagtaaaagggacatctaataaaaaaagctttccttaaaaaaaagaagagaaagaaacaaagtaacaaacaaacaggtgttttaccaggcttgccttctagaggttttctttttttctttttttttttttttttgaggtggagtctcgctctgttgcccaggctggactgcagtggtacaatcttggctcactgcaagctccgcctcccgggttcacgccattctcctgcctcagcctgccgagtagctgggactacaggcacccgccaccacgcccggctaattttttgtatttttagtagagaccgggtttcaccgtgttagccaggatgggagtttttctttgtagaaaagcccttggatgttttgaggcttgcccttggtgctcttctcacctttcacctgccttgggattggtgaggaggtctcctgtcctctgagtagatcgatttcagcaagttatcttcagaccttttgcccactctgatcactgaaagctttgcaacctactcaaagcattatctgagtgttacctgccagagggagcattttgatgtcatctttgaggatgcccaagttgaatatttgaggactttttatcccagatcccaggggaacatgggtgattttttttttctaggttcctagtcctttattgtattgacatttgcatagttttctatccccactctggttcaagagtgcagatgttttgggaggggaggaaacttttagctgggattcccagggcacatgtgttgtgagtttctgatctccagatggatccaggggattgggctggagaggaggaaaagggaaggcttcagcgaccggaggagattcctttagctgctttctctttgtagcattctggattaaataatttatttacttctatttcttatttgcacttctctgttagtgcttgcctggacttctctatctgggaatgaggagagacattttggaaggacacatattcctaggtccttttctttaaagtaaggtcgcctttcaaatgtttttcaaaaagagtttgatcctggatcaaattaaatgcaggtatttaaaactccaagtaacgtcgttaaggattagctgctttgtccttctgccagccaaatatgtggcacaggtgtttctcttttccctgatgacatctgagagcacctcaaggagtgggtggggaaagttcgagtgtgctggggggaggaagcgagagaaggagaaaggagctgtgggttttctgccgcagagccttgatgagaagacagctcggagggcaggttggcccaggcttgaactgtcatcagtctaggcttactcgtgggtggggtggactgtgcgggctggagtcccagaagcttgatttccttccacgtgtgcctcagacagctgaggttgaggaggctggtggaataggcttctctcagacatcgctcagcaagagaggcagcctgtgatcctggtttcatggcattgtcctgcttctgagtgttggaccacctctcagaattttttttttgagactgagtcttgctctgtcgcccagattggagtgtggtagctcaaccttggctcactgcaacctctgcctcctgagctcaagcgattcttctgcctcagcctcccgagtagctgggactacaggtgcatgccaccatgcctggctactttttgtatttttagtagagatggggtttcaccgtattggccaggcgggtcttgaactcctgacctcaggtgatctgcccgccttggcctcccaaagtgctgggattacagtcgtgggccaccgagcctgaccagctctcagaatttttgttattcctgtcatgactttgctttccacagagtgggtggaatgtatggttcaggtgttcaaatgccagtcctcagacaggtgtccatcagccaacagtgaaataagaaaataaaagtaatgtagttttccatacagtgaaacaatggttctttattctgagatgatatgcttcctcagttttcagtgttaacacatctttgaaaaaatgacaatgactctagatagtggtcatattgccctgtaaggtgagctgcgtaacagacaaatcccaaaggctcagcgtgtggctgagttgaggctccgggttatgagaagttcaggatgagtgctactggttagcggaggtcttttccatggggatgcagcctccttccgtcttcggctctgccctcctctggggctttggagtcctctgaatgcggcctgcggatggggaaagaaaagaggactgcatgggggccaggccgatagtggccctgatgacttctctcacattacacctgctggaactcagtcccaggccacaccttctgccccacagcctggaccagagtctgcggtgtcctcaggaagcagaggaaagagattgagagagtagctagtcctgtttttgtgatgtccttacttggcagaatagaagttgccaaccagtcctctgttggccttcctcatttttattttatcggtttaccaaatctaaaagtctgagaactaaaatatttccttatttgagacctttcaaaaataattttgaaaagcttcacaatgatacttctctcatttctcattaccagctgaaagtgaatgacagtaccaccaagccagaaaaaacatagttggaacagaagtttgaaaagcatgtgatctttctggcctatgaattttttttgaacaagggcaatgtttccatgctttggtttaaaatcttaccagtgcatgtcatacatagagtaaggatcagagtaaccagagattggtatcataaaggatgaaaataatcaaaggaattggttatgccaatgagagcccaagaagcttttctacaatctctttacatccaaaatagcaggggactcatttctttgtggggaagttgagtgtgacagaatatgcatgaggtgggaggggaagaggccaccttggcccaaatgctttagatggcagaatcttcatcatttctgcttgacaaaggaggaaagagtcttgatttagaatgtgtgtggccatcacttatcgtgggtcctaattcctacattgatctctttcaggttagtctgaatgattcccacaatcagatggtggtgcactgggctggagagaaaagcaacgtgatcgtggccttggcccgagatagcctggcattggcgaggcccaagagcagtgatgtaagtgttgtgttggctctgggcacaccttggtgccatcaacatgcccttttctggtccactgggattatcatactggaaaaagtagtgggtaattggaacatggaatggatgaattgtatgacagggaagataatctagaaaatgatatatcccttgtttgctgaacacagggaggtgcagtcagtgttgcaaacagatccatgcaatgtgtgattacctttgggaagtaatagcatatggactggattgttgcatctgcccaagaaaataccagagtgccttcctgggcagagctgcctgcctgcagctgagcccgatggaatcaaattggcctttcccatatgctggtttcttctaacccattatagtgggatgagctgttgaaactgattctctaatattcttaatttctatagctgggtatttgtgatctttagtaggtgaggtactttgaagactcaagatgccaagggttataaactcaaaggcctgtgggaggccgggcaggtaaaggacaggagtgaagccaccttcaagtttataacactcttttctattttttttttgagttggggtctggctctgttacccaggttggggtacagtggtgtgatcttggctcactgcaacctccgcctcctgggctcaagccatcctcccacccactcagcctccagagtagcaggaactacaggtgcacaccagcatggctggctaatttttgtgcttatatatattttttggtagagatggggttttgccacgttgcctaggctggtctcgaacccctgggctcaaacaatccgcctgcctcggcctcccaaagtgttgagactacaggcttgagccaccacacctggccattacaacactctacctcctcagagaaatatggtttctcccatttttcttgaagtctgtggccttgttggacaatatatgtcatttccacttttgatggagatgcacattcaagaaacattctcccatatcttaatttgaacatactaatggatacttggttcctgtgttggagagacgtggggaaggggaagggcctttggggaccgggagaagcatgcttccgaggagcattgactgtcagctccaggctctggttgccgtgcaggatgctgggcccagtgttgccacatcttctggttttccagaggaacccagaggtctggagtttcatgtgaaaactgctgagtcttacaagttggcagccagtgtatagtttttacagacaccgcgtgagccaggtaaaacacatgtaagggccaaagctcgcccaacggctggtcccaggtctgcggcctgtgctctggactcctccttgtgggtgagaggagcagcccctgcctcagcctggggtctgacactgtggcagcgcgaggctgcagacggaacaccatgctttacagcttcggtcaccctgcattctggccgggggaaccttctgatgaatttgccagcactttcacactagccttaaggatacatttataattcttgaatgcggatttggtctctgtgaggtccctctctgtatatccactgtctgggttgggtgtgttgagaagcaggtgttgggaagttgtctcagggactgtttccagggagttgaattagggcagccacagaagggaagacagaagggctggctgtcaggatgcatgactttgcccggggtgggttctgagccatgctgtgtgggagaccaccgctactgatggccagtctgggtgtagtgctctggggcagggctagacttgtttggggcaatgactttggcccatttataaatatgatcaggttttgcaagtaaaagctgtggccaccacagacagctgtgtctgaatgcctttggtggccgggtgtggtggcctgctcccatagccccagctactcagcaggctaaggcaggaggatcccttgagccaaggagttcaaggctgcggtgacctatcttcgtgctactgtacttcagcctgagtgacagtgagaccctctctctagaaaaaataaaacaaaaaatagaaaagaatgcctttggccctgtgagactcttcatagacacctgtgtgtagtccctgcccatgggcatatccctcctgggcacaggagatatatatactgtgctatactgtgttgagaaatccttcttggaatttttatgcgtttaaaaaaactcttaatccagacaacattttttgtgaggtagataaagaccttaagcattgttttatagttttgctggacaaacaggagccaagaggtgtaaagagacttgcatgaggtcactcagcatgtcagtgggaaggtcggggctgatgagaatcaaggcccaatcatgtactcagtgtgcgaagatgtggtattagggtgaccaacttgtctaggttttagcactaaaagccccacatcctgggatcctcccttaattctgagtgaaccagggtggtttgtcaccctaagtattgccagtctattgaaacccaactcttgctctctctgtatatttgggtgtgtctaactaagagcccattgaacatgtgaagtgggatacactattgtggaatgaaatgggagatagagccgaggtgggcagatcacctgaggtcgggagtttgagaccagcctgaccaacatggagaaaccccatttgtactaaaaatgcaaaattagctgggtgtggtggtgggtgcctgtaattccagctactcgggaggctgaggcaagagaatcgcttgaacccgggaggtggaggttgcgatgagctgagatcatgccattgcactccagcctgagcaacaagagagaaaactctgtctcaaaaaagaaaaaaaaaaaggagatagattaaatgggaaggaaacgcaatggccagggttaataaatagggatggcagaaatggccttcctctctatacaaactgtgttaaaggattggcagatgcaagtgagatgcctgatgtaaaaagttaatgtgaaaagaaatgatgactcagaggcagtagttggggtaataacaatccaaattctctttaaagaagactgagcatggtttgtaaggtcccatcagcagtccagaagggaaagaacctaaacaaatcaggaactgtgtgggtgttggtgagcggccaaagtcatgcatattcagtatctaaaaagggatggctctggaagctggaatccagaaagtcttgctctcaaacggggaaaaaatgaatcatttatccactgatgaagttgaagccagtgtgattccatgaagagaacggctcctgcaggactcatctgtcctgtgataaatcaacaaaagaattaatagatgtttatctcaccttttcctaactctttgtttctgctctctcatgatgtattttacaaagtactaggtttacaaagtgctcaggtgcaacataattggctgaagagctgtccaggggtacagtccaccagaagatcagaatcaaccaggggctgggtgaggagtggctcatgcctgtaatcctagcacttcggaaggccgaggcgggtggatcatttgaggccaggagttcaagaccagcccggccaacatggtgaaaccctgtctctactaaaaatataaaaattagccaggcgtggtggcacaagcctgtaatcccagctactcagaaggccaaggcaggagaatcacttgaatccgggaggcggaggttgcagtgagttgtgatcgtgccactgcactccaggctgggtgacagagtgagaccctgtctcaaaaaaaaaaagaaaaaaagaaaagaatcaaccagggaagatactgtgcaggataggactttctgcttttgtccctagagcagtgtgacatcatgattgtacccctcaggactgactggggagcagtgtcagttcttgctaacagagggaggccgatgtctggctgagcacaggctctgaaatcagaacacctgggctggaatcccggatgtgccattcattagcaatctgaccttgggccaggtgatgtaccttctcttgtcctcctctgtcactgacatagtgcttgttaaaccttgctacccaaagtgtggttgtggtctgtggatcagcccttggggattttctgggagctggttagaaaagaatctcaggtcccatccggacttcttgaatcagaacctgcacttgaccagtgtcttgccggggccagggggcaggtagggggcggagagggggcagtctgtgggcatattacagtttgagaacattgctgtaaagtacttagaacagtgccagatatggggatgttttctgtacattttagctgtcatctgtttctcccctttctctccctcctctttattattacgtagttttgaggtacaagggaaagaattaaaaatcactcactttcaaggaccatctttgtaggtaaaaaaggatctaaccagaaaccgtgggcagttcagtaactcctcccctgtgctattttgctttttagggagtagcatcatattgaggtcagaggggactatttagtgcagaaatcccgtctggatgaaaaaccaactaggagcacaagatgagtgagtccggggtgttctctcaaattcacctggagatggtattggactgtgagtcagcagcatggtgctgccatgaagaaaagacagctagaaaggaaagcgcaagtcggggtggagccaccaatccgcttgagctaactgcacactggcagaggccttttctgggctgttcaatgtgggggaagatagataactgtgcaccagctttaagcattgtccttgttctatggagcttatagtctatgctaattaagtagaaataagaattaaggactgggtgcggaggctcatgcttgtaatcctagcactttggaaagctgacgtgcgtagattgcttgagcttaggagttggagaccagcctaggaaaccccatctctaaaaaaaatacaaaaatttagctgggcatggtggcgcctgcctgtaatcccagctactcaggaggctgaggtgggaggatcgcttgaacctgggaagattgcttgaccccgggaggtcaaggctgcagtgagctgtgcttgtgccactgtgctccagcctgagtcatagagcaagagcctgtctcgtcagaaaaaagagaaagaaataacaattatgaaggtaggataaaaatgtcatgttggaatttttcaacctggccaagggaaggaaagttgatgagtggttcatgatggccttcaggcataggacggactcttacatacttgcttttcacttctgttaagtagaagacccaaagagatggattttgtttgtaggtgagaattagggaagagctctttgatagtgaaggtggttttacctccatgtgcacgatggcagcggcatggctgagaatctcaggaaggctttctacttggttaatgtgggtcttttctctctgcgggccagcactccttccagtgcttggcctgtagacttggtataagaccttcctacttagcagagaaacgttaagatggagaagagaacattctcctagaggtaacttgttggagtagagagacaactggacgtggaattggaggaaactgtcatagttttgtctcttactagcggtatgacccggagctagccattcacttctgggaatcttagtttttgtttatctcttaaatggaaatctcttagtgactcactgattcattcaattcattcttttctattcatttatttatcacatttgtttatttgctctttggtttataatgatatttattcatcctagaaatctttgttgagcacctgctatgccccaggtacactgaaagagacaaaggtgagactaactccggtttttcagatgaagagagagaatgtttgtaaaggagtattacatactgaaaaatgctaccttaatgtaaactatcacctttgtgcccctgaagatatacgtggggggttatcaaattatgggatgtcagagctggaagggactttagtttccttcctgagaagccattattttgctccatgtgatgtttgaacctaaccgggacactaatgtccattcttggccggcagaatagaagtgagaaagtgctacttcgtcattttacccactcagattatctgtgaactctcagcctgcacaatttctgaagctgcttttgtggcagctccttactgtgtatctggtagttgggaacacatactgtgtgttccaatagcttcttcaactgtgactcagataaaggcagaggctctgtcttggcctcttctaaccttaacatctagtaagtattaaagacgtgcatgtgctctctgttccctttctacataccttgtgtttacatagggcattgtttgcagacatttacatgtttacatgcccatcgtgtctaaagactatgtcttttattagtctttgtctgtctggtgtctagacaatacctggctcacatggaaccctcaaaacatgtttgctgatgactcagacaagcaaggattggaatacaccctgctccactttgaattcacctgcccttccttccctccctcccttcctccctctctccctcccttctcctccctcccttcccttccctccctcccacgcttcctccctccctccctccctcccttccttcctcccttcctccctcccttccttccttcctcgctctgtcacccaggctggagtacaatggtgtgatcatggctcactgcagccggaaactcctgggcttaagtgatcttcacacctcagcttcccaactaactgagactacaggctcaaaccaccaagccaggctcatttttatattttctgtagatatagggtctcactctgttgcccaggctggtctcaaactcctggcctcaagccatcctctcacctcagtctcctaaagtgttggggttacaggcgtgagccactgctcctggcctcatttttctttaatgctcatcctaatccccttttccatgaatcatttgaaaaataactaagttattttaatatattcacctatcaggcttgtttttaaccccgtgattatattaattatttcacatctcacaggtaggtacatctcacagtattgtcacgtcactcagcaatctttcatttccatcttgggctacgtggtggagacccatgagagttttcttctcttttgtatggaatgctgtacaaacagaacttcccagaagaagaatgaagaattagatacgttttgggcaccattcaacagatggcaaaacaaatcctccgttccattcccctcagctagccacattctcccccttctggatgtaatttgttaaacactgaactcagccccggtgaggaggttattactgtttctatcatttgtctcctgctccagggacttgccttggcctcagaaaagaggcttgtgtattccaggcagtggggactgcaggggtcccatgctttctgcccccacatgcttggggacagacatagaggtgccctgcctcacctttgtgtgttatctggtaacatctgtcatttcctatcaggcacctaatgggagccacgttcaggatccaggatgggatgtttgaaagagatctttctgcttgggctcggtggctcatgcctgtaatcccagcactttgggaggccaaggcaggcggatcacaaggtcaagagattgagaccatcctggccaacatggtgaaaccctgtctctgctaaaaatacaaaaaaaaattagctgggcgtggtggcaggtgcctgtaatcccagctacttgggaggctgaggcaagagaatcgcttgaacccgggaggcagaggttgcagtgagctgagatcgcaccatggcactgcagcccgggcaaaaagagtgaaactcagtctcaaaaaaaaaaaaaaaaaaaagaaagatctttctgccagtttctcaccaactctttctttttcatctccttttctctgtattccaggtgtacgtgtcttacgactatggaaaatcattcaagaaaatttcagacaagttaaactttggcttgggaaataggagtgaagctgttatcgcccagttctaccacagccctgcggacaacaagcgggtaaggaagtggccatccctcctgtcccgacttcatgggactgggttttggaaagattgccgcacttaagggggtgctaggagatggcgctctctgtgatctttgtagcatgactggtggctagtgagtttttgtgctaacctgggcatttgtgacagactgctgttctcagggttggtctctgcacaatcaggcaggccaaggactggtcaggcaggatttctagacaaacaatgacaggttaaaccacagaaaatcagccaactcttgtaataccttgcccgacttgcagatggcaaaaatgtttcccaggtacactgagaataaccttgcaatcaaattcatgttttctaggatactatcagtgtgtctgcttgcgtgcttatgcgtgcttgtatgcgtgtgtgtgcatgtacgtgcttgtgtgcgtgtgagtacctgtgtgcgtgtgggtacctgtgtgtgtgtgcttgtgtgcatgtgggtaactgtgtgtgtgcttgtgtgcgtgtgagtacttgtgtggatgtgcatgcttgtgtgcgcgtgagtacctttgtgtgtgtgcttgtgtgcgtgtagttacttgtgtgcgtatgggtacctgcgtgtgtgtgcttatgcacatatgggtacctgtgtgtgtgcttgtgtgtgtgtgcagatacctgtgtgcatgcattggtacccacgtgcgtgtgtgggtacctgcgtgcgtgcgcatgcttgtgtgcacgtgggtacccacgtgcgtgcgcatgcttgtgtgcacgtgggtacctgcgtgcgtgtgttggtgcaaccctctgtcccccggcctctgaacctgtaccgatatggaaaagaaaaccaaggcagcagatattgctatgcctcctgctttgttttcccagctggctggccctgggggctttgtttcttcagttaggcaatttgatttgaggaagcgttgaccctgggcccccagggaggtggaggcgggagggcaggaaccgggcagccggcaaggctttcctgccagttgggtagctcttagctcggagagttgtatttcgttgctttcttccccactcttgtgttaccgtgtttgtttccaggccagatcttctacggaaagacccttagtagaaaaactaagagaaacattctagtagcaaaagctttctgctccagaaaggaacaagcaagcaagatctacagggtcctctttccagtccctagtcctggcttctcaggttgcttgaggtctcctagcaggggctgcattcaaaatatttagcgactggtgtggcttgggcactgaccaatcagaacaaatcctgtctggaggaggctgggtcctggacgtcccctgctgggccatgcattaacttttgagttgctgaatttcagggagatcctggggaagggaccacgccatgggaagtgttgtggggtaggcttaggaagggccacttaagggtttcagggcagcggctgttgaccaggtggtacagagcagttgttttttaacaactggaatggtcattactggtacatacttgttaaaatatcagctctgcctgatgatctcagagtggagtggcagttaggagcaaacttccctttcttacctaactccagggtgacagagtaatttttccccctgagatgaaaagcaaggagaaggtgttggagggaattggccccatagacgggtcagccagcctttgtgcccctttgccccaccgcacagtgtggtccccaggactcccagagaggggtgggccccgctgcttgccttgcctttggctcctccgtgaggtgaggagccctgaccagggtccagctcatagctgcctcttctgtggatggatccatatgcgccccgcctctcaagaatcaaattacacctgctgatgtgttgtatgcttggaaatgcagagtggattttgtgttctcacacaaaaataactatgagagggaaagcatttgttaattagccagatttaaccattaaacaatgtatgtatgtttttaaacattatgttctacatgataaatacatataatagtatgtctatttaaataattaaatttgaaaaaaactaatcaaatattatcataagtaatgataaaaaccacaatttcttttgcagcaaactaataacacctggatttctcaatttattaagttgtacttacctgatgctgatgatgattactgtatttacacattgtctcagagctcactcttgcggaggttgtggcctcgaaaatgccttgttgtccctctggaatctgtcttttcagcttcatctcctcctcctcacctcctgctgtggtgcacagatacctataggcaggctccatctcctcctccccagctcctcccctagtgcacagatacctataggcaggcttcatctcctcctccccagcttctcccctagtgcacagatacctataggcaggctccatctcctcctccccagctcctcccctagtgcacagatacctataggcaagctccatctcctcctccccagctcctcccctagtgcacagatacctataggcaagctccatctcctcctccccagctcctcccctagtgcacagatacctataggcaggctccatctcttcttccccagcttcttccgtagtgcacagatacctataggcaggcttcatctcctcctccccagctcctcccctagtgcacagatacctataggcaagctccatctcctcctccccagctcctcccctagtacacagatacctataggcaggcttcatctcctcctccccagctcctcccctagtgcacagatacctataggcaggcttcatctcctcctccccagctcctcccctagtacacagatacctgtaggcagactccatctcttcttccccagcttcttccgtagtgcacagatacctataggcaggctccatctcctcctccccagctcctctcctagtgcacagatacctataggcaagctccatctcctcctccccagctcctcccctagtgcacagatacctataggcaggctccatctcctcctccccagctcctcccctagtgcacagatacctataagcaagctccatctcctcctccccagcttcttccatagtgcacagatacctataggcaggctccatctcctcctccccagctcctctcctagtgcacagatacctataggcaggcttcatctcctcctccccagctcctcccctagtgcacagatacctataggcaggcttcatctcctcctccccagctccttccctagtgcacagatacctataggcaggcttcatctcctcctccccagctcctcccctagtgcacagatacctataggcaggcttcatctccccagctcctcccctagtgcacagatacctataggcaggttccatctcctcctccccagctcctcccctagtgcacagatacctataggcaggcttcatctcctcctccccagctcctcccctagtgcacagatgtctataggcaggctccatctcctcctccccagctcctcccctagtgcacagatacctataggcaggcttcatctcctcctccccagctcctcccctagtacacagatacctataggcaggcttcatctcctcctccccagctcctcccctagtgcacagatacctataggcaggcttcatctcctcctcccgagctcctcccctagtgcacagatacctataggcaggctccatctcttcttccccagcttcttccatagtacacagatgcctataggtgggttctgacttcctttctgcttgttgtgggttgtggtgaacaactgctaaggccacaagtctgaagagtcagaagacaggacagatgatgttttggacttgaaggaggagggttagtgcaggcagaggactggggctttggaagcactggatctggagaaggagcagagcaggggccgtggtgtttggggcaagagcaaggggaaactggagggtgattccagtaagggagtttaggtgctgcactgtggaatgggggtgacatgtttgcatcccaagtgctgtgtacctccgagtggtgtgtcttagattctcatgggtggatattctttggagttggtggggttggagaagtcaggagaaaaaaggctgccttcttggagaatttgttgacagttgggcctcaggcctggaacaggctgagtgggttggtgggggcagcattctctgtagatagtttctaattccccagagaaggctgctcctcaccaccccaccagactctcaggaaggaaatgatgactcttaacagtgctgattgcttctgttacttttgcctttgtcccctggaaggcaaattgccccaccagacctaccacttcctgagaaaaatcacacaaggctggatgccttgctgtcaacagcagggcgctctgcctaggcaaatcacccaggtgaaaatgcgagctgccaaggagcatttgaaatggtcgaaatgaatgttagcagctgcttggaaaggttaagatgtcaggaaagggcagcgtggatgtctaggagcatgagtgcctgtggaaggggagagaaggtgctagcgcggcatccagttccagtccgaaggctttgccttgtgatggagatggtgcttgtgggcccatgtgagttttgggtctatttctgcattagccagcagtcccacttccttcttggtctcctgtgtgctgccctgaaccattgtgcagtgctggccacatggcagttctgccaacattgtggggcccctgagattggtcagacagaattgaaatatgtttggcgctgttatttgcttacttaataatttttaaaaaatagagacaggggtcttgctctgccatacatcctgggcacaatcatagctcactgtaacctcaaattcctgggctcaggtattccttctgtctcagccttccaagtagctgtgactacgggccagcgccactgcatatctggggctttttaaaaaaggacactgaatgtacagttaggcctcacagcctcagcctcagcagaagcaagacccagtcctgcctttttccaggcagaggttggtcctaggtaaaatttcattcccaccttctagagggatgttccttcattgccttctctgcccttcctcctctcattgtactcttggtttctccacttgaaactggagaaagtcacttatgctaatagactgtggatacattctatagcttagtttgttttctttccagaggtatttgtattttcagaggaaacagcttttaaccaaaggaggaagctcctctggaatattaagttactgcaaacagggttggagagattggggtacacaaaggcactcctgaaattgcatagtttgggaagcaccttgtaggtcagctcttggtcagtctgtaggtttggcctccagtaaacttgacagccaggcagcacagagacttaaaagccagggtgaaatactgtgtcttcctaacatgtacatatctgaccctttgtatcacagcatgaggtaccatgtgctcaagtgatgaatgtaacctacaaataatagagctaggggaatcaaatgaggttggatcatagaagccaagtcttcatggggtacttaggatttgatatgagcttcaaggatggacatgtgaccccagtaagtagaggagagctgtcaggagccctcaagcaggagaagggcgtcagcagagactgcaaagtgccaaaatgtggtttctgtgcaggacagcgaggagattcactttttggtggtggagagcttgtattgagctgctgtgcaatgtcaaacaggcccgtgtctgaagatggagattgtcttctgctttgagggctgaacagagctaggaaagaatatttgagtaggggtgtaaatgaatagtgtcctttagggaaatgtgtcttctggcaatattcttgactttcccttttagcagggaaagattagggaagagtctagaaagggaactattgtggcagtgtaggcatgaagttgctcaatcaaacctggtatcaccctctaagtatttcatttaggccctggaagacatgaggatgaagaagacccattgcctgcctccagtttgtttagtctctagtgaagacgtgggccatgccaatagcactgagaggaaaaaggaaggcacatattttgagaaagattttaaaggaaaacaaaacaggtttggtggctgatagagagtgagggccaaagggaaggactggagtaaaaacccatctctgcttgtgagtagtggggctgggagaaggcatagcaggcaggagacttgggacgtggggagggagaattgggttttgttgggaaagttttgaagaactcaagttttgcgtatagtaaaatatcttggcccatcaaaagtggagatggtgagaaggtaaacaaaaatggaatctctgtaagaattgagggttagactgtagatttgaaagtcatgccatgcttcttcttttgtttttgagacagggtctcacttcatcacccaggctggagtgcagtggtgtgatgtcggctcattgcaacctctgtctcccaggttcaagcgattcttgcacctcagcctcctgagtagctggaattataggtgcacaccaccatgcccagctaattttttgtatttttagtagagatggggttttgccatgttggccaggctggtctcgaacccctgacctgaagtgatctgcccaccttggcctcccaaagtggtgggattacaggcatgagccaccccgcccggccccatgcttgttcttaagggcggtggttgaagctttgtgaaaggataagccaaagttagcagcaaaggatggaagaagaatgaggttatatgagcgtagggagtggggaggaccaaggagccagcagaggagaatcaaggcttgagatgatcaggggctggggatggagaggtgaaatgagagggtgctgtggattaggagagaaggcacacaaatgagttaaatggtacaaggtaagacctatgaatgaagttcaggaaatgttgccgttttgttaaaagagctgttaaggggtgagatgtgaacatgtgaaccagtcagatattgacgtcaatgctgcctagtcctgcgtcaccttgggcagtaaactactctcagtctcagtgtcctcattattaaaagagtgtataacggtaatatccaaagcattgagtcactgtgaaccctgaatgagatagggcatgccaaacttttagctcagtgcctggcatataggaagtgctcttgaaaacgtttagctattaccatggacaataatacattctatgacggggtgcgtgatttttggattctccaatgtgagactgcaggaagccatggaacagatttctggggaaatcttttcaaattgaggatgcttccttccccaataacctaggtggtttgggagcaggaagatggactatgttatttctggggaatacttttatgccagaaattatgatgatcctcttaggatcataattgttttttataacattgcattttattgtagtttttgctttcaaaacatttactaccttttccagtttgatttaatgaggcttctgcagagtttagagatttacctgagatgctggggaggaaacgtgagagagcgaatccacaaaatatgtccctgggaagtttatggtctggatttggggagagagtgcaaatgaaaaggagtgagcacatctgaaagcagcatgagacaagtgcaaagtgctggtccacaccgaggctgtggcactgaaaggtttcagagctggagattgatctgggtcaggtggagtccattcgagaaagtgtccttgggcttatcctgcaggattgcttgacttctaggatgtcaatgactggctgtgggtagaactaggtccctgttgctctggtttctgattcataatctcctgagccttcctcattcttccaggagcagggaccggcctccgggtcttgccaggtgtgcatgcgaggccttacatcatctgtgcttcccagccttgttttctggttatttctctcaggccctcaagactgtcactgggtgcagtggctcatgcctgtaatcccaccactttaggaggccgaggcagcctgatggcttgagctcaggagtttgagaccagcctgggcaacatggtgagactctgtttctttctttctttttttttttttttttgagacggagtctcactctgtcgcccaggctggagtgtagtggcacgctcttggctcactgcaagctccgcctcctgggttcacgccattctcctgcctcagcctcccgagtagctgggattacaggcccccaccaccatgcccggctaatttttcgtatttttagtagagatgggttttcaccctgttagccaggatggtctcgatctcctgacctcgtgatccccccgcctcagcctcccaaagtgctgggattacagccgcgagccactgcgcccggcggtgagactctgtttctacaaaaaatacaaaaacttagctggttgtgatggcacacacctgtagtcccaactacctgggaggctgaggtgggatgacctcctgagcccggggaggtcaaggctgcactgagccatgattgtgccactgcactccagcctgggcaacagagcgagaccttgtctcaaataaacaagactctcatcaaacccatgctatatctcttttccccctttgtgcccaaacccacactgccctagacgtggaatattctttccctgtgggagtctcacctgccctgcgaggcccacctcttccatggaatcatttctcatctctcagcctggagaggcactcataggactctggtcatggcttctcattcagcctcactttctcttgactgatggttagccctggacatgtctgtctcccatgttagattttgagctacttgagggaaggcatcttgggtttttgtggcagctcctgagcgtctggtccgtggtgggaatgcagcacacatgtgttaggttgaattgcctggatccttctccccagggaattctttcagccgcagccactatccagcctaaattgttcagattcactcatccacacagaagctaagtaggatgaggcccgtgctcaccagagctacttactgctctgccccagagtgagcctgccagccacagtggcagcctggtccccagagctgccgatcacctggcatagcagcacgaaggagaagcttatcttcttagatggaagtgattttagtgcttttcctggaaagccatgtcccatagctgcttggaggatgcagggagactcaaccatcccatctgtgttagccaatctgaaaagtagggcgtctgtgtcccagatgccagtaactaccctctggttgtgactgagtgacccactagggagtgggaattgctaatttcattgaaaggaaacaacagaaaggcccacttcattacctggttaaacaagcccaccttgtagcttcatcccggtccatctccaggcctcctttcgctgagccttgtttggagtatgccagtgtctttttattgccaagagatggggagaaagccattgtggaagccctgtaaggctgtggtgccttgttggtgccagctggcccctgcacatgtgtgtactcgtgtggactcgcacatggtttaggggagtgttgggcagctctggacagggcctgctctcaacttacctgttttcccttgcagtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcaggtaagagggctttcagaacccagttgcatggggctcctctagttttctcctctgcctgtgtggattgtgtgtcctttgagtgacctcgcctcctgcctctccctccttctctcttgggcctagcctttgtagctactatttcacttaccagggctcaagaaaaatatctcctcctggcactctcagttggcagcccagccagccatcagcacccagcacttggcaggccctgtgagttaaacatcatgcccttctccatgcagttgcacctttgttagcccttggggtaaatcgaggctctggaatttaatcagagagagagccaggtggagaaagctggaatctgagctcttcagggaccttttgttgaatttctgttctgctttctccatcctccatcttaaacactgcttttgcctcccatttatttgaagttaccactaacagtaatagtcttccttcgagtgcgtgcgtgtgtatcatataaatgtgtgtattttcctccttcaacccaggtttgaaggaaatctgagagatgaggaaagagcctgagtaagacttatatctcaaggttgaagcttgccaagtcaaggatattagtttggcaaaaatctgtgaaacttgtagatcctgtatgattggatttacagtgagccttgaatgtttttgctcagagaaaccttggaacgtttttttgcaggttgtttaaccaaaacacagatctgtttacctttgcttgccttagggagtaacctaagtatgggctgggtcagtttaccagcggagggggaattattgttactttgggtctcctgcttcttaatacatggttgctagggccggaggaaccctcagattccatctgtggaagttgaggggctttggcaaagatcagcaggttaattcctcattgccacagccgtgtattcagttggttctctgtggggctctgtacttagctggtgtcctctgcattcatctttaattatcagggcccattactgttgttttcttcctcttttttgtgcgtgttaaaatactcataacgtacaatttgctgttttgacccttttaagcatgcagtgtagtgatattgagtatattcatattgttttgcagccatcaccaccatccatctctagaacacttttcatcttgcaagactgaaacgctacacccatgaaataatacctctctgcccccagcccctggcaaccaccattctactttctgtctctatgcttttgcctactctaggtacctcctaagtggaattaatactatttgtcactttgtgatggacttatttcacttagcagaatgtccttaagattaatccatattgtagcatgtgtcaatttttttctttttaaggctgaataatattccattgtatgcatagaccacattttgcttatttgcttatccctcatggacacttggattgcttccacattttagctgttgtgaataatgctgctatctgtgaaaggtttttaaggacactgtttcttcgttgaaaagtgctgagtataatcatcctttggtttttaccattacctagaggctagtcttgagtgaaatataatttttggtaatccataaatggaaggcaagtcctactcatttttccttccagttgctattgagagaacacataggtacacagttgtctttcctttcttgcccttgtttgcttttggagcaactgagctggctttggcagtctcagtgcctgccttcacagacagcgtgtcatggaaggtgggatttcagcgggtgtttgatggtgatgccattcaggttgtattatacatgcctcttgcatcatgaccacttgtctttgcagctgtggaagtcagatgactttggccagacctggatcatgattcaggaacatgtcaagtccttttcttggtaagttgtgtcatctaagaaatcttgatatatgtaacctcctttctccagttctagctccttcttggtggacaaactgccctcccctgaaatgtccagcatttattcaggaaatacatttttccagatctgagaattagagctgcaagtacaatgatctcactgtgggagagagttggggggaggagaaagtaaggtatttatgagaggagtggtagagcttttgcatttttcaatcaatcagggaacccaggggaatcttgaggcccttgcatgtttgtagagtttcatttttagagcatcatattagaagtgggagtttttctctatataaaattcatgcatttcgctgggtgcagtggctcacgcctgtaatcccagcactttgggaggctgaggtgggcagatcacctgagctcgggagttcaagaccagcctggccaacatggtcaaaccctgtctctactaaaaatacaaaaattagctgagcatggtggtatgtgcctataaatcccagctacttgggaggctgaggcaagaaaactgcttcaacctgggaggcagaggttgcagtgagccgagatcgcatcactgcactgcagcctgggcgatacagtgagactctgtctcaaaaaaaaaaaaaaaaaaaattcctgcatttgttcataacattttcttgaatgtctgttaaatataaaacctactagattcttaagggtataagaaattgaataatttatggatatagttattaaggagaggtaaggaaagacatttcaggtacgtaacacacattgtgaaagaggcacagaggtaacagacatagtatgagaagctagagagaggatttatccttccagatgggaggatcataaacagctgtgtagaggaggtggcccttgatccaggatgtgcacaacaggtaggatgtccctgtgtggaggtgtggaggacaggaattccaggcagaggaacaaagtgacttgccaaaggcacagggatgcgccaatgtggtgcttgggtagagaacatgaactcttaattttggacagtgtattgggtgaagttttgaaagggaagttggtattagaatctgcatcgcttgataaaggaatttgggctacattctgaaagcaatgaggtacccctgtagttttgtgagaagaggagtgaaataaacaggctgtacttcaagaagtacttctagaagtaaatagtaatatacttatcgtaatttactattacagtgataaagtagtataggatcttgaattatatgaatttgtacatgtgcaggcaaatgtgtaggacagatttctaggagtgggtatgctgggtcagtgggtttatctaacagctatccattcactcacatggatgactgatagatattgcaaacttgacccctcgcaaattgactcttgatcttcaccaccccaaatcagctccacctataacttttctcatttgctcaggccaaaatctttggagtcatcgttgatttcacatttgttttatgctttacattcattctatcaggaaatcctattggcttcaccttcagtatatatctagaatcttctactcaggtaccacttctagtgccagcctccagtgtcattgctcattagtctcccaactagtctttctgcgtttactcttgtttttctatcattaattctcagcatgtggtcagtttgagtctattcaaataaattagatcattttgttcctctgctttgaaccctttaatgcttcatcatttctctcagattaaatgtcagataccttcttaccacagggaacaggatatttgcaattgctgttttctctgcctaaaatgctgttaccaaagatatacttactgcttactcccttacctcattccagtctttgctcaaataacatcttctaaatgaagcccacctcatttatgcccaccttaggatcctatttaaaattgcacctggccaagtgcggtggctcatgcctgtaatcccagcaccttgggaggccgaggtgggtggaccatctgaggtcaggagttcgagaccagcctggccaacatgatgaaaccccatctccactaaaaacacaaaaagtagctgggcatggtggcgggtgcctgtagtcccagctactcgggaggctgaggcaggagaatcgcttgaacccggtaggtggaggttgcagtgagctgagattgcgtcactgcactccagcctgtgcgacagaccaagacactgtctcaataaataaataaataaataataactgtctcaatgaatgaatgaatgaatgaataaaaataaaattgcacctactcccccattactcccaatctcctgtactgtgttctgttctgttttgcagagcactttaccacattctaatatactattattatgcttattatttgtctttctcccttcaatagaatgaaagcttcccaagggcaaggacttttgtaagttttgtgcactgatatatccacagtgaataaatccttaaaattgtaactttggtagagagtgccagatttgatatagaaagtgtcaagtttgcactcatctcaacaatatagaatagtgtctccctccacagccaatgtgttagggaagaaatattatctctgtggtttaatttgcattttccttattatgagttagaacatcttttaatctgcttaagggtcatttttttttttttttgagacggagtcttgctctgttgcccaggctggagtgcagtggcgtgatcttggctcactgcaacctccgtctccagggttcaagcaattctctgcctcagcctcctgagtagctgggattacaggtgcctgccaccacgcctggctaattttatttatttttattttatattttttagtgagagtctcactctgttacccaggctggagtgcagtgacactatcatagcttacagcagcttcaaactcttgggctcaagtgatcctcccacctcaccctctcaagtagctaggactacaggcatgtgcagccatccctagctaatttttacatttttttgtagaaaggaggtctccctatgtttcccaggctgatctcaaacacctggcctcaagcaatcctcccaccttggccttccaaagtgctgggattatggtttgttttatttatttgtttgtttgtctgtttaagtatgaccaggctggagtgtagtagcgtgatcttggctcacagcaacctctgcctcccggattcaagtgattctcctgtctcagtctcccgagaagctgggattacaggcacccaccaccatgcctggctaatttttgtatttttagtagatatgaagtttcaccatgttggccaggctggtcttgaactcccaaccttaggtgatccacccaccttggcctcccaaagtgctgagattacaggtgtgagccaccgtgcctgatctcatgcctgttttctatttgattattagtcttttcattgttggtttcaaggagctctttatatattcgagattagccctttggctgtgatatgagatagatcgtatgtgtgtgtatttatatttctatctcctagtttttcatttgtttttagacttttacttgtaattttagtcctcattaagtgtaatggtcccagaagatgtagatactgcctttgtttcttttagttctccatgtaaagtgaaatgtcttttagttggtattgcttccttagtaatagaggtaaagatggagctggtatgttgaggagccttacagctgaccatcatcagacacccatagattctgtttatgtttccacagagggtagctgtttctgacccttttgttattttccttgagcaaaagttgtgggatcttagtgaaattataaccacagtctcatccaaggacaccctctgctcaaggagaaccattagaactttcttctgctttatttgaattttaaggggaaaaattgttcttttatctgcttaagaaactataaattaagagggcaaaccagcagaattactagataagggaacatacaatttagaaattttaagttctaaaatcatattgtaccttctgcctctgtgtagatatacagatatcctgggagaaaggactggtttatctcattgaagctaatgacatgtcggttaggggattttaggctatttgtgggatttctccccctaggtttccccataataagtgaaagcgtaatctagtctctcagaataatgatatacatttgttcaacaatgcttggcgagttgggagcagcaggagtgggaaagctaaaaatttacatggtccggagcttgagattggcaagacagaacagtggaagacctggagggggctgaggggactcaaagataccctgtggagcatcattgagggatttcaggtgaggccaggtgaggctggtgactgctcagagatagagcaaggattggaatttctcaatgaggacaaagacaatagaaagtaggtgtcagtgagcgtaagacattggaagtctaagtgattgcaaagtatgagaacttgtaggtggagcagcttgcagaaatgggaggtccaaatatggattacggaagaaaattgggatgaaagtcacagttctttctatctctaggtgttggctgctgcttttggctaggaaggaataatagaggtgagctgggtctcaaaatagctcaataaaggttccttcctctctgccgttttaaaaataccaagcagcctcattttaatttgcatatcctctggctagaggaagtactttaatcagtacttctaattgtggaaaagaagagaacatgccaccacccgcccacacatgcacacagaggatctgataatgaagaatagtgttctcccacactaggaccaaagctgctggtttctccgttgccctaagaatccagattgtagggcaaaactcaagtcttgctcccattgtaaaaagaagctcttttttctttgttttttcaagacagggtattgctctgttgcccaggctggagtgcagtggcacaatcatggctcacccagcctcaaacttccaggcttcaatccacccacctcagcctcctgagtagctggggctacaggtgtacgccagcatacctggctaatttttttaaatttattttttgtagaggtggagtctcactatgttgcccaggctggtcttgaactcttgggttcaaatggtccccctccctaccctggcctcagcctcccaaagtgttgggattacaggtgtgacccactacatctggcaaaagaggttcttgtttttctgtttcttattttcctttttgggaggggtggggggaatatgctcttgacagtatatctctgaaggaatttgacacgattaccttcattattctgagagccatcatgcatatgggattgtataagggcagttacctaactgaggccttctgcttttccttgagtcatcactctgtattctcactacaagactatcttcccgactttaccatttattttttccatttgctgaatggttcccatggccttggtgttcttgagaatgttaggagacctggagcagataagttgtcctctgagctgctgtgtggggattcttgggggatcactggctcagaagttcttctccaaggtagtttggcctggtcattctatgttttcattttggattagcttcttgaattgccccacagatccaatgcagaaagtatctcttcagctaggaatactatagggtaaaatgaaatctaagacatggccttccgaggcatctatactgtgtctaggaagctcagacaaatacataatggtgaacaataaaatacagtgtctaagaggcattactgcataaaggaataagactgattctaaaaaatcacccaactaaaggggttttatacctttgtttggagttcaaactcatgtaaaaggcttggaattggatgctgcagagggatgttattgctagtgttgggagaagagaggacagcactgaggaaggcttcctggaagatgaagacttgaacttgatgacagaggagagtaggaattggatggagggatcagagtgcgtgcagagggcatctcctcacgagagtgtggtgtttgcaaaagcacagtgggagaaaggtgccctccctttctgaaggacatcaaggagatcagtatgtttgagaaagagtttgtggaagagcctcatgggagacgaaatgcacaggcagctccagattgcctagatccatgacattggtaggggacagggcagagacagggcagcgtcacttggaaggatcaggctcagaggttcatggtgtggtttctccagtaatgttcttcagaggatgtagcaccttgggaaaactctccttcattcctctgagattcataactttagaccagaaacttgcttatagcttcaagcagtcccttgcttattaattttgaaacattttatcttgtactactactttttgctcttcctaagcagggcagggttgccttgagctaaacccaggatgctttgaaaacaacataaaacaccttgcaaatggcaatttgtcccctctatcctgagtcaaggagtaaccaaagggatatgtttgaggcacagagagtatgatctgtgggtcacaccatggtaggcctaaactctagttgattatcccattgcaaaacttccatgcctctagtaattaaatgtgcaaatgataacaacctttttttttttttctgccaggggaattgatccctatgacaaaccaaataccatctacattgaacgacatgaaccctctggctactccactgtcttccgaagtacagatttcttccagtcccgggaaaaccaggaagtgatccttgaggaagtgagagattttcagcttcgggacaagtacatgtttgctacaaaggtggtggtaagttgaatgtactaaagaataaactacttttgagtttcctttgtgaagtttggcattctgtgattaaacaggtgagtttgcatacacaggaattggaaggatgtgcttgggacagattgactgaagggatctcaacattgacaacattgacgaacattccgaaagggcttggcaggtgctaggaagtcagaggagtggagaggcctaggacaaacactcaaagtggctctaggctctaggaatttggttgtttcctggtagccaagcatccttgacaaagacgtatttctttgaaatcccaatgaaaagaacaaagaatggagaggggagggtggctcagtggcttctttcctttaatcccactgcctgatttcctttaaacttatgctgatttctttgagatttttcaacacatgtcaatttacatggctaataggatgtgtagtcattggctagtgggagttaatgctctaagaaaagcagtaattaagcttccagctgtcagtaagtagcttaactctcagcctttgggaaaatcttccccttgatttgatgtgttggagccagatgccgaaatggtgggcttgctcattcaaaaccagagttgattacttaacaggacttgtcttgaaattgtattgagttcagtctttatcaccctggttgtaaaggaaaaaaccaggcccagtcaagggcaggtggggctcttatttctgggaggctactagcttgctttcctgatggtgcccttcccttgttgactcagggtctgttgaaggcctttgctaactgggaggttactctgttgtctttcactgttaaccttagagactgaaatcagacgtaatcttttccttcagattctcatttacttctataattggtagcaggccaggtggaagtaggtcaaccttcttagtaggattttagggtcaagagaggatctccccagcaggaaaagcagggagtaaggacagaatgagaagagagatgtgggtggctaaaggctagaggcatttccagttacataccttgcaaaatgttctgaaaaaccattagcctatggcagtttttcttgtcaggccatttgcattgacccatagacattggttcagtgccttcctgccttgactgtttctttatctttctcttaaacacacatgcacaaatatgtacagcagcccagaaacataagcatcctcgaatggctttgggcagggatggggtgatgggaacacacagataagaaatcaggcccaagcactggtgccttgtgacatcagttggacagtcttgagttttcagtatggtctaaaaccttgtcttcagttctccagggtttataggccttttctgccttaatgccttgggcctggagttattgtgtgattttaattctgaactctaaaacacattgactgactgcctggtttgtcctcctttttgcttgaaccagggcaggatggatagctgttgtgcatttctcttaaccgggttatttctaggtgtcacggtcgagagtttaagttatatcccagctgggccgggcatggtggctcatgcctgtaatcccagcactttgggagtctgaggtgggtggatcacttgaggtcagtagtttgagacgagcctggtcaacatggtgaaaccccgtctctactaaaaatacaaaaattagtctggtgtggtggcacatgcttgtaatcccagctactcggaaggccgaggcaggagaattgcttgaatttgggaggtggaggttgcagtgagccaaaatcatgccattgcactccaatctgagcaacagagcaagactctgtctcaaaaaaaaaaaaaagttatattctagctggagctttctgtgccctccattctagtctaacagctatgtctgttctccagatgtatctgatttacagagtgcctgtggtgagtttttaattaaacctggccagtggtaagattaggggtcatgtttgttttgatctcaccgatacagtacccagtgccttgcgctatgtttgatacgcagcagatgcgcaatagagttgaatgaatgccatgtttgcccacctaatttaaaaagtagtcaatttttagaaatttggtgggagacgtattaaatttttggtacttttataggcaattcttaactctctgtatggcttatttatttatatgctgttggtggcaaaattgtagttatgagctggctcctccttctgcacatggatgagccaccagattccagggtcagtggtattagtgagaggatgtaggtaagatgagttaggccaccactgagaggtgtttcccaaattgtggtcttaggagtacccacgtcagcatcaggcaaggacagttgttacaagtgcagattgcagggctcaaatgcacttttccccagatcatcccaaggttgtctaacaatcaccagtttgagaaactctgccctgagccttctacaggcagatgcttcaaatgacagagttgtactactgtctagggaatatttctcaagggatggattgatgggaaaagaaacacaactggctgtggatagcacacaaaatatgtgctttcctcctttttattacatcagactgctaaacgacaaggataaacaaagttggcctcggtcagataatcccctcccagtaagagtgttgaaacctgcaagtgtaactttttatctggggtctgcctagctctaaggctgcctgagcttgggaaattccagctggctttagtgttaaatgaattcaaatcaaattgggaaaatcaaagaactgattttaaagctacagaaagctggttttgcatgattaactcttttgcttccttccagcaccatgaatgattacagtcctttgcaagctactgtttcagccccctggcttctggactggagctggtgtccaggtcttcagaacctcctggtaccctgttggcctcgctctggctttataatgtgctttgtattttttgcccttaagttgccttgtttaatttttattccttgctttttgacatgaagttcacttatttgtcttcatagtgtacatcaaaatgatagggccattaaagaaacaatgaggttcctctgtgatttgttaatttggtaatatacaactgttaggctctttcagtagataacagtaattgctgaaaagcttgaggtgggtcagggttagctactcccctacaacctcacaacctcataacctcactaccagattaagattatcatgcaagccaggcccagatatttcttgcacaaatgtgtatcagtaagcaaagacatgatctgtggacttgaagtctcttctgtgaccttacagatgatgcagccacccacgccttgcatgctgcagacgctgtgttctagagtggatgctaggaaactatggcccaccacctgtttttgtaaatgaagttttactgggacacagccatgctcattgcttatttgtggtctaaggttgctttcatgcccagtggtagagttgcataggtacctatacagaggcaatatggctccaaaagcctaaaatatctattatctggacctttacagatagttgtctgacttcctgtagttgctgactatgctgatagttgtctgttaccccttcagttggcatcaggtaactggaatcgcaatgtcttgacaggtcccaggcattatccagaaaagtataggttatgggcctctctaaattgttatgccctgttaatgacaggatggtatctttagaatattatgcccaattcaagtattttgatgtcacaccagtctcccaagtgagggtccatgtgtattttcatgattctgactaagcaaccacgaatttcactattgaaaaccaattttcaaccttaagctaatttgctctctaatgttgatcagaggtaacagaacagtttagtaactgctacagggtgttgtgggcttctagatgagaaatcagctgacaaaactgtgttgtgaattataggataactgacccaaaccaaactacttataaattattttaactatgttacttaaatgtataagcacccaatgcttataactctcatacgtgatcaataaaacccagatatttacagattaaaaataaaactataacaatacatttaaaattaatatttgttacaactgtgttgagatacaattcacattctgcaaaatttaccctttttaagtgtgcaatttagtggtttttagtttattcataaggttatacaatgatcatcattacctaattccaaatatttttatcacctcagaaagaaaccacatacccattaccattacttccttctcctccctgatgctggtaaccactaacctagtatctttatggctttttcaattttgggcaatttgtgtaatggaaatcatacaatttgtgactttattagtccattttcatactgctatgatgaaatgcccgacactgggttatttataaagaaaaagaggtttaatagactcacagttccacatggctggagaggcctcacaatcaaggcggaaggtgaaggaggagcaaaggcatggcttacgtggcggcaggcaagagagtgtgtgcaggggaactgccctttataaaaccatcagattttgtgagacttattcattatcatgagaacagcacaggaaaacccgcccccatgattcagttacctcccaccaggtccctcccatgacatgtggggattatgggagctacaattcaagatgagatttgggtggggacacagccaaaccatatcagtgaccttttgtgactggtttctttcacagtataatgttttcaagtttcatttatgttgtagcatgtatcattactttaaccatttttaatggctgactagtattgtaatgaatataacacattttatttatccatctattagttggtggccatttggcttgtgtctactgttttactgttacaaacagtgctgctgtgaatgttcgtgtgcacgtttgtgtgtgaacttatgttttaattctgttagtttatacctgggagtgtaactactgggtcatgtgacaattctttttttttttttttttttttttttttttgagatggagtctcactctgtcgctcaggctggagtgcagtggtgtgatctcggctcactgcaagctccgcctcctgggttcatgccattctcctgtctcagcctcccgagtagctgggactacaggtgcccgccgccacacctggctaattttttgtattttttagtagagacagggtttcactgtgttagccaggatggtctcgatctcttaacctcgtgatccacccacctcggactcccaaagtgctgggattacaggcgtgagccaccatgcccggccgacaattctatgtttaacttttcgagaatcggtcaagtggttttccaaaactattgtaccattttatattcccaccagaaatgtattagggtgtagttttcccatatccttgtcaacatttgctactgttttttggatgatagccatcccagttaagtgtgaagtggtatcttatggttttcatttgaattcctgatggctaaggatgttgaacatcttttcacgtggctgttggccatttgtatgtctttcttggatggatgtctattcaagtcctttgtccgtttttaaattgggttcttttttattgttgagttataatagttctttattctatatattctttatatacaagttatatgatttgcaaatcttttctgccattccgtggtttatctttttacttttttctttttcagcactgaagtttttatttttattttatttttttgagttgggggtcttcctctgtcacccaggctggagtacagcggagcgattgtggctcactgcagccgtgatcttcgtgtgctcaagcaatcctcctatctcagcctcccaagtagctgggaccacaggcatgtgccaccatacctgttaatttttttattttttgtagagacggggtttcatcatgttgcccaggctggtctcaaactcctgggctcaagcagtcctcccaccttggcctcccaaagtgttgggattgtaggcacgagccaccatgcccagccgtgtttttaattttgatgaagttcagtttatccatttttttttgctgcctgtgctgttgttatatccaagaaactattgcctaatctgaggtcatgaatatatacttccctttcctttaagagttatgtagttttagttcttacagtctatgattcattttcaattaatttttgtatctagtgtgaaatagttatttaccttcattcttttgcatgtggataaccagttgtcccaccaccatttgttgaaaaggctatactttttccttggcaccttggttggaaattattttctcataaatatgagaatttatttctggactccttctctctttttttttgagacagttttgctgtcacctaggctggaatatagtggcatggtcatggctcactgcagctttgaactcccaggcttaaaggtcctcctgccccagcctcctgagtagctgcaactgcaggcattcaccactgtgcctggctaagtttttgaagagacagggtctcactatgttgcccaggccactgcacctggcctgtttctggactcttaattctattccattaatctgtatatctacccctatgccagcatcacactgtcttgattactgtagttctctaataagttttgaatttggaaaatttgaactctccaactttgttctttttcaagattgtattggctattctgggttccttgcatttccatgtgtattttaagatcagcttgtcaattttttgccaaaacaaaacaaaaaccacagataggattttgatagagattgatctacagattcaacacaatttggagagtgttatcatcttaatatatcatgccttccaatgcatggacaaaggatattcttccatttatttaggttttctttaatttctttcaactgggttttctggttttcagtgtacaagtcccggacttctttagttaaaatttttttcctggctgggcgcggtggctcacgcctgtaatatcagcactttgggaggctgaggtgggcggatcacgaggccaggagttcgagaccagcctggccaatatggcgaaaccccgtctctactaaaaatacaaaaattagctgggcgtggtggagcgcacctgtagtcctagctactcgggagactgaggccgaagaatctcttgaacctgggaggtggagattgcagtgagctgagatcgtgccactgcactccagcctgggcgacagagcgagactctgtctcaaaaaaaaaaatttcctaagtattctttttggctccattgtaaatggttcttttctaaatttcattttcagattgttcattgctaatatatagaacatgattgatttttgtattattgatcttatattctacaaccttgctgaactttattagttctaacttttttggtgtgtggattccttaggattttctgtttacaagatgatgttgtctgctaaaagagacaacatcatcctttaattcttccttttcagtctggaggccttttatttatttatttttttgcccaactgccttgggtagaacctctagtaaaatgttgactaggagtggagagagtaggcatccttgtcttattcctgatcttaggggaaatgcattcagtcttattaagtatgatttttaactgtgaggtttttctagatgtcctttatcaatttgaggaaggttcccttctattcatgggttgttgagtgtttttatcatgaaaaaatctgggattttgtcagtgctttttctgtgtcagttgcaatgatcatatgtttcttttttttcctcctttagtctattaacattgaatattacactgatggatctttctcatatgttaaaccaatgcacatttttggaatgaatcccacatgctcttggtttataatcatttttatcctttaatttgtttggcagaatttaccatctttgtgggaagttttctggatactaattcaatcttttcagtttttaaaatttctctttggttcagtttcagcagtttgtatctttctagtaatttgttcatttattctaggttatttaatttttaattattcatagtgttcacactaatcttttttttatttctgtgaggttgttaatgatgtttcttatttctttcctaattttagtaatttgagtcttctctttttttcttggtaagtctagcttgtagtctagtttattaaatgttgttaatcttttcaaagaatcaatatattgtttgagtaattttctttattatttttctcttctctatttcatttattcctactgtaatctttatatttctttcattctgcttgctttgggcttagtttgcccttatgtttctatgttcttaaggtggatagtcaggttattgatttgatatttttcttctttttttatataagtgattacaggtatacattttcctctaatcactgctttagctgcatttcatatgcttatgttttcattttcattcatcttaaagtattttctaatgattcttgtgattccttttgacttcattgatgatttttgaatgtgttgtttaatttcaatatatttgtgaatttccttcactttttggtttctcattttattctattatgatcacagaatgtactttatatggtttcagttctttttaaatgtattggggcctattttaatacttaacatctgttatccttgagaatgtggctgaacatgtggaatgaaacatgtgctttgagaagaatgtgtattctgctgttattgggtattatgttctataagtgtttattaaatctacttggctgatggtgatgttcagtttatctttttccttttctgccttgttctatattgaaggtgggaaaatcttcaactgttgaaatctttaagtattatcatcttgattatttatttctcccttcaattctgtcagttttccctcatgtgctttggagttctgttgttaggtgcatatatgtttatgattgttaattcttctagattgacacttttatcattattaaatgtccttccttgtctctagtaactattttttgtcttaaattctattttgcctattattatagctattcttttcttctgggtacagtaaacatggtgtattagtccgttttcatgctgctgataaagacatacccaacactgggcaatttacaaaaaaggtttataatggacttacagttccatgtggctgggaagcctcacaatcatggtggaaggcaagcaggagcaagtcatgtcttacatggatggcagcaggcaaagagagctcatgcagggaaactcctcctttttaaaaccatcagatctcatgagacttattcactatcaggagaacagtgataacactatcatggaaaagacctgcccccatggttcagttacctcccacctggtccctcccatgacatgtgggaattcaagatgagatttgggtggggacacagccaaaccatatcacatggcatatcactttttcatccttgtagtttcaatctatttgtatctttgaatccttgtaaatagcatatggttgtgtcaggtcttttatgcattcttttaatttctgccttttgattaggatgtttaatttacttacatttaatgtaattactgaaaggtagactacatatctgctattttgctctttgctttctatattcctgataaattttttttggatcctttattacttcattactgcctttttttgtattaaatacagattttctagggtgacatttaaattcccttgtaccttctttcactaaatttttcccaggtgttttcttaatctgtgctttggggattacaataaatatcttaatttatgaaatctaatttggattaataacaatgtaacttcagtagtgtacaaaatctttgtcattatatagctttattgtgtccctgcttttgtgctattattgtttcatctttatactctttaagcccatcagcacagttttagtctaattgaggactccttagatgagtcatttttctttgctgctttccaaggttctttatctttggctttcagcagttttactgtggtgtgtctgggtatgggtctctgagtttatccttttaggaattcattgagctgactggatttatgttttttatcaaatttggggagttttgggtcattatttcttcaaatattctttctcctttattctctcatctcgtcagtgactttggtaatgtgtatgtcaggacacttgatggtgtttcctgggtcttttaggctgtttatttttaacattcttttttttgttgtcagactgagacatcacaattgacatgtcttaaagttcactgcttttttattttcctggttcaaatcttctgttgaacccctctactaaatttttcttttattatacttttcaactcccaaatttctatttgcttgtttttaaaaaatatttctatttctttattgatattctctatttgatgaggcattgttctcatactgtcctttcatactttatacatgatttcttttagtcctttgaacatatttataatagcttatttaatttttttttttacttagtctaatgtctgagcttttaaggacaatttctactgactactctttttgtttgtgtataggctatactttgttgtttctttgcttgtcctgtgattttttttgttgaaaactggacattttaaatggtgtggtacctccaaaccactgacaccccttcctcagggttttgtgttgttgctgtttgttgttgctgtttttgttgttgttgttattgttgttcagggagtttcctgtactgctatcaagtttgtgttctttattgtttttgctactgaattgtctcgtaatttagcttattggtcagctaatgataagacagagattttcttaaactctttgaaccactaagtctctcagcctttgctaatggcctctgggtgtgtgttagggtataccttcaatgcttttgcaggcagtttacaactctgtcctagccttcacttcctgcttatgtagagcttcaagattagctggaggtaagagactagaccccgttcatttctttcttgagcatactcacggctcttatgtgcttgaccttgtagagtcccaggaatactcatctagagcttattaaagcctcctaagggcatcttcttccccattttttccttttaagctttttagttagcctctttttaattcccaattggtaatactgtcttcagaagttacagtgataagcctttgctaatttttattcactattttcagtaaatgccttggctggctataaggctgtctatatcatgaaccaagtcaggctatgtaaagacaagagctgataatgcagccttcctgtgagcccccagacaggtcaggctttttgggaactccagacctattctgtcctctccagtggctgccaggctgctgtttttcacagctattgtagatgtgaggctgtgggtttccaaggctaccacagagctagagagagggggatgggattagggcaaatgaaaacatcacaaagctggctatttttgccaagattcagccattgttcttgagtaaatgtgccttggatttttgcaaccctttatttcatttgcagaattctgaaaaagttgattttgaggatttttgtcagtgtttttcttgcttttatggataagtatatttttagagttcctagaaatgcttccaattaatattaactttgtaaactttattataggcattttccaacctacacgaaagaacagttaatgctgatatgacctccccacgtgccctcaccaacttcaatattacttacctacatttgccaacctctccttagctatctactcactacttttttttccccctggaatatcccagatgtcagattttagctatgtttcatttatgattttttttttttttttgtaaacaacattaaggtggatgaggatgttttgctgaacctttgttgctgctccaagggaggatgtgacccatggctctggtgcttctgaactagtggccctgtgcttccccatgccttgggagggcttagttctttacccattttctctagctgagctgccatgcaactttcagtgggatagctcattgcagtatcctttggcctttacttgataagaatgtcctttatttagttcctttactcctcttttctccttgatcctccgtttctttttgctcttgacacaatctcaaatataaatggaaattcaggttattcagatacctagatgaatttatttatttaattatttattttttttctgagatggagtcttgctctgttgccaggctggagtgcagcggcatgatctcggctcaccgcaacctccgcctcctgggttcaggtgattctcctgtctcagcctcccgagtagctgggattacaggcatactctaccatgcctagctaatttttctatttttagtagagacggggtttcaccatgtcggccaggatgatcttgatctcttgacctcgtgatctgcccacctcggcctcccaaagtgctgggattacaggtatgagccactgcacccagcagaatttatttttagttatcagaaatgaaaacacaaaattaaaaaaaatcttcttataaattctcagactctataagattgaattagattcaaatatttaaatcatttctactagttgatgaagtttgtgcatttgtggatgtattagttggtacaacctttcaggagggctatttcatgatagctatcaaaaatacaaattttgacttaataattcttctaagactgcatcctaccaatggtattgtgcagttctgaaaaagtaataaatacatgcttatttatatgtgtgtgtgtttaagaatgtttctggaaataactaaagtgcccaccaatagctgttaagtggaaagatgtctaagatacattgccaatgataaaattttaaattgtgggacagtaagatacactgttaatggaaaaagttaagtaatacaacagcatttatatcatgatccaaattatatgtgaaaaattaaattgcctctgtcagtttagaactatattaggttgctggtaatagactagaaataaaaattgcttaaccaagtcaggagtttagttttctcccccttgctgcctggaggtaggctgtcttgggctggtatgttggtgtcctgatgttcttggggatccaggtttctgtcttaatgttctgccatcctgactagtgatttccattctcaagattacctcatggttcaagacatccatactagccttcaagtccttattgcagttaagaagaataaggaaagacagcaagtaggacctcttcccaccaattctgtctgtttaggcagccttctcagaaatccagcacgaaacttctgtttttatctcattgactagtacttagtcacgtgacttcccataggtgcaaaaatggtagagaagtgcagtcatttattctgggtggtgtcagagtcccactgctcaggaggaaagggataatgggtgttgggggtaggtgtagcagtgtctgtcactatgtacatatgcttgcatgtggtggcacagtacatttctgaaaggatgcacaagagctgttagccactgggcactctgcagggtagagtgggaggagggatgtggagatcagagcagagcttctgcatttaccttatacccatctgtgctgttggatattttccatgagtatgctttgctttttaataatagtgataaaaaacaaaccaacccaaaacctatggtttattaagaaaaatctcagagccttacaatacatcttataatcactagtgtgccatagtttaattgttaatatatttcttggtggaagtaaaacaatacagtaactctttaaaaatccattaagaatgaacctgaattgtccaggtttaggaataattctccaagaaggtagtgggatcgatgcattttgagattttttttttgatgattgtagtattctgtgatttttgcatttatgaggtaagactgacctgtgaaatatattcttaatactcaggcctcccagcagcaatcgttaagtatttttaactaatgatgggcctgggtgtcattgagaaatcactctttttaaagttatactcacagttggaagtcgtaaaaaacaaagcataaaaatgtatatttcattgatatgttcctctatatattcacaaaaatgtatgtgtataggctgacttaaactaatcatctgacatagccatgacattttatcaacttaatgaaggcttttggaatttatatgtaacaattttgctgggaactgttttcttattcagttaatatgcttttacatttttaatagatccatcatttcctacggccctatgtttagtacaagctattaatatggttttcaggtttccattttggtgggcagtctttcgtacctctctgcctgatttctttaaaacaaactacttttaaccatttgttcagtggtgatttgaatgtctgctgctcaaatggattaaaagtaactttgtctttatcagctgggtcctcacagtatttatggggcatgtttgagcacagggtactgaatcgttatattgcagataaaataaatggatatgttccttactctataggaagttaatatctataataaacagcaacctagtcaaggataagtgaagccaaagtaacccctctggctgggaatcccaacatctcaatatgtttaatagtcatttgtatgattatgtccacatgagggtatgcctccctgtgtctttcctgatagatatgcaacatttgccttcagcttctggccatgttcttttagagctggaagaaaccacacagagtttttataatagttcttatccttttttgagtggtggactttcttgagaatctgataaaacgtacggagcctccatagcaaaataaatgagtgtatataaaaaaatttgcatatatgtttacagggttgctggaccatttaaacccatctacagggaagtcttgatccaaataagcttctccttttgtatatgaataaactgaaagctagagagatttctatcattttctcagttggtagagctagctcttaatctatgcttttatacacatttccaagattcttgctgtgacttaaaaatctctaaaatgcaatgtgatgtggtcaacatcatgttgaatactctaccaatgaatatgtattctagcaaaagaccttcctcaatgagattattcagagatggaaaaccagaatcaatgaagattctctcaagtcttggtgcaaattaaaaccttgtgactggagcatccttgtaatctaaaaataggagtagaaagaagaaaagaacatgttttgtgtgcatggtgtgtggctgatctcaccctttagtggtttgggggccgtaggctcctccctgcgtgtttcttcagcctcatcacacaatcctctttctatctcttactctgttgaagtgttggcagcctccaaaaacctcctctagtccaagttctaccatcataccatttccttatctaatatccatggagtgtctagtgtctgttgcaaaccgggtatctaagatgaagcagtacaacccaaactgcccagtgatggcagacattgcaaaaacatgaatttgcaatcacagtctctattttgtgtttccagtagaactggaagaatctgactcttctatttttatttttgctgcttttgaatgactgtaatgtggcaccattaatttttttttctcctcttccttggcagcatctcttgggcagtgaacagcagtcttctgtccagctctgggtctcctttggccggaagcccatgagagcagcccagtttgtcacaagacatcctattaatgtgagtggggtctgcttgaggatgggaagaagtatcattgtctttatgcagaggtcagaggaaggttgttgcagggatggcctgctggagtggatattttatggcgcctccctgaagtcaggtctctagagagtgcagctatgctttgggcatcgtggtctgtggttcccacttcactgaagcagagctgaacgagagacttagtttgctttaagtggagcagcactggcagagagaggttcgagccagagtcagtgccatctgagcaacgtgccagtactgaagcaatgggaagtttgtgcatgataggatctttttttattaagtaactgctggattgcttgcaggggatgaattccagcagaggataggatttgggtcccaccttttagaaacaggctggagagactaaaaactgagtagcagaagaaaccagacataagcaaatgcttaaatatgcagctttataacatgaagatggataggaaaagtctgcatgggatgggtcattagaggagctgccacagggagacggtcacagtgaaacgtcttgacattggcaggtggtttggtgaaaggtaagtagctcacttacttaccttccaccaaatgagtgggatcatacggagaacagtcatgccagtcctttgctagtttctatggattctgctttcctttggtcaccttaggaaaaataaagggaagtgcattaacccgtattgtactttgtacgaatgaaagttctcatgggaaaatgagggagacattattaacggaaagaggtttgtaggtcatttgtgcagtgcagtggcccattattttgtgccccatttgccagtaaggggcccgctaagctgcagatctgcctcaggttctccaaagggaaagtcgccaaagcttctttgccaaggttagggagcttcccgtgggctttaggccaacattcatcgctagaacatttgaaagtcattgcttccgtgtgtatagtaaaagcccacagggcacatttgttttttgacgtatcttttttgacttttgattccaaaggaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtaaggagactgtgagtccttctcctgccttcttaggccaacacaaccattagcttctctctggttctgtggttttcaacattagctgcccatgtggatacacccggggagctttcggaaacccgatgcctggctcacgtgcgcagagatcaccatgggatgggtttggggtgtggccaggttatgaggatcttaagaagcgccctaggtgattcttacgtgcagccaagtctgagaactacagctctaggtaacatttagggtccgagctactgtgttaatcacttccttgagctgcttttgttcagttttctggttttgtggtttctgagcagtgaaaaacagcacttggtaaatatcagtcagtgagagctggcatatgcggccagtggatcaggttaattgatgtcattactctttttaagagataatcggacggtgttttgtaaagaaaggcaccaacgtcattgatcctttgtctgtaaatcatgtgtttagagctgttttgtagtccagcagtgggcggtctcggagcaccacacccatcaaggggtggtggaggagttgggggtttgggagggatgaattggttcttaagatccgttcagggccatttattctgatttgtcgtttgacaaccagacttgtgtgacctgtgtggctgtggttagagtcccctctgctcttggaaagagtctcccgtgtgaagctgactggtctggggtggggtctggctctccagccatgacaaccaggtctgagggcatgcccctgtgcccactgtttctgggcaattcattccgttgtcagtttattcacaggtatgctgctgctctctgccagacagtgttctaggtatagccacaaagtaatgtatgaagcaataaaatatcagaacaaagtccctcttccatggagtttgtattctagttggggaagatagaatataagcaaatatgtgatctgcctggtaacatgttgaaaagaagaataaagcaagatcaggggatggggatttgcaacggtgttcttttattctattggctgcttcaggagggggacatttaagcaggtgcctgaattacatgagggaaggaaccaggcagacccctgggggagtagcgctgcaagcagggcagacaggaagcacagtgactctgaggctggactgcactggtgttttaggagcagggaggaggccagggtggctggaagggctgcagagagggagagagaaggaagaaacaggacctaagagagcagggctcagatcctatagggccttcaggggcttgtgaagaactttgtttttttcttttttgttgtttttgtttgtttgtttgtttttgagatggagtctcgctctgtcgcccaggctggagtgcagtggtgcaatcttgggtcactgcaaccgccgcttcctgggttcaagtgattctcctgccttagcctcaaaagtagctgggattacaggtgtgcaccaccaggccaggctaatttttatatttttagtagagacagcaccatgttggccaggctgatctcaaactcctgacctcaagtgatctgcccgccttggactcccaaagtgctgggattacagatatgagccaacacactcaatcctgtcttttccttcgaaatgagatggaaggtttagaccaggagatggacatgatctgatttaacctttcaatttttttccgttaaaatctgtgaattgcattatataatgaaaagaatataacacataaatggatagtgttctaaataattataagtgagcactcatgtggcttatcttttacaggagttatcctcaatgctgtgtgggaatttgactactgtgactactgtaggggacaaaggtgggaacaggaagactagttgtgaaagtattgcagagatacaggccagtagggatggatgttggctggacccagggtggtcacactagagacgctggaaatggtcagaccctaaatatattttgaaagtagagccaatgggatttgttgatagatgggacgaggggtacgaaaggaggaggagccaggggactgctactgcttcacccgagctgcctttaaagagatggccacacagggagtcagggagagctggggcaggggcaatattggggggagatcaccagcttggtttgggacttacctggttggagaggcctattggatatccatgtgcccagccttctacctggcctctgacagtgcttttccacttcctgtttcttctcttttggaggtgctgtcatcttttattcctttcctcccctgacatagactcatggattaattattatttaatgtgttataaaccattcctgccatgatacattttgatgctcagcttgtcctggtttggtcagtggcggaccctacctccttctgtttggttcttgtcgttttttattgaaaaaattatttactggccgggcatggtggctcacgcctgtaaacccagcactttgggaggccaagatgggtagatcacgaggttaggagatcgagaccatcttggctaatgtggtgaaagcccatctctactaaaaatacaaaaattagctgggcgtggtggcacgtacctatagtcccagctacttgggaggctgaggcaggagaaatgcttgaacctgggaggtagaggatgcagtgagccaagatcgtgctactgcacttcagcctgggcgacagagcgagactctgtctcaaaaaaaaaaaattatttattgaggtgaaatgtatataacatcagcttaactgttttaaagtgggcaattcagtggcattcaatacatttacaatgttgtgccaccgccacctctgtttaatttcatggccttctcatttctccaaaagagaaccccatgcccattaagccgcttctctccaccgtccccttctcccagcccctggcagccgtcagtctgatttctgtgtctgtggatttttccctattttacaggatgtttcatataaatggaatcatacaataatatgtgaccttctgtgtctggcttctttcacttagcctaatgttttcaaggttcatccgtgagtaccatatatcagtgcctcattcattttaatgggtgaataatattctccttttaaaaataattaaaataatgaatcactatccctcagacctttcactgactctttaatttttcttttttcaccattgaaagcccctggctgtggaatggaaaagtcacagcttgctaaatattttctcgtcttcctcatttgtcagatattcagggtgaatgtttcatgctgggacagagtatgagccagaagccagagcgatggccctttacagagtcatgaaggcctcccctccttgcctgagcgcacagtccagtgaagaaactggaaatagattcacgtcaagagtcataggccaacgtcccactcagttttctcattgttctcagattttatctgaggactagagaggttccattatactcagttgagtgatgttttgtcatctgcatctcaatctcagccaggtgaaatgggataaaggtgaattagcacatcgtgtgggcaggctggtttagagtaaactgctatgtgaaatgagcaagtctttgaactgaataggaaagagtggtgtctgggaactgcttctgatttactcagagacatggagaaagagctctttctagggaatgaccctggccctggtgggatgtgccaggtgggagtctcatggaaagcactagctagatgttggatgctttggaggaactaatgtgctgaggagatgtcagccccgtgggtcaccttagggaggggcatgggcccagttggtgggggtattgccagggcatggattctgcactgagtggggctataggggacctggtgagcttcctggtaagccttggcccagggcactctgggaagaaggggagaagtgccctggggagggccagtgaggataaaatggaagaaagtagaccctcagagaaagtacttagggtggggcagattgttgcagggcaggtcaagtgggggaaaggaaaggatgggctgggacttctggtgaaggagcatgtgaggtacaggaagacaggcttctgcttagaagtaaaagataaaactccaggaatccgactcgggaaagaaacagggctcatctaaatgagagaaactcaggcctcccagatatctagaagaagcccataaccagtgggatgacaggtttatgatgataaccctcagagaggtagagcagaggtcagcagagaaggaggaatcgagaccttcagctggttcctaaggaagcccctgaaaaataactgaactagacctaaggaaaccacatgtcagagaatttggtctcaactccagcatttcattcggcactctgctcagtccctcagcctgaagctgctttggtggggctcctagtgttccttttcctgcctcagaggttgttgtttgggtctttctgtctgaggtggcagggcagtcatccagctgaagagattgtgtggagatggttgatggaggacagcgtttctcggctttattgtgtagccggtggcttagaacccctgaagtaaagggcaagcttccagtcttttttctttttctttttttttttttttgagttggagtctcgctctgtcaccaggctggagtgcagtggcacgatctcagctcactgcaacctccgcctcccgggttcaagcgattctcctgcctcagcctcccaagtagctgggactacaggcacgtgccaccatgcccagctaatttttgtattattaatagagatggggtttcactatgttggccaggatggtctcgatctcttgaccttgtgatctgcccccttcagcctcccaaagtgctgggattacaggtgtgagccaccatgcccggccaagcttccagtcttaacagccacctatgaaccctggttacaatttctcagagatccgctctatttgtaatgcgtgtatcattttagcgcaaaaccacttccctgtggctgtggcatcagggtatccgcatggtagataaagcctgggaaacccatattctctctctctttttttttttttgagacggagtctcgctctgtcgcccaggctggttggagtgcagtggcgcgatctcggctcactgcaagctccgcgtcccgggttcatgccgtccatattctcttaagaatataaccccaagctttctagagccatccttgctatatgtacagtttctttaggaaagaatcgacaggttctgctgagcttcctgacagaaaaccctgtgggcttctatctgatcagggtgttggataattaggttgtaagtacctggagaggggctgtgtaaccctgagctaggttcctacagattgggttgaattttaagcctcagcactgttattaatgtcttgcaagtctgacttaatgatttctgtttttgaaggctcactggaggatttggagtcaatttcgttagtgatgtaatagatgtgactctttcgtcaacttttgtatgttatattcatcattctaaaccccctgttaggaattgttggtcagacaagccttttgaccctaaaagttgaaaagaaacaaattttttaaaatagcagattatctggctggacatggtggctcatgcctgtaatcccagcactttgggaggccaaggcaggtgcatcacttgagctgaggagttcaagaccagcctcggcaacatggcgaaaccccatctctaccaaaaaataaaaaaaattagctgggcatagtggcacacacctgtagtcccagctacttgggaggctgaggtgtgaggatcattgaggatcatctgagtctgggaggttgaggctgcagtgagccatgattgcaccactgcactcctgcctgggcagcagtaagactgtctccaaaaaaaaaggaatgaagttctaacaatgtgctataatgtggatgaaccttgaaagcattatgctaagtgaaagtaaccagatacaaaagaccacatattgcagattccatttatatgaaatgtctagataggccaattcataaacacatggagcagatgagtggtttccagggcttgggaagggaagaggaaatggagagtgactgccagtgggtatgaggtttccttttggaatgatgaaatgttctggaactagatagtaatgatagttgcacaacattgtgaatgtgcttaatgccacaaaattgtatacttttaaatggtcaaattttatgttatttacaataacaagcaaataccaattcaggttcatagctgtttattttcatattgtaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgaggtattgatgctttaatcttcttttgctttttaatataaaggaaagagccctgctctgtggtagtttcctatgtctagtatttattgaaaaaatacaagatcacatggtattctattaatatcacatggagcagacttctatttgtgttgctacacttgcagttcccaaactctgctccaaggtcttgctaccacttctgggcagaagcaactcagaaaaaaaaaaaaaaaagtagtattcgtttttagtactacttgtttagttagaccattacttggtcttttggatttttgaattttgtttgtccatggtgggctatgtggacactcccctatataatgtatctgtggcccttgggaaaattcttttggagactcttaccttagaatttacttcttggtttttcttctctatttggcaatgggtcttggcttaccacatcaaatctaattttggaaagaggcagcctataaatggatatagacaaatatctgggtacttcctcttccctcaatagtgtcttctacagcagcttggtgagatcctgggatagttggggcttgggtgtttttgagcgtgctgtgggggtcaggctttagttaaatcgaattaatggtatcattcaaattcagctttctgtttccctgactaatcagtttatttatgaactgtcgttcatcagctttaggtataggtttcttcttctgagtttaggtggtggaaggaatgtataggaaatgggtaagtctgattacctgaggttacagaaactcttcaatgaatagacttccttgcaggcagagaagcatgagtcagaaagaggagtgagcaaataaatatttctttgagacccagcctaatttgttccagttttcattggtcaaactgagactctagcaagacagatacttgttagagatccttttatgacaaaaataagtagcaaataatccagcaaaccttgctaccatttttacctgaccataaccacataagcacatagtcctcctgtgcagaaccctggccacatctgagtaacattgaacaagctctttctgaccaggagaactgagtgtgaccatatggcaaagggtgttgtcctgattgcttgcagagctatgaaaatctggacatgagtgatggaggccagactgaatcgcttgaagccttgccctgtatacctacacctttgtgcaaatgtaaaatacataggaaaaaatttagtgctaatcctttgctttttatatctcattgatactgtacatcaggggagcttttccatgagacttatgacttctgattcttggtctttcttatgacagaattgctggaatcatgtttgaaatatgtctctgacttagaaagtgaatatgacaaaatcatttcatttctctttagttctgagtcacttgagaggatctctgagtgataggatgagatgatgactttcccatctacttgagttgacactgatttctaattgttattccctgagagtctcagaaggcctttttaagttgtaattgttctcttcttccacgggacatttatgtgggttcagatgatcctctctgtctggggggtgtggggacagctgggctgtgagtctggtttcccctgggccaggcctccttgccccgtgtcagctgcactcccctcacacaggccgcagggtttacagggaacgctaggcatggtatcatgtgctgacactgcctgaaactttggttgtatagctttcccagggctgttcccttcatctggctcagcgcctcagtcagctcctcaacctccagctccggagaatgcccatcctgtccaaggagtcggctccaggcctcatcatcgccactggtaagtgtgcttgcctgttctcaaaaggggttcagctgtctggtgatgtgcaggccaaatgcagagcgatcacccacacctccagcagtaaccacgctttgtggtttgaaagcattcttagttgctagatactacgcagaatttctggctgggcaaggtgattatctgacatattcttgaaattaaaaataattatttctcttgcattttaggctcagtgggaaagaacttggctagcaagacaaacgtgtacatctctagcagtgctggagccaggtggcgagaggtcagccccctcccccaatcccgtcccctccaccctcattcccatttgtgtgagaatgtagactgtgccttggcatttcagggacacaaatggtccatggcagagaccagtaatgccagatatgactataaagtaaagaaaggtacctgaagccactgatttatatccacagttactttaaattaaacacagacctttgcaaatgtgtgaattttactgaacattctaagattatgagttctatgagggcaaagacaatgtctgttttactgacttctttatccttaggacctaagagtgcctggcatggagtgggggctcagggcatatatgctgcatgtatcagcaaattatagcgtagtggtattagccctgaaatgggctgctattattattattattttgtatattattgaagttgagatgaagcctgtccttgctgggctatgttgtataggcactttcgtctcactctgtgctatggaagtagactctctttttgccttaaggttgtataactaatatcgatgctgattataccaattcctaagacagggctagttccctagttccaaaatgctaattcatcttcatctttgggcattagagaatttccaaacttgtaaaaaaaaaaaaaagttgttgccagcctcccattgattaaggccaaggaagtgcgtttggtctcgttctgtaggggttgctttcaggggtgaccctctagttatgccaggagccaccagggtaaaacccaacagatcacttgacaggatgagcaccttgtcatcgagcagccccgcaggctgggcagccggaacagcacgtcgggagtgatgtggagttctcagaacagctagcagacatagttcccatccacgtggtgctttactgggaatgcaccatgctcaccttgatatttgaataggtaatatgtaaagcagtaataaaaataccaacattcatttggcaccttgcagttcacagaggcctgtcacaagccttctctcactgtggcagggcttcccatccctcccgaggagagagatgaggctcagacactgtgtactgtatgtggtgaacgcaaatatgtgttcagatgaggcagattgttaaggccattgtagtcagagtgcaaacagtttgaatggaaattttcgggttgtccttgtgcagctcccaagggaagattaagcagctgctttcccctttcgtggagctggacgctccctttgaaatggggtatcctcttctctgcgaataggcctgtggtttgtttgtgccttctgctgttggtgtaatctgggatttgcacatctgcaagtgatttccttctgggtagaaagcagtgtcttgttcctcctccagtgaagtggtatcgtctggtgattaccggggcagctgtcagtgcctccctccacacgtgccttgtccctgccaagaagcaaccagtgcataagagaccttattttgggacatagcagaaaactaacttggggatgaaaagattgtgagtttatctgtgtgagtgggcatctgagtccccatgggcagccttcactttagagggacaatctgggctgtgtgcaggagcaggtggtggcagaggaagaggctgtagtggacagaatgttgcctggagcactgatgactgtaattgtggttttctttttcctcctaattagttgtgcaaattctctgatcctcagaattcctttttttgtgcttttttctctttttaaataatttttatttcttttatttttagcttttttctttatcaactttattgaagcagatgaaggcacagtacactgcacatatttaaagtgtacagtttgatcagaattaattatggtcaccacaattaagataacaaacatttccatctgcaaattctctgatcctcagaattccgtttttgtgctttttttctttttaaaataatttttatttcttttatttttagcttttttctgtaacaaatttattgaagcagataaggggacagtacactgcacatatttaaagtgtacagtttgatcagaattaattatggtcgccacaattaagataacaaacatttccatcaccctccccgaggtatctttgtgcccctcggtaatccatcccactctccagtcttgtccttgtctgcttctgttattcattggcattttctagaataggttattcattggcattttctagaattttgataagtggactcacacagtatatactctttttgcctggcttctgtcacacatcacgatgattttgggtttcatccaagttgctttgtgtatcaattgttcattcctttgctagttgtatcccattgtagggatatatcataatttatttattcattcatctgttgataaacattccagttttgctgattacaaatatagctgttatgaacattcatgtacatattttattcatttctctagggtaaatacttaggaatggaatagctgggtagcatggtgggtatatgtttaactttttaaagaactgccaaattattgtcccttttacatttccaccaaacagtatgtgagaattttaattgcttcacatctttgccaacacttggtatgattagtctttttaattttagacattttaataagcatgtgataatatctcattgtagttgtaattggcatttgtgtgattattaatgattcttttcatgtgctcattggccattttaaaatctggttgtgaagtatctgcccaaatcttttgcctttttgaaaaaattgggttggtccagcacagtggctctgcctataatcccagcacttcggacggctgaggtaagagggttgctggagccatgggcaacatagggaaagcttgtctctacaaaaaataaaaatagccaggcatggtggtgcatgcctgtagtcctagctagttaggaggctgaggtcagaaggtcacatgagccctggtggttgaaggtgtagtgagctgtgattgtgctgctgcattccagcctgggcaatggaatcagagcctgtctcaataaatatataaataaattttaaaaactaattttaataattgagttgtctatcttctttgagttgtaggagtttttttaaaaatatattttggattcaggtcttttgtatgatatatgggtagatactcattttttccatatggagatctaattgatttagcaccatttattgaaaacccttctctctctcccattgaattgccttggtacctgtttgaaaatcaattggccatatatgggccaattttaggccaattgggtctatttcaggtctttattctgtcccattaatctgtctgtcttttcactaataccaaattatcttaatttccaaagccttatagtaaatgttgagatcaagtagggtaagtccttcaactttgattattttaaaaatctttttttattattgtaggtcgttcgtatttcctgatacatttcaggatcacttgtcaatttctatggaatctgctgggatttttattataattgccttgaatttatagaatcagtttggaggagaatcgacatgttaatactattgagtcttctgatccatgaatgtagtatctttttccatttcttgttcaatttctctcagtactttgtagtttccaatgtagaggtcctgtacatcttttattagctttattcctaggtattttaattttttgtggtattactgtaaatggaattttattttctaatttttgctctagtatataaaaatacaactgattttttatatattcatcttgtattctgtgaccttgctaaggtaattcattagttctagtaggtttttagattctatgtaagcaatcataccatttgcaaagagtgacagttttatttcttcctttctgatcttaatgtcttttatgtattctctcattcttctcttcttcctttttctcttctttcttgtccttctttcttctctttccctcctttcctccattttctcccttctgatttctttcattcttcttatcacaatggctaggacctctatacagtattgaatagaagtagtgaaagtgggcattcttgccttgttctctctctgggggaaacaattcaacctttttaccattaactatggtgttagcagtagatttctttatcaacatttgggaagctccctattatcactagttgttgagtatttttttttttatcataatcagatactggattttgtgaaatgctatttttacatttattaaaatgatttttttctattactatgatgattaaatattacattaattaattcttgaatattagaacaacctggaattactaggacaaactctacttggtcataatgcattattctttttatgtgcagctaggtttgatttgctaatattttgttaaagatttttgcattatttgtgagagatacttgtctttaatttgtttttttttgtaaaatctttctaaagttttgatattagtgtttggctagtatcataaaacaagcagaggggtaaacccctcttcctcttttttaggacaaagtttggtgttattttttcttgagtaattccctaatgaaactgtccaggcattgagttttctttttgggaatattttttgataagagatttaatttctctggttgatacaaggctattcagattttcttctttttgtttcaattttgatgagttgtgtgtttcaagaaatttgtcccttcatgtaagttgtgacatttgttggccttatgttatcaatgatatattctctttatctttttaatgtctgtaggatctttggtgatgatttcattcttgatattggtgatatgtgtattttctctatttttcgttcgtttaggtgtttcaatactgttgatctttccaaagaatctgcttttggctcttgttgattttctattgtctgttttctgttttgttgctttttttctttattattattttttcccttatttgttttgttgttctttttgtagcttattaagatataaccttgggttattgattttatatcttcttttctaatgtaagcatttaaagctgtaagttttcctttaagtactaatttagctatatgccacatatttagatatgtttttagtgtttttaagttcagagtatatttaatgtccccctttaaaactgagatataggctgcacacagtggctcatacctgtaatcccagcacttaggaagaccaaggcaggaggatcacttgagaccaggagttcaagaccagcccaggcaccatagcaaaactttgtctctacaaaaaataaaaaaattaactgggcatacctgtgatcccagttactctgggggctgaggtgggaggctcacttgagcccaggaggtcaaggttgcagtgagctgtgattgtgtcagtgcactccagcctgggtgacagagcaagaccgggtctcaaaaaaataaaaaaacagataaaattgagatgtaattcacatattataaagttcaccattttaaagtgtacagttcatatgtttttagtattattcagtcatcatcattatctgattccagaacattttcatcaatccataaatatctcttgatttttatcttcgaatgataagttacttagcaaagtgttatttaatttgcaggtatttgggggtttcatagatatcttgttattgatttctaatttaatttcctatagtcagagaagacactttgtatgatttcagtccctttagatttgttgagatttattttgagatccagcctgtggtctatattgttgaatatatcacgtgcactgggaaggaatatgtattaagcagttgtttgaggtagtgttctgtagatattatttatatgaaggtggttgataatgttgttcagatcttttgtgttcatattgatttttgggggttctagttctctaaattcctaagagaggaatggtaagatctcctactatgattctgaaattgcctcttgctcctttaaattctatcaatttttgctttattttggtatgcattttgagtctctgttgttaagtgtattcacatttataataatattttctcatgaattgtcccttttatcattatgaactatctctctttatctattgtaatgccatgtgtcttaaaatctattttatctgatattaaaatagttactgtagccttcttctgtttactatttggatattacatctttttttgagttggtgtcttactctgtcacccaggctggagtgcaatggtatgatctcggctcactgagacctcgacctcctgggttcaagtgattctcctgcctcagcctcccgagtagctgggatttcaggcgctcaccaccacacccggctaatttttgtatttctaatagagacggggtttcgccatgttggttaggttggtcttgaactcctgacctcaagtgatccacccaccttggcctcccaaagtgctggggttacaggtgtgagataccacgcccagccctggatagtacatcttttaacatccattcgctttcaacctatatatgtctttatatttaaagtgttttttttttctcttttttgaagttgggtcttgtgtgttgtccaggctggtcttaaactcctgggttcaagtgatcctgccaaatagttggacttaaaggcacatgccaccatgcccagttctttgaagtgtttcttctagacaacatatagtagggtcttgcttttttactcattctgccaagctctgctttttaactgaaatgcttaggccattaacatttaatataattattgatgtatttgaatttaggcctaatatttcatttattttcttttcatttctcctatttattattcctctgttccttctgtcctctctccttttgtattatctagatacattaagtattctacttttatttagattttttggggggcttatctatgtgtatttctagtgacttctctaaggattacaacatacatatctaatcttttatagtcttctttgagttgataattgcacttaacgtaaaatttagaaccctttcaaccatacaagtcccttttctcctcccccacctatatgttattttcatatttatcacatcaacacacattacaaaacccacaaagcagtgtttgtttttgcttcaaattatcatatgaatttcaaagaacttaaatatttacccagatatttaccatttctcttgcttgctcttcgttctggaaaaatctctgtttacccatgggaaatttccctatagcctaaagaaattcctatagcatttcctgtagcgagatctgttggctgtgaattctcttgtttttccctcttttgaaatttctgttttatttaccttcattcctgaaggatatgtttattggatagagaattctgggttgacagtaattttcttccagtactttaaagatgtctactgttttcttgtttccgtgggttctgatgagaaacctctcttcactttagctatcattctcctgtgtgtaacatgccatttttctctagatgctttggagatttttttttcattggttttcagcagttttggtatgatgtgtctaggagggcttttctttgagtttattctctatgtagatgctgattttgaatctatatttatatctttcaacaaatttgggaaattttcagccattatttcttcaaatattttttttctgctcccatccctttctcctgttcttctcggactccagttacatattagacctactgttattgttccttgtgtccttggcaatctttctttctttgaaatcctttttcccctgtatgttctctagaacacacagatagatctgtaatttctacagatctatatttattttgaagttcactaattcctttgtcattgcttttctgatgttgagcccatcagtaaatttcttatttcggacattatatttttctgttataaaatttgtttggtttctttttaaaaattgtttccacttctctgggagaattcttttctctcattcatttcacgtgtatttttctttccctcatgggacatggttataatagctattttaaaattccagccaggtatggtggctcatgcctataatcccagcactttgggaggccgaggcaggtggaagcacttgaggtcaggagctcgagaccagcctgaccaacatggtgaaaccctgtctgtactaaaattataaaaatgagctgggcgtggtggtgcatgcctgtaatcccagctacttgggaggttgaagcaggagaatcacttgaacccaggaggcagaggttgcagtgagctgagattgcaccactgcactccagcctgggcaacagagtgagaatttgtctcaaaaaataaaaaattaaaaaaatattccaatatatgggtcacttgggattggcaccttttgactatcttttcctttgagaattggacacatcttatggatatgtttgtatgctgtatgttaagtaattttggtttgtattctgcacatatgaatgaaattcatgaaattaagccttctggaggatattgatatttttgtctcagcatgtaatcagcctgtttaggttctgaccctgagttctgtcttgctttctgtaggtggtagtttaactctcagttcagtatgctaagcctttgttacactggtttgtgtctgtttcatgcacgtacacttcaggggttaggctgcgacttgcgtaagttcatatacaaaattaggggatttacttttttgacactctctgctatgggattccatccacactttacctaccctataggggctcctttctctggttcctttgggggaaataatatctattgcagttttagctgtgactgagactgaggtgcaccccatgactgggacttttccttcgggcaaagctttaccaggatattcatgacttgtgtgtgtagcttctctaggttttaaatctccacaagcggcttgctttcgtttacttttcagcatccactggtagttgttttttgtccagagttttcagctgtaattagcaggaaggatgggctatagagggctaatactgtcatagtagaactgaaaccccagttacttaatttttaatcaagggttggtgggagtcatagatttggatttgagtcctacctctgctgttcacagtctaccattttaatattaagcccgtgtttcttcatttgggaaaaaaattgagatactagaacttgctccacctgtccctaggattgtgtggaacagatgagataatggatgtcaatgtcttctgtaaacggaaaaattgttttcaagtggttgtcattgctgttatgtctatgtgcacgtgtgtgcatgcctgtgggcatgtgtacatggtttctgcacaattacctccacagcagtggtgtcaccatggatttttcctcttcaggcacttcctggacctcactactacacatggggagaccacggcggaatcatcacggctattgcccagggcatggaaaccaacgagctaaagtaagtgtctctgatgaggccttttaacatcaaactttctcccagaaatttacgtctgtgattataattggattatctctctatagcactatgttgttgacagcacaatttgtgatctctggatatgagttaaacttttttttttttttttgagatggagtcttgctctctcccccaggcaggaatacaatggtgcgatctcagctcactgcaacctccacctcctgggttgaagcgattctcctgcctcagcctcctgagtctgggattacaggcacctgccaccacgtccggctaatttttgtaattttagtagagacacggttttaccatgttgatcaggctagtctcgaacccctgacctcaggtgatccacctgcttcggcctcccaaaatgcttggattacaggtgtgagccactgtgcccaccccgatttaaactctttatctcccaaatgggaatataagaacctgtcctttctatcacaaagggagattgtgagcaagagggcaattaataataatggccaaataattaagtggaggctctttaatttgtccttctttgctttgtgtctttattacatagaaagactaataataaatagcaataataataataataatacatcagtaacaattacagaatgcatacaacttgatagccattgacttttggtgcgttaggttggtggggggtctcatggagctggaaggggtgtttagggttaactgcatcatttcacagatgagaaaacaggctcagcaaggcaaagtaacttgcccagggtcattccctttgttagtgacagagacaggattagcacttgggtttttcgattgcgtcctacattctttgcaatatattgttctgaaaagcaaaactgtcaagagtttgtaacctctacacccttatgttctgattttatcagaaccagtcctctgattacctttggctcgtttctgaatggttcatgttaggtcaagttcatgctggaccacacttctccctgtttttgagctgaacccattagatggattggtgaaggatctggagagggcttctgtaactctcttgtttattgcaaggacaaagctttctttttctttgctccttttagaaacggggccagcagtaagtgagaggtgggtggtttggaaaaagagatcttagcagctgtttttttttccctgtggttaatttgacatgtgctgagcagcctggcctcagagaaggagagagaagcaaagtactggtgtttggcattccacctggctgttctctgttctgtgtagcactggttagctatttctttagaggtgatactccgaagaggtcctgtttgtgtgcaacactctgtattcatattcagattggtgtttgctcagacaacgaccatcacagagcacagtacttcccacatttgtgctatcatttatatacccattaatttaattttcatttcacatgttcaccaagcaccgattgtgccagatgctgtgtatctgtagatgaataggatgcctgccaccctgtagttgaaaggtgggcgacgaaacaattgtagtgtttggtatactgctatgtgtgtaatacgcacgtaggggacatagtttggcttcctaggaatacatttcattctttgtatggctttcagatttcagagtcagttctcgatttgccttgtttaacttctctgaaaattaaatttgcattccaaactggctcctctgaaggagttagtgtgattctagtcctcttacaccatctgtcggtgcatatgtgctcagggaacgcagcgtcattctgcacgagctggagcaaaacatgatcaggaaaataaacttgctgccagaaaatcataaagccttccccagacattttgaaatgacttgggggttgtagactttgggggattatggtcactgtagcattcctctatttgtataggtttcatttggaggtgtctgtttgaatagttcaaataaagcatttgaaaatacgaaaatacatacaagcctcctattgacaggtgcatgtgtcccacataacaacctgagcttggcctaaatctgtgtagccacctggcatttactcagtgtgttgttcacagaggtattttgcttcttcccctgctgctctgaaaagcaagaaataatattcaagttagttgatattctcagactacaatggtgatttactgtgacacccatgcacaaggacaggtggcttctgacaagactggatatctgttgctgggctagggcctcaggccccttctaagtttggcctccccagtcacagagatctcttttcctttatgactcgtagcatgtataggctgtcccattcatttggcattgatcatattctgactccttatgttagttacctttacatgatgcgcctgaattctgcaactcgttagtaaggtctttgtaggtaaatatttctgctcgatgtaggttaccaggcacttagcaaatatttgattgaaataggtcatgcatacttaatcatccaagattgcttatggtttttttttttttaactgatttataaaactagaggagaccgagctagtgtgccaattgcacagctccaaggggaccactgccactgtgctccatgtcaatgacaacccctagagcacagatgtgagtggaggctccctggatgtgtgcaacccggtagtacccaagagacaccagagatgacctaatctactttccttagttttcacatgagggaataagagattagtcaggagttaatgcccacactggaacttgagcatatttctgttaggaatcatttcaggtccattacacagacaactgtcgaacatctacaatgaagcggatgctgtgctggataccaaggatgcaaaggcaagtggggcactgatcgggagctgcctgtgcccactgtggctctgtgatgtttctgagccagatgcagagagagaggctgggaggagggggttgtttgaaagagggctttctgctctgattttactcatctttagggagggaagccaagtaaagtagcattagtaactcaaataggttgtagtggggacagcaattgaagcattgctcaaagtaaacattagggttttttttttttttggtcgatgttcttttaagttatgcatgtctttctctccctgattagcacagatatctaggagttgactgttatttgtttcagcttctgccttgagtctcctctgagactgttacctttgttattgttaattgaaattgagagcaagaagtggaacactttgttttgctcttgtgtctacatgtctgaaatgggtaaataagaacctgcactggggatccacttattcgttcattcagcccgctgctcctgtgaacctgctcacgggaggcataggagcagtggctttttcgtcagagaaggggctgttgcatttttgcaccctgaccgaagaagattcaaacacgtttgtcagcttgatcacggaagagaagatcaatttctgtttcttcgctgcggtttgcttgtcagcatgatgatatttttcgtagtcagtaataatattttgaacttgccccaaagcatcttttttttctaagacatccaatttcataggggcttctctctggaaatcctgaaaagcccctgaaaagactccacgcagcagagcagctgtcttttctggacctgggctctggaagcagccccacagttccagaatgtgggaggcagtggttaatgtcttcacttgcttgcagcgcctctcaatggtacagttgtcgggagagccacccctactttatcctaacccctgtggtttttctgccccttgaggtatagagaagcaggtgttcttatcactgtgtttttttttttttttttttctggagttcagtggtgcgatctcggctcactgcaacctcctcttcccagactcaagcggtcctcccatctcagcctcccagtagctgggaccacgggcaggagccaccatgcctggctaatttttatatctttttttttttttggtagagacaggtttcgccatgttgcccaggttgttctcatttgaactcctgagttcaaagtgatccacctgccttcctaagtgttgggattacaggtgtcagccaccaagcttggtctttatcaccttttaactgttaagaaaccgagaaacggagttgcagtgcagtttctttaacttccttcaacaagcgtttatgaataatgccctttctgtgtgctaggaaagattcgaggtgccaggggcagaaaagtaagaggtcttattcctgatgaacggcaatccagtagaaaacactcgcaaaatcaagtcactgaaatacagtgaggtataagattatggagagcgctgggtgcggtgggagccagaatgagggccaggtgatgctatctgggggacaaaggaggacttctgagagaggaaaccccagctgaacctaaaaggatacaaagcaaggtcggaatgcttttccaggtctagagagaccttgagcaagggccaaagcatgatcagtggggaatgtgcacggctcttgagtattaatagaatgcaaatttccaggtgggaagtagtgagaaacgaggctggaggaaggtatctatgtagaggccaggtcctgggggacctcacctgtgccttactaaagagattaaagtttgctttgaggtgatagggtccctttgaaggattttagtaggggaatgacatggctagacttgcattatagaatgatggatctggcagaatggagaggatggattcagtggagagagactggaggtgagagctgatgctggggtgtgtttgaggactaagtctgcagggcatggtttctgattcacctgggatgatgggagaagtgattataccgctcatagaaaggcagaggtaaaggagtaggcttgcagggctgtatattaaatgcagacatggacaggttgaattgaagcctctgttgtgggtccaaggggcgatgtccagcaggaatctggacatattacaatatctggtgcagccttccgccaccctttgcaagaattttctccgtgccatctgtgatagacaatcttttgttctatacttgaacatttctattaatggggaatttgccatatcaaaaggtgcttccattttactttgggacagtttgctgttcatttgttcactaattcatttgtgaattaaagttctctggtaagggagagcccagattctcctccctccagcttctattcgtggactttgttctgctccctggagatgcacagtagatacttccttttgcatgaaagcctttcaagtatttaaggaccctgtcatgttctcctgagtgtctgccatttcatgatgaatatcctcggttcctttcctcatattctatagatcctcaatctctatcttctaggttctcccttaggtctgcctcacgatgtcagtgccttaaaatgtggtacctggatctggccccaatagcctgaaacatgcagaagatgttgagattttgtcttcatgattctgaacactctgtatctattaataaaaacctctgacagtgtttccatttttaacagccatctcaaactggtggctcctatttttttttttttgagaggaggtatcatttgcataccacaggatgctcagatattgactacaccatttaatcagttctgaagggtgcatgtcaagatgtagagtatttccatcagtccagaaaatactcacgtgcccctttccagtcagtgctctccacccccaaacccctgccccaattacaggcaaccactggtatgtttatcactgtagctgcctattccagaatttcatgtttgtatgttttgtatttggcttcttttactcagcataatgattttgagatttatcaatcttttaactggtatcagtaggctgagttcactttaactaaaatacctgagatccttctttcttatggatcttattatacaatcaatcaatcaacaggacggatgttccccgtcctgtatttgagcaaacaggtttttgaaactacatgtggagctttatttttatttttgcttatttttttttggtttgaattgtatttttggcatttatttatttttttgagacagagtctcactctgtcgcttaggctggagcacagtggtgccatcttggctcactgcaacctccgcctcccaggttcaagcgattctcctgcctcagcctcccgagtagctgggattacaggcatgcaccaccacgcccagctaatttttatatttttagtagaggcggggtttcaccttgttggtcaggctggtctcgatttcttgaccttgtgacccgcccgcctcagcctcccaaagtgctgggattacaggcgtgagcctctgtgcctggccccggcatttattatattatttatacaattagccttttaccctttgcaaatttggcagattcgccttccagatccctatccagatcattgacagatgtgttgagctctgtgagaactagaagtcttatcttgggttgagatcaaaccatacgtcagcactcttgggatgtgcttattttaccatcagtgaattttatctgactgcgtggtccacaaagatcttcatgaaaaaaagaatgttctgtgtcattgtcctgtttttcaaatcaagaattaccacgaggaaaggaaatggagttagtctgttgtgacttgtgtgtgaaaccatttgggttcttagccttgacctccttttcgtctgagtgctctcaaataaactgtttcataatccattcttgaaaccaccttttcttcattaaggaaataaaagtattttccctattctagtttttgagatctttgttcttcataattctcctagagattattgaaaaggatgctataatcatcctatctttaagtctttcagttccttagaatttattttgtactgattttcctttaacttaaatggtttttcttgtccaatttgaagattattttccttgataaagataaaagcaaaatagaattttttttctattttttttagacccagctttactactatgttgttattcaaagatttttttctttttttttactaacgaagtctttatttcttttgttttcagctttccaatcagccagaaaacataaagtattttcaattcaaagttctagtaaagataggaagaactgggtgatggttttcataaatgaatgaatgaatgaacgaatggatgaatgtgtatcaagtgctctgtttttttaaattgatacatatgattatgtctgctattatttattctattggccatcagagcaatgatcctattcctttctaattctttatagaacttgccagataaccaatccactgacccaccagtctgccaattattttggtaatttgaaacataaaccttgattcattttgaacttatcttgctactattccaacagactactggctatgagaattacagctggaattagctagcagtaactgaatttgttgctcttggttatatgaccttttttcccatcttgaatatgttctttagaaacctgaactcatcaggaacttttctgggtagctgcctgctagagtcctaagttgggtatctaccacacttcttccttttagagtatctgtggttatattatgttttattattatattatctgaccttcccatcttcttgagagtttttggccctgggattatgtctatatttttatctgaacagtttgatttcttcattcctaaaggctagtgccctatatcctctttcataacttaagaatgcaaagatgggccagacgcggtggctcacgcctgtaatcccagcactctgggaggctgaggtgggtggatcatttgatgtcaggagtttgagaccagcctggccaacaaggtgaaatcctatctctactaaaaatacaaaaaaaaaaaaaagaatgcaaagatgactttgtttcttcacaaggttcttgtcacttacttttaccaatacaagttctcctttgggggtcagaattcagtccaaaatgcgtgttctcttaactgttgctgttgataagacaagagccttttccccaaaattctgaagagcaccattttctaaatgagcagtgtattttcagatacaagctatgcttggtcatgtacctgcttgttatttcattaatgagttattgtcagagtcctctgggaactctcaagaaatggggtgattcatttcctgaggttatgttgggttcgaggagctcttaaagagaattaacttggcaacgtacacatagatagactttagcattaccactgagtgggcagatggctgccatcatgtctggataataggttgactctgttggttcagtttgctttaaaagtaatataaacctttagcttcacactggttacaagaaggagactgaatgagttaatttatccaaatatctgtttcaaaattttcttaaaccaaaagcatatctgccaggtgagatttctccccttgtgagagatttgtagggggagattacttagtctcccattgacatttattattctgccttgtaaccctaccagttggtttaacccctagcctttttgtagcagtatcttttttttttttttttaaggcagggtctcgctctgtcatccaggtgggactgcagtggtgcagtcatggcacactgcagcctcacactcttggactcaagcaatcctcacacctcagcctccagagaagtagctgggaccacagggggcaccaccacacgtgactaattttttaaaaaaattttctgtagagatgtggttctcattatgtttctcaggctggtctcaaactcctggcctcaaaagatccttctgccttggcctcccaaagtgctgggattacaggcatgtgccaccacgcctagccaaatcgattttaataatctcaatatgagatgaagtgtttggatagaatgatgtcacgaaaagatttctgtcaaggattagaatcccaaaggtgtaaaactaaaatctcaaaaacatgagaaaggtgaaagaaaaagttttgcatataatttggatttaagaaggacccagaagccctgtgattctaaagaaggcttgaattgagtgatttctcatgtcaagcgtctcaccagctcactgggtgataaaacaagtgttgggcagattttcttccttgcctccctctccgtccctcttctccttcttcgacaccaaagataatgtaaaatcagtgcagttactcaaatgctgcttagtttttcaagggctggcttcctgcttctgttatagtctgtcttggagactttcctcagtatatactttccttcaactttttactttttaatttctaagaccacgggaaagttggaaaaaccgtataacgaacacccatgaaaccttcacctagagtcacaaattgttagcatttgccggtttgctctacttctatcattggtctatttatctatcctgtgtatccatccattattttttagctgaatcattttaaagaaagttgcagacatcatgctccctcacagctacttaaatgtgtatctccaataaataagggcattttcctatataatcacaatgccattctcacacctaagaaaattaacatgaactcggtatgacttatagactatattttctcagttgtctcaaattatttatggccacttttccccttcaatccgggatttagccagtcctgaactaaatcctggattggatttacacattgcaaatttgtttagtcattgcatttggcttttatactcctttagtcttttaaaatctataacacattatctgccttttttctttatttatttggtttttgtggccttgatttttttttgaagaatctggagcagttatcgtgtagaatatcccacattttggatttgtccaattgtatagaatagtacacagaggatgtgttattctcaatgctttattcaggaggcacctaatatcaagttgtcctgctattgatgatgtttagttaagattgtgactctctgatcattcattgtaagattatgttttgtaaaattttatttccccatttgtagtgaatgatttgtctgttcagatcatctgaacatcctggccccaacactttcaccgaatggttttagcatccagtgatgatccttgtgtgatttagttattgcagtggggataatttttctgtaattatattatattatattataatatatatattgttgtgtccaacccttattaagtgccattctaatataagaaaaaaattgggggccagacacggtggctcatgactgtaatcccagcactttgggaggccgaggcaggcggatcacgaggtcaggaggtcgagatcatcctggctaacatggtgaaaccccgtctttactacaaatacaaatacaaaaaaaaaaaaaattagccgggtgtggtggcgggcacctatagtcccagctactcgggaggctgaggcaggagaatggcgtgaacccaggaggcagagcttgtagtgagccgagatcatgccactgcactccagcctgggtgacagagtgagactccatctcaaaaaaaaagaaaaaaaaaaagaaaaaaatttctcttttgctcctctgtcttttagtatcattagagacccatgtcctattttcattcaatgtgtaatctgttaccatcatttttcttttttatgtttgaattctcctaaattcggccagttggagccccatcaggctggttcctgtgttcttttgagatgactgcatttatttctgagcatttccttaaactttccctgccttagcccaggatcagccatttctccaaggagccctggttcctgttcctggtgaatgttatatggaaaccaagcctttgccttagagactttcactgcaaggattctcttacttgcatttgggcagatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggtaagctgctgcctccttggaccttttcacatggatatgcgtggacttcctgttatgtgcaaagcaccagcttagatactgtgtactcagaagagcctgacattcattgggggagatgggcccataagagttagcaaaaagcatagggaggtaattgaaggcctgctcaattcttcttagtaagactgggtgctattctttgtatcttagtttcctcatgcagttcctggcacataagaagtttaaatatatgtctgctgaatatgtagataaatgcatgaatgaaaaacatatttccaaatcagcagtgccaattggacgtattcagtgagtgtgcctgactgtctgtaagtcagtgtgccaagcgacacagggtcctctcaaagccatctaggatctagttgtgatctgctaatctagatacaggatgcataagtatgcagggagaagtgaaactcttcagcatcctctccctgcttccccatcttatcttaccctttcctacctctcagccttggctaacctgattctagctgcccggagtgccctgtttcttctcatttccacccgttcagcctcccctactcgaaatccttttcatatctcaggatccaacacatttgtggctgatatcccaaccagaagacgtctcccttcttctctatgtccagaacataagtgtatgcataactttgtgtctgtcactcggtgtgtttcaccttccattgactagattataaagcccttaaagataagaacttgccctgtgcatatttgtattgtacctactggaaagcctgatagcctaacagtctgtaggagtttaataagtttactgatttgcatggcattgagtcaaaggttgtgtatcagcttcgggtagtatctaatctgactgaagacacatatataagagacacaaagtgccaacatagacataggcatactttggaatgcttgtagaaagcaccctacttagacatttcgatgaacgtggcagatggagtgatggtgcaaggtatcttagcattttccagcctctttccatggagatcctgtaccttcaagtagggccagcgagccctccattgccttcgggccacactaccagatgtgccctcactgcctgaggaagcaggccaggaacattaacccccaatggtattgctcatcaaggattcagctgttccctagttctctaggagagaaacacttctgagtactcatttctaaagggcactgctgactcttctgtaatgtttcggaaatttggatagtgcctaaaggtggcttgcttctttccaacttttccaggcagatgcctgcgtttcaggtatccttttcattggcatagggctgcccagcttcaaaacaagctgattggagggtctgtgtgcttgcggggtggcaacagatagacaggaagtgggggttgaggccaggcaccttgaggcatagcaggaaaccctacatgggcctgcctctaatgcttcgtgctgtgttcctttttctttaggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtggtcagttcttctttgatggctggggactgagttgtgttttattcactcagcagtgttgggggaagagattaggcatggtccctttccctgagcaaaggaagggaatagaaggaaacaagtatttgtgaagcatcttttatgtgccaggaactgtgctaagcatgtttcatgtaagttgttttctttagttcttatagccaggtaatgcggtagaggtgtctaggagagctgcagctatttctacaggaatagatagctctgggatttatttctattagggtaacccaaaaatatgctgaaggtttcattgtttttaatccttctccttaggaccctattctagaggggatttatttctttatctgaaacgaggggatgttagtgtgtgtatatgtgtgtgtgtttgcatcatttattattccttaagcaaaatatccaaggcactgctgcgaatgctaaaagtaggagaagtgatttgtgcatggctaattggcacaggagatagaagagagcaagtgcctcagaggaggaactggtacttttattgtgactattgaaaggaaggagagggctgtggattgctgttggagaatgaggagatttttggaagaagtgctgtttgagctgggctctcagggagcatcaatatttgcagacagcagtgttttgagaccatgtgtctgcaacagtcaggtgtagaggcagcagggtgtggttgggagttgaattgggatgccttgttgggtgtatgacatggggatgacaattggagatgaggctgaaaagatagaatacagtaggggagaaagaccttagaggggatgaaccttattctataattaggaggaggccttcagcggcttttgaggagagttgatgatgagaacagagcttagctgtaggagcttttgaggagagttgatgatgagaacagagcttagctgtaggaagaggattctagtggcagagtacagaggatctcagagctcctggacagtcactgtagtctgtaattcagcatgaaatcattgtagtttagtcaggagcaccaagagagccatgggtatttaatataaatacacaactcatatttcagtggttgctgaggcacagaggaactagattttgctttgggcagctgtacttgtcttgactaaagccagaaacctctgatgtattctagaccagaggttggaacatggtcatatagtaaatgttttagactttgtaggccatatggtttctatgatctgtgttacaactcctcactttgcccatggcagtgcccatgggtgaatgaaagcagctctagaggaatgaacgtggctgtgatccagtaaatctctatttacaaaaatggccaaccaggtttggccacttctgttctcaaccagtgcttctgaaactttaaggtgcatatgaatcacttgcagattctgccttggtcacatgcagattctgcctcaggagttctggggctctgcgtttccatcaagctcccaagagatgtggatgctgcttatctgcacattcgccctttgagcagcaaggcttagaacagagaagacagtcatttccttagaaaggtgtgtgctcccaaggtaacgacacagactctttaacagcaaaagcacagggctggctgatgttcttggtgacttcagttccatgctgtttgccttctgctctttcttacacacttttgcattatagtctaatctaatctgagagctttgttggctccaggtagtcctccccagaccagcttgagactggagaggtcctaatccctgaaaagatcatagtgccctctctctcccctcttcctatccccaatatgtacttcaaaataaaattaagactaagtaaaaaataggtaagaaagtctaacaaatctttggggtttttttttttttcatgacatttaggcttaaaaacaaataacattaaaattttctctcttgccctacatttccccaaccctcaccaaaaaaaaaaaaaaaaaaaaaaaaaaaatcacacacacaagaaaagaaatggagcttggtgtgccctcctgggtaaactggcctgggacctgctggtctaccatgcccaccccatctgccttgctggaacctgctgtatgctcaccctgcttgtatgtggagtgtttttattgtagaccagtaaaaccacctgctctgccccttgtggagttgggttgcaggccaaatgagatcgtggggtgatgaccctctgaaatggtaaggggtatatggatgtcagctgttccccgctccacccctcccaattgtttctctgcttgctgtagctgctggaaggcagccagcccaactatatggctcttggagatgtttgatggcattggactatggcactgagaaggaaaatggtcccaagatggacgtcaggaaatgagatgagaatgagcaagcttatagtatctttccattagttcaggtactggttgacaactgtgtttgaacaccaggttatttctgatagtccttttagaccacactgggaagcccagctattggcccatgtttcctgatttccatggtagattcttttatgttcttatatttctcgacattgccaagtcatacagctttcacattcttgactgcaacccctagtaaataatacattttctcttatgaccctgtacttacatatgtacgtgtagatacatacacacatataattaaaacacaagttttaggagacaacattgacttttaaatgtatgatggggccttttgcaatcttttgcacttttttgggaggggaagaatctagtcttgggcctcccaagtactctcagagtccactaggtcatgacctatggtcaaagaaagctgcccaggaagagtgctttgctattggaggcaaataagtaattagctaatgctttatctggttcctaaaaagatttaaagtggccgttcagtaataacgaactgaggtaatgaaagaggcacatttgatacagtgacaaaactgctgccttttgaacaattcttacaaactattaaatgtggattatgatataatgcacacaaatcactctctgtgtatctgttaatactttttgtgtcagaaatgtttaatgaatatttggagtttttctttttgttttttgtttttctgagacagagtctcactctgtcacccatgctggagtgcagtggtgcaatcttggctcactgcaacctctgcctcccaagttcaagccattctcttgcctcagcctccagagtagctgggattacaggtgcgtgccaccatgcccaactgatttttgtatttttagtagagacggggttttgccatgttgcccaggctggtctagaactcctgacctcaagtgagccacccgcctcagcctcccaaaatgctgggattacaggcgtgagctaccatgccggacctaaatatttgttgaattgaatagagcaaataaatgtgttctggtagagcacatgaacgtggaatatatgttctgttctataattctttgaatatattctgtaattcattgaattatagaatttacaggtttggaagggccttagaacattcatagtacagtcacctcgttttagaatcgtcttcgactgaggcctcctgcttcctactccaggatgctgcccttcaagctgggaggtttggcagatgtgactccagatcacaagaggtctcatgaacctaactactgtatctcaaagtacagggtgacttagctagtatgtggatatactcttaaataacattgaacccctagtcaaattttttctttttttctgagacaggggcttgctctgttgcccaggctggagtgcagtggcgcaatcacggctcactacagccttgacctcctgggctcaaatgattctcccacctcagcctcccaagtagctgggaccacaggtgtgcagcaccatacctggctatttttttttattcttttttgtagagacagggtcttaccatgttgcccatgttggtctggagctcctgggcttaaacaatatgtctgccttggcctcccaaagtgttgggattacaggcgtgaaccaccatgcccggccccaaataattttttaaaaaggttattcttttaaaattcctcttttacttcttcagattctgtcaaaaagaacgtctcattggttgctagtaactgtaacatttgcctaatcccttttaacagagagggcaggtccagagtcttaaattgggaactggatctggctaaaatttaatactgttttgatttggcatgatgattttttttttttttggtctatttatggcatgtgattgtgtttttccaactgtggttctgatataaatcttcttttgaagatgtattttatataaaaagtaaatattctttaaagggacatgttaaataacttataataaaagtgaaaagtagtaaggtaaagtcagcagaattggtacaggaatgcctgaaatgtataaaaccgtggccttaacaaagcccaattgcctttttagtgacttcggtttcaagatgagtgaagatttgtcattagaggtttgtgttccagatccggaattttctggaaagtcatactcccctcctgtgccttgccctgtgggttctacttacaggagaacgagagggtatgtatcacagaggttgccctgtcaggttctcagcggtccgcacatggagcgagagagcatagaggaccgtctggattgctctacactcgaaattctagaattccaagttaacagcctgcaagtagtttgggcaacattataaattatggtatttgtaaactctcctacctccacattgcaagtctgtaagcatccctgaaactctaggaatatcttaagtcatcaacttcagcagggaaacatcttcagaggaatgtattcaagagatatatttaaaaatcttggccaggacagtgccctaaattgtctgggcctgcctagtctaattataaggagaactgactcagaactacgaacatcctctttctagttctaaagagaaatgagtggatggactctactggccgtgggtagtaagtgtattcccagctgggatgcctttgtggctattcttccatgtttctgacctcttgctcttggggtggggtgacagctaccggaagatttctggggacacttgtagcggaggagatgttgaagcgcgactggaaggagagctggtcccctgtcccctggcaggtaagagaggtggtttcttccctttcatttcttgagacatggttgaagcagtatcacgatctcacccaagtccgggcttgtggctcctttaattgagtggagaaaaacaatggccgtcacaagcatcacagggcttcctcttttccctaaggttggtttccacactgaacttgtacatagccatacccgtttttaggaatggaaagtactttgtgtcagctcagtttctttgagggaaatccctttgttaattgaaaaatatttattcagcatccactggggtagaaagatccccacaggcttttgtgtgttccttaatctgtttgtcaaagttgagtataaagaggtgtgtgacttcttaggaagtagctaagtagtctatgttaattttataataaaactaactgtaactaaaattttaatggaattttatagatttcagtgtactttttatgtgttgccagtttaacccttttaacaactcagggaagcagatattatcaattttgttttttactttttcacgaggaagcatgttcagaggaggttaaatggcttaaggtcacacatctagtaagtgacaaagttgaaattcagactctaagccccatgctcttcattggacattgcccaaatggcaaataaatatcattctcactattttagataatcattatgcatgctaattaagaaaaacttctctgaaatgattcacatgctataaaggtatagtgtgttctaaaacacgtttctgctagatttagtggtgatgtaacatggggtctttaccacagagacatgaaattatgatactttgaaaaataatctcttagttgcttttcttcactctgtttccagttcttattcatttaaagcttctttattccctctgtgccctctttcctgcccattacctcttggtgaaggtaaatggctggagttaacttccgtctgtggtgggtggtggtgtcttacgtggacagccataagcaccgaatgaatcatgaaagaagtgtgtggtctccacaggcagggcagggcagccctctcttttgctcactgccgccagcttgccctggtgtttttcatgctaagttcgttagtcccttaatttaatctttcatcattaccagagtaattaacatacctcactatggaggcttgaaaagaaccaccacttcagcaaattccaacaaatgagcagataatattcaaatatttccctcacaagagctgttattgatgagggcgtgggttagtagggtttgagtgattgctcttgaggggctggagtgcctacttttgtaataaatatttctgaagataattcagcaagggacaaaacagtttgtttaaagccatctaaactggcaggaaagctattttctcttctactggaagatagaacagggaacgaagtggagaaatctcattccattgtgggccacctcctatgtaaaagagagaaaaaaaaaggcatggaataggaggcagggatataccaggaaagaaaaagatgctttcacaggactaatgggggccgtaatatctttgcaaagatgaggtaatctgggcatctggaaggattttttaaatgcaagaatttttcttcctttacaattactatgaaaacacacattccttggccaggaccagccaagaattccattccttttccaggttaagcattgcgcgctggaatgccgcatgctgctctgaacataatcctaaaacacgtatttctggattcaggttctactttatgggtattagtttcttagaggaaaaaaaagcccagagtgacagaatgaggtttatagatgctggagagagatgtggggcaaaagccttgctgctgcaaatgtagctttcatgtccctataccttagctggccccctccctgggaatgacagcgggaaggtttccttgacaaccaaaaggggaggtaggttaccatgtgatggtaacatagatacttctaaagtgacctggaaccaaaggaaaagaaggaaaacttaccttattaaaaattgtaggtagatttattttttgatgcattatctatattacagcttttataaagaaggtgagtggtacatgttaagtcactgagtgtatggaatcaggaagtgggcaggaatggctaacccaggcatgcagcaaaagaattccgatttgcatcttggtcccatatgcaacacactgtcaagatgcacactttagacacagatgctggtgtgctgcttgtgtccactcctggggaagaatctggatgtttcccaagccgttccctaagtggacaagacagtgtactgggtcttcctatttccagttgtctgacattaggtaagtatcttcagcactcaggaccttcatttctacatcttaaaaatcatccacggtagcgtctgtatcataacaggcagcacagtgtagtggttaaagcatagactctggatccagagtgcctgggttccaatcttggttctgccacttgctagttgtgtgaccttgggtgagttacttaacctctctggtctcagttttctcatttgtaaaatttggttaacaagagttctaccatcaggcagttgttgtgggtcttaaacaatacccgatacgtagtaagcacattatacacaatatgtacacaatttatatttgttgagtagaaacagaatttttgtggtgattatgttgtggaacattttgtaaatagccaagaacaaatgcattattagtattattttggagatctaagaggttcatagaattgccatatggtgttgtgaacaatatgaataagtgagcaaattgattagagagcttagttacaaagcttcagtgactaatggtctctcgtcaacaagatgatgatgctgtggtgatacagtcacgtgaggagggagaacagggcgattggtgtaattaggttggcaagtgtgacttgaagactggcaggcttagcccagaagtatggttgttgaagcatgcatattgggagatttagaataaagaaaaacataacaagtaaaacacttgcagatgaagaaacagattcactggagtttaagtaacttgcctgaggcagaaatgtgattccattacacacctcctgagtcttgatttctgtgctcttcacttggtccacaccacatgccaatgaatttgaggtttgtgtatgagaaacaaataggtcagatgtgctaggacctcttcagcatcccctgggtccaacctcccacgtgtcttgtgtgtctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccaggtgagtcagcgcttggtctgactgtgggagctgtgcatcgtgactgccctgtcctgataagctgcatgcagaatggcctatggaaatgggcagttagaagtttgtaagtgttactcatctcagggctgacaggtgaaagtttccagtcttctgtgttagtatttttctttctctgtcttcatctgttcatataggaaggataaagaaagccctaaatccacagacctgcttgaaagtgaggtcttgcttttcctgctgggaaggtgttgggactagtaatgtaggatgattagttgcccccctattgtgccaactgcctcttgagcatctttcttcccaagccatgatacagtaacacttgacttacccatagctcacataattatccacttcagctgttctgaacacaggtaagaaccaggaagtaagcattaaagagccctggacaggccaggtggatagccatacgctcacacccatgcatttaaaggagagctctttgatctttattcattgtctacttaatccttttagaaaagcaattccaacaaatttttatctagattccaacccaacagaaatttcacagtgcctgggtatttgaggggcttggggtgggggatggcggtgatgctgaatggagctgtccaacaatagcacttgatggctaagagcctcacagggaagaaagagtataaaagcagacacaagaactgaaatgtaacagcagtctggtttcacttattttaaaagcaaacagactcatacaatctcagtaatctctgactttattattgccatacagcataatttagtaaccagtgttcataatgataatgcagagtaatatatatgattaaattctctttattctgctttaaaaaacaaaaatgtagtatattttagaaatgctttcatgaaaacctggcttcatgtgtctggaaagtttactaacgtaaaacatctcatcccttgccagtcctgccagttgaataaagggttacccttcatgggactgacttggcagggggtcgtttgaacagttcctagcatttattattacttttctctcttaagcgcctctgtttgaatggaagcacagggcaagaggtgatcatcaattctggcctggagacagtagaagctttggcttttgaacccctcagccagctgctttactgggtagatgcaggcttcaaaaagattgaggtatgtgtattttcgtgctgttcttaattaagggagcaggcggggcacctgggctttgagccacatttgacacagaggcaagggccagtgtgtcagattactcaggaaatttactgcgagtttccagagaatggaccagctgagcctctggagaggagagaaaagggggtaagtacctgtgagttgatcttttggctagcagaagcttagctaataacaataaatggtaatatttttattttatttatatatgtacttacttattttatttatatattatttttgttttattttactacttttattaaacatgatggcaaaaactacaatcacttttgcatcagcctaatatcatggtattattataatgctataacaataatcgtctagtattattttattcgattagagtgatagcaacaatatcatcatcatcatcatcattgccactgttattaatccccatttctctgcaacttagctacctagtaacctgtcccaccttatatacccaaggcaaggatgatgagtgacctctaaactgccaaatctttgtctgggggaatgtagtgtgctcagctcactgcctcagcacctctttatactgactctgcatggagagacggcatgtgggtgaagtgggaagtgcagtagaagcagggagatgcagagggctaagaggagttgcaagacgaaagacacagactcgagagatagacccagatgtaggcttgactccactagctcagcgacatggggcaaggtgcttatgctttctaaacttcagttgcttcatgcgttagatggagattcatatattcgcacaaccatttgacaggggttctctgcatgatacatgtggtttaggttctgatgataaagcagtgggcaggacacacacgttcttgttccagtagagcttagattttagtggaggaagcaaaataataaatcagttctgttggtggtacatgctgcaaagactctgaagcagtgcagtgtgattgcgcttttggagagtggggcaacattagaataggcagacagagcaggcaacttgaggttgatgtcttagctgagccctggctgagaagaggatgatcttttgtccacctcctggggatgctgatagaagtgaactggcatctactgaatgctgcctcggtggttatgttattgctctttctctcctttctttaattgcgtgtggtcagcacttggctaggggctaaaagaatgcaggtgatgcacaagcacccaccttttcacaggctgtggggcgaccactgcacaactcaaatactgttggtgcaaaatggtgtcagatgagccaaggtgcagagctactgatgcttattggtccaggtgggtcagaagagttaggaaagtaggcaggcctggcagtgaggtttgaaggagagttatgccttgattagattaagcagtggggcaggtaggcccaggatgggatgtggcaagagcagacagcagtgagtccgcatcaggcttggagaagcaagagatgaccagcctggctgacgggaaggagcaagaatatgagtcccacctgtggactcttcattgcaaggctgtgacattgagaatttgttttatgggagtgtggagtcatcgattgccttggaacgtggagtgacacgggatggtgaaataagtaaatgctcatttgcttatttacttatttgagtaatttacttattgatactgctttgtccagatcatcatgccctggaaactggggcttacatggttctagctcctctttcagaccacttgaaaattgtcccatgagtcagaggaaggaacagcgcattgtgactagaagttggggcaggtttcgcagatgggtcaggtcagggaaataggcaggcatggagggggcatgtctgtagcagaagctgagtagccatctttggcaatgggggtctttaaggagctccgatccatctcagcctcttttccccctgtttttgtcaggtagctaatccagatggcgacttccgactcacaatcgtcaattcctctgtgcttgatcgtcccagggctctggtcctcgtgccccaagaggggtaagtgttgccccaaaaggaaatcagtcttgcgtccaatgctacactaatagattctcatggaaacacagactgcgggacaaaaactctgtttctcatgatggtggttgaaatggtctattaactgagaagtttgagaccacagcttagtcatcgtggtcaggtaactccgttcgctttttgttagccagtgtcagagtctctttaggcatccagatgtcttgcatctgtgggttgtttctctagaaaagttgatgttaaaagagagcttctgtagacatagacaggcctgcttggatattgtgagaactttctcttgagtttcatgcatggtacaaacatttaattcattccatctttcccctgccttcccagcatgtgtaggttttcttacgtacaatcagtgtgcacttggggaaggcaaaggtgctttttattaactcattaactgaaggaaacataattaagagggaaattctggatttgacattctggcttttcctctctcgtagcatttatgatagagaattggcacaatttttttcaaggaaaattctaagagtaatgtatgtacttggttgacaatatttagagagaacagcactttatgaaaaaaatttgcattcttccttttcattcttaaccctttaccctcacacttcctagtggtaatcattgttaataatgtcttgtgtatctttcatgattgcttttacttatgtacaagtattatctttaaaacacacacatatacacacacatgcacgccaaataggattgtagtgtagttactattctgtacctttttaaacaaacttaatatgtattgaaaatagttctgtgtgagcatatatagatttttaggtttcacagtattctattatatgtaccataatgtgtcacttcctctgctgattaacatttagtttaatatacatacatatacatttctttgtatattatctttgcataatttgattttatctatagataaattctagtaaaggaatttccaggtgaaggaatttaagtagtttcaggtgttgtcattacatattgttataataatgctgaaataaccagccggatcattcgaaaggagtttctgaccttttctggagtagtatttgagctcccatttctctagtattgatgaggtatgtgttctgtccccattttcgctagggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaaggtgagtccatttgttgctgccggacagtctgctagagcgggtgaggagcatatgagatcaggagcctgcatccctgggctttgcagagaagctgtttaacttcttaaaggttgccttttttccaaatttgagataacttattttcagcctatggagggatgccaggcagaggcgccaagggtccaggctcccctgctgttcacatttcaaaaggttaaaagtgaaggctcttcccatgaacattcccagtttgcccctcagtgtcagtagcctcatttcagggtggtgtcttcattttttgtgcgctttgctcactttattctctgatgacttccggtgagctctgcaccacctatagtgccttgcagttctttttcgactctggagagcaacatggctcttcccaactctgggaaacagatttcaaactgagggggttgggtttgtgtcataaacttgaatgcttatcagatagtttcttttgggcagtttcttctgtggggttatatggtgaggtttggataaaattgctgtcctttgcatttaagtagaatcttgatcaggctagtcattcagccaataaatgttagttgtctcctgcctgggggaactcttacccttagagagaaccagaataaagaacgaaagagctggactaatgggcaaaggttttctttttagaatgaaatctactgggatgactggtcacagctcagcatattccgagcttccaaatacagtgggtcccagatggagattctggcaaaccagctcacggggctcatggacatgaagattttctacaaggggaagaacactggtaagccagagtctcttcttttgtctctgtagagttgatctcaagaaaggggctgcgtgtggccaatctctgctcagagtaggagctggcagcctgcatctttgttgtcacgacaacatgcacattatttaatttcttcctaatgacatcttaatttcttttctaatgatacacaaacagctggaagacagcatgcttttgcctgcctagagtgttggtgcttggtgggtaattacaccctcctcctgcccttggcccctgactgattggtggcgcggcttctgttgcagctgggagagtcctaacatgtgcttaatccctgtttggcatgcttgcaggaagagactctgtgctgggtgctcagatagttgttgcttcctgacagggcctcttgcttgttctctggttgcccagatgacctattgctcattgaccgtacctacctctgctggaatggcactgtgtagttaggtgttgttttaattaacttttcccaccatgaaaccctaaaccccatgaagaaagagatggtcttttttattccccgatagttttaccagtgtctagcactttgtaggtgctcaattcatatttgttgaaagaataagggatgaaaagggaggggaagaattgcagtgggtgcagacagtagctgtcttagagatctactgggtgaggcttcaagaactgctatgaggctttgacctgctagtcctggagtctgagactattcagtggaaagcctttatcatttcatgactgctctttgattttgcttatctcccagccatactattgattctagaggagaaagatcagaggattaccaggaagaatagtccctttaagaatttccctctttatctcagcaggattaaatggcatcctgggtttgctgattctcctttattgacaaactgctaagttttctgttcttaactggaatgttgatattgttttatggttcttggctgaccctatactaggagaaaattgacaggggaaataatactgttatagatatcattgttatcctcttgggattgtgaagatagcatgagaacaccctgggaaaactataaagtgtcttacaaatgtaagacgatattatttgttatgtcttcaccactgacctgtgaggtagggaaggctggtattatgatccatggtttatagattagggaattaaatctcagatatgaattagctttcccaaaatatcctcactagtttaggggctggccttttgttgcaattctgccgctaaatggagaagtcacattctttcttagaggaggcacctgttttagaatcaggagagttgaaggaatcttgcttctcagctccagtgactgaaatcttcagacctttgtttaatggaggacatccacccctactgatctgacttgctagctagcagagtggatttttagtatttctccaagtggatttttagcatttctccatgttaccacttagtccagaagagtgggtcttcatttttacaagtgcttgtatgcatgtgcttgtttgatttgcacacaggagcttctgaaacactgtgtgcagatgaagccagtggctacccggtcacaacttacttcccagtcttgactgtccacttcatcccaagaacttgggcacagctgacatgcagtcacacctgtgactgaggagcagtgcgggaggagagagtttgtggtctcagcacatgcaaacgtggtgtcttggtgccagtcagacaggtctgcaatcctcaccttaggtgtagtttccctttcatgcctcaaagagtcatcttcatttaagttagccagagtcattttggggcccagagtgaggtctggatagatgacaggctggtttaaaagggagatatgtattagcagggcatagtggcacatgcctgtagtctcagctcctcaggaggcggaggtgggagcatcacctgagctcgggaggttgaggctgcagttagccaaggtcgtgctgctgcactccatcctgggtgacagagtgagaccctgtcaccgaaaaaaaaaaaaaaaaaggctgggggagatctgtgttggtgagtagaacacagacctggacctgtgcatgggcggctgtgactgtccctttggccatggccagttgtcgcctctctgctcctttctgtttgcctttgggattttctcttgctgtcctttggttgtgagcaggatacttccaggagacctactgcctccaaacacagggctggagaaagacgtttttgtctttctctgcagcccagtttgggtcaaatcaaagcttttgcagtggtgtctggctgtcagcactgtctatgagcactccgcacctcttggccttgaacttgtttgctctaacctgcttgctttttttggacactgataggacacttgcttttttggacattgtattacagatccacggtgtgtgttggatctagcacttggagaaatgctaaaaatccactctgctagctagcaagtcagatcagtaggggtggatgtcctccatcaagcaagggcctgaatatttcagtcactggagctgagaagcaagattccttcaactctccttattttaaaacaggtgactcctctaagaaagaatgtgactcctgtccatctttattatttttgttgtctcctcctaacacattcgggactttctacagtagtctcctgcttatttgccattttgctttctgtgatttcagctacctgcggtcaaccactgtccaaaaatatatatggaagattccagaaataaacaatgtataagatttaaattgcttgctgttctgaatagtgtgatgaaatcttgtactgtctcctccctgtcccacctgggatgtgaatcctccctttgtccagcgtctcatgctgttgatgctgccggctcattagtccctttaggagccggctgggttatcagggtgtcaaagtactgcagttcttgtacgcaaggaacccttattttacttcatgatgaccctacacctcaagagtagtgattccagtaatttggatatgccaaagggaggttgtaaagtgcttcctttagggaaagggtgaaagttctagacttaataagggaggaaaaaaaatcttacaccgagtttgctaagatctgctgtaagaacgaaccttctatctctgaaattgtaaagaaagaaaaagaaattcatgcacagtataggtttggtcctatctgcagtttcaggtgtcagctaggggtcttggaattgggggttttggaataagaggggactactatattaaccaagtgttaaataataataattgatagtaactacatgtattgaggggttgctgtgttataagtaccacagtaatgtgctttgtgggcttgtataacctcacttcgtcttcccaaagacttctatatgtactatcaatatttccattttataggtgagaatatgaaagtctggtttagtaacttgtgtaggtcacacttttagtaagtggtaagaatttgcactgtggcccgttgacttcaaagcctgaacttcgataaaaccacccggctctgctccctctgtcatgtgttgctagaatagcagtgccctggtagtatgacagcagttcagaagtactgttctagattttgattgatgatggttcataataaaaatgttgttcagttgcaacatttatcaatttgaaatatttggtcctttatagctagctggtttttattttttatttgtttagttttttggagacagagtctcgttctgttaccccggctggagtgcagtgatgtgatcttggctcactgcaacctctgcctcctgggttcaagcaattctcatgcctcagcctcctaagtagctgggactaaaggcatgtgccaccatgcctggctaattttttgtattttagtagagattgggtttcaccatgttgcccaggctggtcttgaactcctgagctcaggcaatctgcacgccccggcctcccaaagtgctaggatttacaggtgtgagccactgtgtctggccactagctggtttttaaatggtataactggaatttattctttgtaaagtgtgttttttctttaaagaggttactttacaagattgttgatgtattcagttgctcctgcgatggctcttggagctttggaattcttttgcagttttggaattctcctttagagcctgcagtaagtatgtgcttttaagtatctataatgagggcacatatttattatttgaggtagatttgattttgataattgccaagtgtatagatacttgagatgatgacatttttggctcctaaagtattcctggaggaattttccaaacaggaaatgtgaaaatgttctgaacatgcccagtgaagacatcacggggctatgtgtttgatcttctaagggaatgtctttgaagatgattgtccactcttcacattgagataacggttttcatattgcctggtccactcaagacaattgtcatcctgtataaagggtctgtggctgtggtagaactgccatcataggagttggtgaattacccttccatcttcttccagcttctctctgatgcagctctcccattttccattctctggcttcagactagcctagacattcctgcccctgcctacctcttaggatcagtgacttggttagcttgttttgcagtttgcccctggttactgcctcagagtacagtttcatacatttctgcctagatcagcctcctgaaatatgataccccattttgagttctctactcttagctcttcttgcttgtttggataggaatatttgctctgcatatgaaaaggttagtgaaatgattttacagacatgatccctgtgaaaaaaatcatcctgtaatagagtagttttttttatttgttcgttttgtttgtttgtttgtttttgagacaggctctggctctgttacccaggctggagtgcagtggcgccatctcagctaactgcagcctctgtctcctgggcttaagcaatcttcccacttcagcctctgaagtggctgggatcacagatgtgtacccggctaattttgcttattttttttttgtggaggcggtcttcactatgttgctcagggtggtctcgaactcctgggctcgagtgatcctcccacctcggcctcccaaactgctgggattacagatgtgagccactgcacccagccggtaatagagtattttaaaataacatcatattccattattgttcaggatcttggaacattgagtgatatattgttctttgaatacaaaacacatgttcccacatccttgtttgagttgtttctcatgagtggtggctctatgtcaattctgcattccctcttgtagccagtggcctgtacctttgaactaaaggagccatctgtgcccactaatggatcagagtgaagggatgtctgggacttctgctctagtcagctggttagtctgctatggtaattaagctgttatgattgattatttactgaaccttttggactgtttcatcatgtggacttcccttcctctggaggtgtatgttttctctctatttactgaatcttttggaatgtttcatcatatgaacctcccttcctctggatgtgtgtgttttctctttggtaatacctcttactcttttccttggcatcataataacgttgttgccatagcattgtgatttttatttttatttgtaatgtaaattaaccaatgatgtgcccacacacccaaagctactgcgtatattatccatatcgacactgattatcattcatgaacttcgtctaacctgtaggccaggataggcatggcttagatgaatgcttggctgggtggcaacagatgatttggatatggtgctgaagtgtgggagggcatctctgtccatgacatagcacgaatgaagaattagcaattgagttttatctaagtttttatgttcatttttcccattttcatgattaataattgcagtcaaaagaaaaaacatgatttcatagtttctgtgaccccatagttgtatcatgtttcagattgttataaaatggtttatgcatcttcttacctgccatccccggaacgatgtaggggataggatggcacttttgccatcctcgttcatccacaaaggctccttctcaagagtgcagtggtggattttacgaactctctccggtgctgcctttagtaagctgaaccagagaaaagattggcaggagtgggctagatcagcatgaactagtccttacctgaacacattgcacagcagtggctgatgagtactgtggttggctcctcctttagctcttgaggggcactctggcacaaaggaattgagaaggggaggcctggatttttgtcctgggcccaccattaaccaggtgtatgttctaattaaggcctttggggccctaaggagcagaaacccactcaagctagctcaagtgaatggttttatggaatgaataaaggagcccaaagatgaaagtctaggagagcctcatggggactggagctgttctttctctttccctctcattaggcctcttctctctgtaagcctctttctttttaaaaaaaaaattattcggaattttgaaggcaatgttcaactatattatagccactagtgttgtaattgagaagtccaaagacattctggttcttttttaaattaaaaaaaaaaattttttttaagggataggatcttgctatattgcccaggctggattcgagctaccaggctcaagtgatcctcctgcctcagcctcctgagtagctggggctacaggtgcgtgctgccatgcctggcctccttaagtctcttttagtctcctgacggtctgcagactgagcttatctgcatacccagagttttgacttccacacggttttggcttgccatgtgccacttcaacacccatgctctgtgaccctttccctggctccagctccttggttgctttcttgtctttcagtgacccaattacaaattcccaggaggaaccctgctgcctggcttggctctggggcagtctgatctggctgaagacaggatgcaagtcactggttatactgagcagaagttttcagcacagtaggcgccccaaagcttgccacttgacccttgagagcttctcgctgtcctttccgtaagacgaggaggttgcagtgggtctccttcttgtattcagtacctccctcatggtgtgtattaacctacctgctgctgtttgtcttccctccaggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaacaaggtacttccctttttcttttttgcctgtcatcctccttcctttgtttcctgctccccgccaggggagggagggatagctctctgtttcctaaccttttcgtgttattggaaaaagtccaaggtaaaaatcaaacctaccagatactcataagaatactggtttgggttctaagtcctggtaagggtcaaagaggcccttcagtcctcactcagaacaggcctatgctgtacctttctaagtagtagctgtggtttttggtttcatgtcagatggcacaggctttcttcagggtctccctttttattcttttgcttcttcctctcctcacccatccctcacatccaggtttcttacctgctcctgttttgcataagttggaccaacctgattgggaaaaataaccagtgtgactccttccgcgtttactctcacctaacggttgtccatcctctcaccgtagcctagcccagtgtgtcctgaactttcagaccaatgtttgcaaagcactttgagtctagaccttatgccatgaccaagcagcaagagcagccttacacccactccccctctgaatttgaatatagagatttaacatttctttcctccgaaatttaaaaagtttttccttcctgtgtaatttttactgtcaccacttcccccgcctccagcatcacgtttctgtgagtgaggtgaacccctgcaagggcaccttgccatgaagtgcatggattgatggccagaatttctgcttttccttatctgtgattctatttgcctttttttttatatatattttaaagagacaagaaagagacagggtcttgctgtattgcccaggctggcacattcacggctcactgcagcttcaactcaaactcctgggctcaagggatcctcctgtctcagcttcccatgaagctaggactacaggcacgagcccagctaatttcttttatagggacgaggtctcactttgttgcccagtctggtcttgaacatctgggctcaagggatcctccctcctctgcctcccaaggagctgggatcacaggcatgagccactgtgcctactctatttgctttgtaatcctaaccctgcttctcacagcggcccaagtccaaggcagtgaaacacacaatacaagccttttagtcaatcttccttaagaaatataaacagaaaaaagatgagcctttctttcttagaaacaagagactttctttcaggctatggatacaatcttaaaactgtttggaaagaaatagaatcaacactaaattccaagagaaggggaagaaagctactccatatttcccattagaatgcctttgattatccaaatatgagaccaatcatcgcatgtccttgatgcagtttgccaaactatacattttttttctgtaaggaattttaattgcttgctttaaagtagtcatggggcagaaaaatttctcagagtattgagaaaatcttcataactcatttgcttgatagatagaatatatatggatatatataactatgtatataaaaacatacctatagatatattgaatctgtatgttttaattctgtgtagacacagtccattaaggagttctgtgtgtaattagtattttataatgttgatgtactgtattcactacccaatagactcaactggtattgtggttatccttcttaaagcattgtatctgcttctaaatatttcttccagcctcctcctctcttttgattttaactaaaagaggaaagcaagaggctagtatgggacatttccttccctgtagacacgtgtgcttggcattcctcctccccctttaccatcatgttacttgttgtgggaagtccgggaccccgaacggagggaccagctgaagccatggcagaagaacgtggattgtgaagattttatggacatttattagttccccaaattaatacttttataatttcttatgcctgtctttactgcagtctctgaacataaattgtgaagatttcacggacacttatcacttccccaatcaatacccttgtgatttcctatgcctgtctttactttaatctcttaatcccgtcatcttcgtaagctgaggaggatgtatgtcgcctcaggaccctgtgatgattgcattaactgcacaaattgtagagcatgtgtgtttgaacaatatgaaatctgggcaccttgaaaaaagaacaggataacagcaatgttcagggaacaagacagataaccttaaactctgactgccggtgagccgggcggaacagagccacatttctcttctttcaaaaggaaatgggagaaatatcgctgaattctttttcccagcaaggaacatccctgagaaagagaatgcgtccctgagggtaggcttctaaaatggccgcttcgaggggcggccatcttttatggtcgaagctgtagggatgaaataaaccccagtctcctgtagtgctcctaggcttattaggatgaggaaattcctgcctaataaattttggtcagactggttgtctgctctcaaactctgtctcctgataagatgttatcagtgacaatgcgtgcccaaaacttcattagcaattttaatttcgccccgtcctgtggtcctgtgatcttgccctgcctccatttgccttgtgatattctattaccttgtgaagcacatgatctctgtgacccacaccttattcgtacactccctccccttttgaaatcactaataaaaacttggtggttttacggctcagggggcatcacggaacctgccgacatgtgatgtctccccagacacccagctttaaaatttctctctttttttacgctgtccctttatttctcagaccggccgacacttagggaaaatagaaaagaacctatgtgaaatatcgggggtgaatttcacccgatatctggctgaatttcccccgatagttactaaagggagggaaactcaaaagagaaagacctgtggtccagcagtaagaataatattggtttcatttcctcccctgccgcactctgatgggtagagaacacctgtcttcgcaaccagtatcgctgcagcaacgggaactgtatcaacagcatttggtggtgtgactttgacaacgactgtggagacatgagcgatgagagaaactgccgtgagtcttctggattggacgttaagcacttaccattactcagaagcctggttggctcttcccaggctgagggcctaaggtctagggcgagggccacccatgattggtgatgcccatctaagttgatggggcttagatgacagagaaaacatatttccatacacaggtagatattagatatataggattaatattatatacataatatttttttaaccaccccagaagtaccactcgttacaagagatttataaataaacgtcacatggctgaaactgaattgatttggcaatctgggctctaatcttggctgtggctctgtaataaagctggtgacttggggcgagtaaacaggtgatattctttgatttggaaattcaatattcagcctttttagggatgggaaatgagtatttactccagttggttgatgttggctacctaccaggctcaagagagattgttttcattggttagtaatgcatagcttggcctacagtgtggggccattggtgtacatgccatgtaagtgtcatctttaggctgtataatttttaagatctgacttctaaagtataagactgtggttagcagaagttaaaaccaaacaaccacaaataacagatagtttattaaccatgaattttcactatcttttcttcacttaatttttaatagcttcgacattatcttataaggagatgatttgcccttttgtcagtcatgcactcactcaacaagcagttgctatacaccctgtgttccaggctctgtgctgggcctgcatatatattgccgatcaaggcagaaacggagttcacagtctgaagtaggagtcagaaaaataggcagttacagtagagtgacgggcactgcgatgcggaagtgtcatatgcatgtaggatgggcacccaaagcaaacttgggcaggccctagcaaagagctctggagagtgtctggggtgaaccaagcagaggtggagggaatcaattcacaggcaagggagcagcatgtggggaagctggcatggccaggaaactggtttgagttatggagaatgggcatgggcacaggggccaaggtgaagttagatgagtgggcagcgcccaggacagcaagggctttgtggactttatcggagaagcagttgggaaccactgatgtcatgtgatgaaagttcatctttggaaggataagtagtgggcagaatgcgtttgatggagagagaccagaagcaggaaccaagtcagaggcttctcttttatatattttacctttggcaacccaggggctcatttacccatttgtactgtaagaacagattaatgggaagctctagatactcatttagccagtcatccgtggggcctgtgcccggctcccctgccacttcacccagaaagcaacttgtgaaatatccagctcattaaacacatctgggccctgcaatcctatagactcccccttttggctgatagagggttatttacaaagcctttccttaatcgttttcccttggattcagagggtgcctttcacaccgagggagtagagcttatttgctgaatggcagatttgggaaagcactagcctctctgtgtcttttctgcaaaaaataaggcctataaagcctcctttatcagagttgcaggaaggtgtgatatttgtgggggaatagccaaagctctttaaaaacattaatgcttattaacagcattgaagcagataatggaaaggagtttattacatatctgggtgggatagaagatgcttcttagaattaacaagttacaaggaaattgcccagacataattaggcacagtggaagcagggagatacaaaccagatgacctcatatccaagagtgagggacacaggtggcagagcattcctccttgtgcccttgggcttggtttctactaaatggacaagctgaatcttgtattggctccgagttttgagaggaatgaagacctgcatcttttgggaggcacctgctgcctccaatggcttcctcccacccagcccctgagctctgttgcagactgcacagttgtgcatgaaggatggagctggccctgccctcctcccagcttggcgtgaatgtcagctgggattcactttccagagaccccgagacctactttctgctccgtcgtctccctgtttcacctggctcaggtctacacatgtcagatggagctgaggcgtggagaggaggaaccagaaggatttaaaactcagagactgggagtcaagagagaggggcttatctgtgcctgcatgtgtgtctccctcatcaaggaggttgcgtgtggaggagagaggttccctgtttctaagcagggctgcaggagctggaccgcagtgactgagtactgccatgtggggagttaagtgaggcaccctgccagctgccagggagcagtggaggaggggggacaccgggatgcaggagggtgttgtcagtgggtttccctccctcttacacagattcctctagctgggtgactgtcaggcactcagggttttgacgcgaatccctgcagtcttgtcattttgcattcatcccctgcctcccaccacgagctcaattacagagaagaaatggagcctcaaataagagctgccaggatgtctaacggcagcattgctatttggcatttcgtgcacgacaacccctcccccgtgccagcattctgttctgccacattttacctcctgggtcagcctttcactctcctgagagcagcctgccttcccctcgcctttcctggagggtgtttcacggggtgccagggattgtgcttaagcacaggaaatatctacttaggagaggaagaaaaatctaattctgtatccattctaatgccagaaggacatgaggaatgatgaggaagagaagtgacatttgtttagagcccattatatttacatcctatttaataggctctggttccaaacttgttccctggtttatcttcataataatgctaccaagtaaaggcaggttaagtaagttgtaggttgcagactcaattcaaatctagtctttctggctgggcgtggtggctcatgcctgtaatcctagcactttgggaggctgaggcaggcagatcacttgaggccaggagttcaagaccatcctggccaacatggcaaaaccccatctgtactaaaaatacaaaaattaactggggctggtggtgggtgcctgtaatcccagctactcaggaggctgaggctggagaaatcgcttgaacctgggaggcggaggttgcagtgagccgagattgcgccactgcactccagcctgggcaacagagcgagactccatctcaaaaaacagaaaaacaaatctagtctctctgactgtgatctcaagcactaggacacattatcttacccagttttactgttgagaaaacagccgtagggagattaaaattaatttccccaggaagaggtagagccacgatttggtacccagtcttgactgactgcagacagagcctatgttcctactgtagaattctacctccatgctgcctttaccatctgtacaatgaagtgctaacttcttgtgtgaaattgagcttctctaatcgtagtttcatagataaaggtatttctgtcacttatttaggaagacacttttcgcgtctgaagggatcttaggaggtcacctagcctgtcactctctctcgccaacagatgacagtttctcacttttccccgtcctgttccgatctggaagctgtccacagaaagatatgcccttatctctcttggttgtaaatttcaagctctcatgtaatttatgtcttctgtaagtctaggtttaatttctgttgctacaattaatacctgctttcttctattttttaattggttttccagtaggatgtttacatttgtgggaaatcaattgtacctaaggaatatgttgtctttctatcccattttagctaccaccatctgtgacctggacacccagtttcgttgccaggagtctgggacttgtatcccactgtcctataaatgtgaccttgaggatgactgtggagacaacagtgatgaaagtcattgtggtaaggggacatcacatcctgaaaccctgctctggagaggggggtcattgtgctccctcacagggctgtactggtatgtactggttttctgatagccgtctcaggatttatgatattctagctgaatggctttctccatccacatggtggggttgagtcatttctctgtccattcttaaagagtttgtttgctgcttttcacgaggattcagttcgctggagacacttgcgaactgggaccctagattcccattaactctggatgggaccctagattcccattaactctggatcaagtgtctccagcagaactgaatcctcatgattcatggtcagaaaagatggagcctggactcagctcctgtcacttactcttagattagcctttgttttctagtctgaaaaatggggaaatggaccctgctttgccttggagagatgctataaggatgaaaggtgatggtaaggaagtaaatttctgaatgaattcagggggttattaacagctctacaggcttggcccacatgtctcagtgggtgtgagattagcctgctgaagacacaaatctgcacctctgtgaactgttcttttttttttaaccaatttaattcattcaactctgttattattagaagttagcagatggtataggcattgagtgagcatctgttttctgaatggacatttttatatttagaaaaacagtgggttacaattccaaggaatgatagagattctctggtccaatccttttaatttctactttctaaagtgactgaggtctgtagaggtcagggggcttattcaaggtgacacaattagtttgtgtcagaatggggaactggaatccatgtctcccattttctaatcctccactatttctgttgcacagtacctccttgtcagtttcatgagacccatcttagttaacagtccctggtcccagactcatagttgctgacctccgaaggagacattatgcaatcagcatggtgtgccagattgaggcatgagagggaagtgagagtggaggtcagacgctgacccagacgtggtgatgagttggcggggccctactgtgccctctctccctgtccacggggggcaggtccagccacgctgtgcttacgcacatggacacagcctgcttgattatgagcaggtggtttgactcacagcagctgaaataaggggagcaagggcagcttgtaaatcatctcaatgcaagttaaccagcagagcagagcctaggccatttccacacagaaaatacccctagcctggctcttggaaggtttttaaaaaattcccagttttccttcttcaagtgcctgaaaacatgtccttggaatgtgcaactatttccccttcatccctgccatttccttcccagcactcttagaaggttgaaatgtgtagctagttttgccctagtaagaaggaaacttcacgtggttccctctttctggtatcattgagctcacgtactgggtacatgtttgactgtgaagcagtttcagccccctgatcctctgttcatggctcattcttactagtttgtcctgaattcatcccagggtcccggttagccccttcctctgatgcaggtcctcttcgtaagtttccacactcttcctcaaaaatatctgatttactagctttgccatcaacaagcctcttggcgagaatgactgagacggctgccttgggccccacgcttggctgctcctgttttctgacgctctgtaaactccatgtgaaagttctatgccacagtctatttgggctgtgataacaaaatacttagtgtaggtaatttataaacaatagtattttgtttctcacagtactggagactgggaggtccaagactgaggtgccagcagacttattgtctagtgagggcctgttcctcatagatggtaccttcactgcagcgtcagatggcacctctgcttctggaaggactgcagggaaatgcttctatctgtacgcaagcgtggcagaaggagtgaacagctccctcccacctctttcttaaggacactaatcctattcatgagggctctgcccccatgacttaattacctcacaggggtcccatctcttaataatatcacattggtgattaagtttcaacatacaaatttgaagtttcaacatatgaagtataaacatttgaattttcctagcctccagaaccgagagaaataaattgctattgtttataagctcagcctatagcattctgtcttcatgatctccccaggagctttgaaggctattgccagggcagcctccttccccttcttggtcaagctctgctggttggttcttaccaggcccccacccttctagagacagcgcatccacccgtgtccctggagctctgcccacagaaagtcccgagttatgtttcctccgttttgggagctcagcactgattttactctctctgactgagcatctcacggtgatcagctcatgcagacctctcggcactccttttctcaaaccacaggctgtgtctgtaggagtcctctgtttcttgaaagttctacttcctggcctcctctatcactgcttcctaaccttcttcccatcatagcaagcatagaaaataatatatgtggagagcactgggatgaatggacaaggatgctgttgtcaagaggcaagcagctctaagggtctgagggtctcagaatctcagcccacctgtaacccatttgcagcacactgactggaagctgttaaatgaccttttgtccctggtaaaagtctcttcgttcatggtctctgtggatcattggtgatcacgggtccatctccatcctttatgagagctttgacaccagagacaaaattctgaacaagcttttgtcctcacctctctgtttatggtctcacctgcagaaatgcaccagtgccggagtgacgagtacaactgcagttccggcatgtgcatccgctcctcctgggtatgtgacggggacaacgactgcagggactggtctgatgaagccaactgtaccggtcagtacttcctggactcagttgacagcactcatccgttcatgcagtggttaacattatagctttaaacgatcggaaaatctaggctctgagaattagcttggaccttagaaatcagcgagtttcatgcttctcaaagagctggtctttgatgagataaggaacctgtgccagaatgtaaatcaacaccctgctttcaactgattaaacagtgttctgagtgatatcgttgatttatgttctggctcaagcttcttattcattcaggaccagtgttaaacagttttcagaccagcccctcggctggggtccatactttgagtaagcactgaactagctcatgttttttaaaatggagcatcagggggttccccagacaaggaaaatgtaaactgtgtttgtacccgttttgggtaagattttattaaaagtaaagatggaaacaacatgaatgtgctaggtgctataaggtaggggtagtgttctcattcttttgttgggttcgcttatgttcattacattatttttatgaatgagtggatgaatggtggccagatatattatgatggggcagggcagactgggggtgataggcagtgggtagtgcaaggagttgagaagcttgtggagaaatgaaaacaaattccattttataatcatcactttgtaccccattgtaatttgtccaaaaaacaaaaattaaggaatttttgttccagattttattactcattgagtaaatttgctctacagcctccttgagaagctgttattcagttctgtcttgaacccctctagtgattttggactagggagataaagatgtttcctttaaacatttcatggtaaggacagatctgtttttacactcggataattcagacttcattgtgtaattcattgttgagtcatcttctcaattatctgaagccagctattaatcttgtgaattattggacttttaaatctcatgtcttaacctcctctgcccccagagtatcccagcacttcctacactgcccggcatctggcggctcaaagcacgcctactaattggtaaaaggaaatacaaagaaggtacatctgttatatctcagacctaaggataaataactgtgcattatgctctggcttagacttgcttccccacggagagagatgacctcttcttttactcttttgtattctctgcagtgtccagcacataatagagtatgtgctcagagaacctttgtggattgagtaattttatgcaactgcttccctccattccttttagtttggaggtgacctcatatggccttaagggagtgaatagatctcttcaaatgccatatacatcacatgggatattctgtggtgttaccaaatcctgttcgcttgtaaagtccacccatgttctttctggcgcagcctctgtgtctgcacctctgcttctgaaaagactgcaggaaaatgcttctctctgtatattaaagcatggtctgcagaaggaggaagaaccgaggcccataaaggagctgccgttggcacaggaaacacgtgaatgctgtttggaagctttgggtttggatggatacttagttaatagattagaagggtgcacttggacattgcagtttgtaaattgcagtatgattgaacatcttgttaacacaactgccttactcaaatttgcatttcagcagcatgtgccggtcttacagaatgaattgattacttcatttctataggcaagcttgtataaactcctggttttttctctgattttcttccggcaaggcaaactggagaaaacttaagagtccttgctgctcagctgcagccttgttccaagggctgttcttccaaacctttcaaggatgatccaccttctctgtcatctcaaaatagttggaggtcagatgtgagctcatggtgatgtgtggcatgacacctcattttcagacctactaaattaagctgcgtacagtgccaaaagaaataggtcaaggtagctgacctcctgttggcatcagcttggatgcgcactctgctgtgcgtcctctttgcttttcttttcgccacttttactttccacgaggctgtttctttattcacctcaacccaccgctattgtttttaaacgtgtacatctgatttctgtgtgtttttttaggacaattacctgtagacattttatttgtattcttaacatctttcctctctcctagatatatggggactttagaatttgatccaaatctctgcctacagttccagtactaaaatacctagtattttaaacactaaatatttagtattttagttttatattaaaaaatcctaaacttcactgttactctttttaaataaccacacttctgcataggcacacaggtattaccaactacctctgtgtcttgttgctaatgcctcccaccaatgtacatccttcaggggttttgcagcaggagtctatgagtggcaaactctttcaaggttttgttattatagacatatatttaatcctcaatcttgaattcaaatgggtctgggtttctaggcttttagtaattttccgtattttcatagaattcttccatttcttcctggcctcttttgtgttgatttgaattctgctcttagttgtctgttcaaataataacagacactcttttctttctaattacctttaggttatattgctcttagttttacctacctaggtgtggaattatttttacttatcctgcttgagactttgtttgttttaagatctgagaatttttcgaaagacaactctgggaagttacagctactaactcttcaactatacctgttggctactttctctggtcttgtcttcagcagttactctaagccattcgttggactgcctcattctgttgttctcttccctcctgtttttatatttgctgtctctttatgactctgtgctagaatctgagcgacttctctagatttatcttccagttcaacaattctcttttcagctaactctaatctgctgtttcacatatacatggagctgttttttttatttccatgagtatacgttttgtatctagaatttctgtttggttctttttcaaatctgccttttatttttcagtgttctttttttaatactttatgttttttcttctctgtcattaatcattcaaattgtgatgatagtcatttttttcctcatgcacttacttttttttttttttttttgagacagggttttgtcttgtctcccaggctggagggtagtggcgcgatgacagctcactgtagccttgacctcctgggctcaatccatcttcccgccttagcctcttgagtagctggggctacagacatgtgccatcatgcctggctaatttttgtatgttttgtagagatggggttttgccatattgcccaggctggtctcgaactcctgggtgcaagtgatcctcttaccttgtcctctcaaagtgctgggattacaggtatgagctactgcacctggtccccttctcatacacttttttttttttttttgagacggggtctctgtcgcccaggctagagtacagtggtgcgatcttggcttactgcatcctctgtctcccaggttcaagcaattctcctgcctcagcctcacgagtagctgggactacagatgtgtgccagcaggcctggctagttttgtgtttttagtagagatgagtttttaccatgttggccaagcttgtctctaactcctgatctcaaagtgatccaccctcctcggcctcccaaagtgctgggattacaggtatgagctaccacgcctcatgcgtttctttatagtctagcgctttgtaagaaataaggcagtactttccctgttatactacttatttcatccattctactctgctcatgtttggttaatgcttttaatcaggcattccagcaggtcttgatgaatcaggaaagttctgcctgagtcaaagattaagttgtaggatattgacctatattagaaactgatgttagatttccacgattgtttaccacacgaacttcaccattcttatagttacaatgaatcctaccatgcagaggattctttttcttccctaaattcttcagtctggattaaagtccatctcttccatccttgtaattaaaaaaaaaatatgtattaagcatgcagtatttaccgggcactcaaaatcagagctcataagttactaagaagatagaaaaatctagaaaaagataatgcgttatgtattccagccatacctggccacttgaatgcaaactgattactctttctgagctcagcttctgtgatagaatctggagatctcagccatgcctcccagaattgtcatttggaaacttcactagcactctgaaatggttttcaattaaaaatgaaatgcagaggctgaataataactagattagtatggcaattggtttaggcaactttatattttatgaatgtgagcaaggtgtcggtgagggatgttttgaaaggctgtcagacttgtgacacgaataaatcaaaagtattccaggcgatggctgttactggggcagaaactcatgtaacatgcatgatacatttattcctcttatcagaaataagtatagtttttaaagatgtttaatggattctgagtgccaaaggttgtaaatattgaaacttcttatagttgtatatacatgctgccaaatacagccttggtccttggagagatgggaagacatagataatgagctaccacttgttttaaagtggtttgaaaaatcaggttctttggatttctgaccattgcaaaaaatagcctcaaatgcagtaaaattcctgaggacatcataaaccaattttcccagtccttgggcagcttactgccaactgtctcagttgaatagaaaactatagtttgctctcagcaacccacttctgtgtgttttgtttctttccgttgtggtgtcatcctctccacacagttaaactaacagagagtccgtctatctaggttctattatcttatgctggttgtaaacaaggccagtcctggcttgcattcagcaatgaacagacacaaacagctttctgtttcagaggaggaagaggaaatcagatggagaggaccgttaggagtgttggttgggttggaggcacatattacgcatttgaactagtgtttgactgagtttttgaggtggttctaaatgacttccaggtggcctcagcccatgtgtgcagaggaggctgttcatgtttaacagtgactctctttcactagcttcttttttgcttctagtgattatagtggacaccacatattattggctggtagatgttcctctcaactctacagaaagacaatttcaagttcttaggcctgctttctttgtgattttggatgactcttttatattcctctggcctgaggtttttcacacttgaaattggattttttttttaaagaattgtaatgtatggccttccagaacttagcagggcccttaggtttcactgtaaggatggtgaatttgagatcaccacacagtggctgcaccaggtccaggactccgtctcctgagcacaggctgccgctccttatttctcagcatctggatgagtaagaggacttaggtgagaaggcaaactaccagggtatagcagaagaagtgcaggcttgggccttggactgccttggtgttactacttaatgatctctaattttcctattctctctaagcctgttctcatttgtgaaaggggaataatccttaccttgtaggttgtcgtgaagagcaagtgattttttaacgtgtgcatctgtccctgggcaatggcctgggtcatgtttataaatccataggctcaagtccaccgagggagctgcccaaggtcagcccaagtgcccaattctcagccaaggagaaacccagatgctcccacagttcagaccttattcctacctcatgcaaacctcttttcagcccacccccttggacagttggtgggggatggagatgaggggtgtgcgactgtgtctctcttctctgttacagccatctatcacacctgtgaggcctccaacttccagtgccgaaacgggcactgcatcccccagcggtgggcgtgtgacggggatacggactgccaggatggttccgatgaggatccagtcaactgtggtaaatgcaaattccccagctccctccctgagcctccccagtgtctgctgttcaggaagagaggccacagagagccaggggatgaaatgctgttctcctatgcctgtatttacactctgaaaccaaataagcccatctactttctatgttatattgccatatgatgtatcagattatattatatagtcttaagagttgcaggcaagcagtttgccccacacacaaactatataaaatgctgccacgtaaacaaaatatataaaatgttttttgaaaccaaatatgtttaaggttctctatccttttgccaaacattccaagttttcaggggatgttagttgtctacatgttgttatacattctactccttaagtaaagatgtttatgcaactctgtttttgtgtagtaagcattttcatggaggatgcatattcactttatgctaccataacctagtttacatggttgcttcctggttgggtgtttgaggtttttagatttatactgttatgctagtaccactattcgtgtctttggaaatggcctgatttttctttgagatattttctgagaggcgttcttcagtatggagttgtaaggtgaaaggttctgaccagtttttgagtctctctgttaccaaattgggtttccaagggattacatcaaatgtgtctctaccagtaaaacgttgcatgtttccccaagtctccttgatattagatttgtatctttttagttgcttccactaatgtaatatgtgtgtttgcctcatgtagttttgatttatacctcttttaaaatactttttctacctagtgacattaaccatttctccaaatagtggtgcttgtttactgtttctgtttgatatcctttggctaatttcccagaaatgattactttttacaggattaaaacacattttcatacttatacctaatcctcaaggaactattctacacagagctcagtttgcaaaggctatctatgactgcctcattagaagtgattttcttttttttttttgagatagggtctcactctgtcacccaggctggagtatagtagtatgattgtggctcactgcagctttgacctcctgggcgcaaggcatcttcctacttcagcctcctgagtagctgggaccacaggggttggccaccacgcccagctaatttttgtatttttttgtagagatgaggttttcgccatgtggctcaggctggtctcaaactcctgggttcaagtgatctgcccaccttggcctcccaaagtgctgcgattataggcacgagccactgcgcctggccagaactgattttcaagtccaatgcctggcaataactttttgctcaggagaaagggtgacctagtactaaagattctgatcaagataccttagttgtagtttaatttcccctggaactgttgtgaaacctcaggctcttagcatttctaggcaaactttctccaaaacaactttgctttagaattcctccagaattaaggtggtgagtgatttaaatagctttataaaactaggatttcatactcaagattcatattgtgctttttctattcattgaagcttttctttttcttctaaaaaatatacttagatcaggtatggtggctcacgcctgtaatcccagcactttaggaggctgaggcgggaggatggcttgagcccaggaatttgagatcagcctgggcaacatagcaagaccccatctctacaaaaatacaaaaattagccaggcacagtggcgcacgcctgtggtcccagctactcaggaggctgaggtggcaggattgcttgagcacgggaggtggaggctgcagtgaactgtgatcacgccgctgcactccaggttgggtgacagagcaagactctgccttaaaaaaaaaaatgtatatacacacacacacacacacacacacacacacacacacacttatcaaaatggaaatgttcaaaatagaaaagatacaaaaagatataatctctcaggtgtaggttgatctcctcacctgcccagttcccactttttcctaataggaaaccaagttgtatattttttcagaatatttttgtgcatatataaacaaatttaagtatactctgtattattgtcctatttcatacccataatgtttaactttgcgtattgttttgcaccttgtttttttcacagaactgtttatctagggcataatttttatagagcacttcttgcatctctttatagctgtctgtgttccagtgtacagtaatttattaaacagtctgttattgatggactgttttcaatctattacacagttttgcaatgcaacacttgtacttgtgggcggttttcaacctgttacaaacagtgttgtaatgcaacccttgtacttatattaagta[450 bp omitted]ctgagttgatccctgagtacttggctaggactcctggaggctgatcgtggcagagagacagggtttggttaaaggagagcaggaaggaagaaagcagggttgggggcgatggtgggattagatcgaacttcagtgaaagttattgtttagttgaaatatgttctattaattgaccagttgttttgaatcggccacttatttctacttgattggttttgttagtgttgctgagtatcactgggggtagagtgggggggggggcggggggggggcatttttaggccagatgaccctttttatcttcagttttctttagccccagaaagattgccttgggtcactggtgctcatccttgattatatattggaatcacctggggagctttaaaaccacctggtgcctggaccttacccccagagattctgatttaattagcgtaggtgtggctgggacttgggacatttatggtgctcctggtgattctactgtgcagtccgggttgagagctaatgttatcagtgcagggagtggcaaactagcctgtgggcaaaatccagtccctaacctgctctattaaatgaagtttgatttgcatacagtaactactatttgtttacatattgtatatggctgctctcatgctgtagtggtggacttgagcagttgtgacagagtctgtatgacctgaaaaccctgcaatagttgctttctagttgtgttagttggggttagttggggttctccagaggaataggaccaataggatatgcatatgtatatatatagatttactttaaggaaccatcatgcaattttggaggctggcaagtcccaaatttgctaggtgagccagcaggctggagacccagggacacactgaggctatatagttcaagtccaaaggctgtcaggctgcaaaccttggagagagccagttgcagttcaagtacgaaggtcttgctgtgtcctcacatggccctttctctgtgtgggcattcctggtgtctctctcttctcaaaggacacgaattcttttgagtttaggccccattcttatggtttcatttaacctccattacctttttaaaggccctatctccaaatacagtcaaattggggatcagggcttcaacatacaaattttgggggaacacagtgcattccataatattagttccttacagaaaaatttgcctacccccgtattagagagtcagtatctattaatcatgcttgagattgggggtttgatgccagacagctctggatttcacttttggcttcatcttcatcagctgtgtactcttggcaaaatacttaatgctactgcccttgttttctcattttgaattagcgacaataaaatctctcctaatgttgtcttgagggtttaatgatgcactttatgtcaaatgctttagctctaggcttggcagaaaacaagtgctcaataaattgtggcttttactgttgcttcctgaagccacatctgtactcgtgtgcacttgcccagggctagagggcccagccagccgcagtgctcatggcctcttcccttctctggatcccttacagagcccctctgtacgcacttcatggactttgtgtgtaagaaccgccagcagtgcctgttccactccatggtctgtgacggaatcatccagtgccgcgacgggtccgatgaggatgcggcgtttgcaggatgctgtgagttggggcaggcaggggaggtgactcacggtcactaaagaacttgcatgggggtttggccaccctggggttgtgtctctatttaataactgacaggtcttggttgagtgtcgagggtttgaccaccctggagttgcacctctatttagcttacatgtctaggttgagcatccaagcttgccttttctgagaaagactttcttttgttgcttaaggaatcctgcttttcagttgtgggtgtatgtataaggggcaggatggcgagtgaccagggtcttggctcaagggtcgctgaaagtgagaggcctttcttgccagtactgtatcagatggcactcccagcgtgccgtagccccttaccctgcttcgatgatcctgtcacaacttgccccaatttggacctgtctgttcattttgctgcctgagctttacaggagcaggggcttgttttgtgcattgctatggccctctcctaaaatagtgcccttcttggagcagctcttatatttgtttcctgggactgctgtagcagagtaccacagaccagatggctcaaacaacagaaatttatttcttgcaagcctggaagctagcagtccaagatcaaggtgtcggcagggttgggttcctccgaggcctctctccctggcctcatagacggctgcctggctgccttctccctggctcttcacacggtctttcctctgtacacatctgtgtctaaatttcctcttctgtaaggacaccaggcctattagattcgggccacccagatcacctcattctaacgtttcctctttcaagcccttatctctaaatacagtcctgtttctgagagactagaggttgggacttaaacacatgatttttgggaggataaactcagctcataacacgactcggtaaagattcatggaatggattaattaacaaagtgtgtgctctgtttagattaggtttggcttttgctttcaaggcatggtttagccagacagtcctttgccagaactcactgctgttcccccttgcttctgggcaccactgctgcttcgacccctcagcatggaagttcctggacttcatggatgtttgttccctctgtagcccaagatcctgagttccacaaggtatgtgatgagttcggtttccagtgtcagaatggagtgtgcatcagtttgatttggaagtgcgacgggatggatgattgcggcgattattctgatgaagccaactgcggtaagatgtccagtctgcctcctcacatcctaatcctctagttaacagtgatgcctgcagttacagggacactcaccggcaaccccactgcagacttggccttcccgtaactcagcagcagttgctgccagttcctgaatactcatacgagttgagtcttgaagggggcagctggcacccagcaggtgctagggaaaagtttatttgatctcctttcctttctgtggttgggaagaccacattatgtataaggaaggtggtagataaggaattatggtaaatattatggagtgacctccccctaaaagtgacaggccacaatgtaatagttattgtcatgattggattaccatcaatagttgttttattcctttggtaaaatgtcagaattaaaattcaggtgattgttctcaggatattgtagtatagatcagaggaacatgggttaggggctgggaagatggggttttgtttagtttgtaggtgtattttttgttccccattgggtccatgaagctgccttatctctttatgggtgggaagtgtgggttgccctggaacttgggtctggaggaggatgcctagagttggagccctgtgttcacactgatgcagggaaagcaactgatgatgtggttgatctctgcagaaaaccccacagaagccccaaactgctcccgctacttccagtttcggtgtgagaatggccactgcatccccaacagatggaaatgtgacagggagaacgactgtggggactggtctgatgagaaggattgtggaggtaagaggcccctggggcctgggttagccccataaccaagacacaccagaatagttccaccagctatgcaggatgtgcctggctgattccgtgttttggggggcatatttttgtgagaggagtgactcaaattttttctgttcctctttctcattttgaaataagtgtggttggtttctcctattttcaggctatttattccgtatttgcagggcagagtgagaagtctagagccttcctactcaaagtatggtttgcaaccagtagcatctgcatctccttggaacttgttagaaatgtagaatctctgacctcaccccagacctacagagtcagaatctgcatgctaataagcccccaggtcctgtgtgctccacaatgcatttgaggagcactcatgtggaatgcagacttgcccctttcctttctggcattctcatctctgaaccaggtcgtggagtagttgcggttgaattaactagaacacaatgctttgcctcagtaggaattctcttagccaccctgtgcctcctcagccacctgtttctttcaccagcccctgcaaaagcaaacttatctgaatattaaccgaaatcaaatatagtaagggaaatctactccccaaaagggaaaagaatattgcctcttctgacaacccattatacatgatttctagattagccgctgctcagagctgtgccagtcactggcctccctcagcaggtacagctaaaactgggacatccgcactaggtttgggacatatttggtctaagatcaagctgcttctaatgttttgggtttccgtgcttggtgtttttctcagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttggtgagttctggcccaggtcctctcctgtggtacctgctattgtggagaggaccttctgggggtgtgctctgggcacaatccaaccgggccccatgccctgctgtctgggactctgctgtgtggccaggttgcctgttactaatggtgtacctccagggaaggctgatttctagcattttttcctggatcatagatgcataggaaattggaatgggagcatctcatcctctataactggcctctgaccttcctgcaagatgccagccaccctgatttccacccaggctatggttatgccacctttgctgccttcttagtgggaaagtacaaattggaattaatgtggaactttttgtgtgtgtattaaactctggggagagagcccaattcagcttgctagttggccggcctgtccaactaaaagaagggtaagcactgccatctagtggctaaactcaaagaggcagctgaaggtctgtagtcaccatattgttggaggtggggtagaacttgaaatcccatttcgtgtgtgctcctaacagcaggcggaacagaggtgaggatcctgtgttctttcctaagcaggagtctacttcaaactcagttataataggagaacaaataattttttgcatgctttgcatgatcttttcccttcttctgtgagcatgttctttccattgcttccttgtttaaaaacatcaaaatcccaaactttagtgaacctaaagcatgtagggatctcctgggttccacccagaaattctgattctatgttttttataaaacattataaaaatgatgtttttactagggtggtctttttgccatattgagtttcctcttgttctcctgtctagaagatcaatttttgacaatttctattttccaggccctctgtgagctgattcctccttgcctccctggattccttacatcagccaagctagattcctgatcttcttcagatagacttgcttctttcctgcctgtgcacctgcagcaaggttttgccctcagcaggaactcctgtaccctcaaccttgtcttcctactttccttatcactgaaacccaccatccatcagtgcaaacagaagcatggattttatagcaaaagagaccttgatatattcatatcatcagaacttctcaaaatgtgatgcaaagaccaccctaatggaatcgcctggggtgtttataaaaaaatgtagaatcagaatttctgggtggagcccaggagatccccatatgattcttaggttcacaaaagtttgggatttctgctttgaacaagtagggtattattctcctttcaagctccacctctgtggcgctttcactgattcctttaaatgatttccatctcttttccagtctcattaaacttacccattgaccttttgattcttaactatgatctgccatatattgcttcctaattatttcatgcgtgttgatctttgcttccatagccattgtgtggacttcctgtttgggaatcatgctgtctactactttgagtcctgctctgtgtctcctacaataataggcaaatagtcagtatcccctaaaatgcttctcaaattaaaatgaattgtaaaagagaaaacaaaactttgtgtctgtcctttctcctcaaggcctacatatttattgaataacttgattatcctcttcaagttgtttttgcttattgaaactctgaccaggacattaatagactctagcaaattctgactaatccagtgatcagatctctgtttatatatcctgttcagcttttgtactttcttttttgtgcgcagtgctgggacaaatttaaactcattgttatctgtagctcgtggatcttctttgtttagtgtagaagtcttctaactggcttattaacctcatatttctccccctttcagtttttcttctgataaggcccatactgatgaatgctcatgtcctccccagtattggagccctctgatgcctcccttattgtccagggcatgatttgccttggcctggcattctccccctttttattttttatcacctgtctccatgtaccttgtgtttctgcagagtggttctgagatatagggaaagcccctttgaaaatccaatgaaaactatagaatatgcacaatatcctgaagttaataattgcttttttcatttgtttgcttaggttgttttgtaccatttgccaatgctttctgcctttcagtcgccactcaggataactttccacaggtcaacatgtccagggatttatcaagtccagtttttctcttggagatactccttctaacaacgtggattctcctttcgggacagattgttctctagtcctgctgtgtgcctgttacccagggactttcactgcctccttggaattctctttgcctttctcccagtttagattccttgtttcctggatcttgtgtgttgctttttcttggtttactcccttgtttgggtggagtgcatccttcagtagccttgtcaggtgaatatgatgacgcagtggccaaggacactgtgatgacagctctcaggtgtttgtctcttgaattttgctgctctggtttgtattggttgccctgtatacctggggcacaactgccttttaggacgttgcaccatcatcatcttcaggatttcctttacctccatctcctgttggaactcctgttttctgtgtcccagtttttctctttttagtttaatcccatgtttcagtagagcacgttttctggaaaatgcctgagaaaatgtatgtgggaggcctgtgtgaggtcttgcttgtcttaaagtgttttaattctgtcttcagacttaattgatagttgggctgggtttggcgtgctagattgtaagtaattttccttcagagttttgaaggttttgttccactgccttcaagcagcttttcggaaatccaaaagccattttgattctgatttttttttttttgtatgtaacctgtttttaatcctctagaagcttgtagaatcttccctttggcaccagtgttttaaaatttcacaatgatgtgctttgctctgagaccctttccatccaacatagcggacacttgcatgctttttgatatggaagtttatatattttagttcaaggaatttttcttgaagtttttattaatgatatttccctctctgttttctcttatttcctggaactcttgtcattcatatattgtctcctgatctggtcttcttccttatttttttgtttaatcttttatagttttgaaaattcccttcccccacccccccaattttctaggagatttactcaactttatatttcaactctttgctgagtttttcatctttgttgtcatggttttaactttaagagcttctccatttttaccactgtccctttttatggtatcctgttttctttttttcttggataaataatatattctttctttctgaacgtattaaggatatttgtttttgaagttttcttcttgcaaagcctctatttcctccaaatggcctttttgggggttagggctctgtttggctttctgcctttcatgtcaaagccttttctcagatagttcttggttgctgcttgtatttaaggctggggactaaagtgctggtaagtaattctgagcacatgggtgggcttgtcaacttcgaggttcatggctgggaaccatgggggaactctgaatcttggttacttcagggttagtctctgaagctggtcattttccccagagaagattattagatctcctgcctagacaataattaccttattgctaggatcctcggagaagaggactgggacttccatatgtaggtttaatcccccttttatcagtaggatatacttgctgtcaactacgcctatctaaacaactctctgtttttactttctccaaataacaaccctccattcttctattggggtgacgtatgggttggttgcctcgtgggactgataggaggggatataaggaatgtagctgcgtcttaaacatcattcagtcagttcccttattttaactccttcttcacttccagttagatgccagtttctgaacttttggaggactgtgtgttgttgatctgattggttctgagctttctcctgtgacggcttagggtaggacgcagccttcgctggcctctttagtcacataccgctatctgtcttctttccagctcccaaatctcattatccatgtcctcgtggatttaggtctttgaaaacaatctcttgactgtggctttagtgggatcctgtggggaagcaacattagatgtctgtatctactctgctctctatccggaactcgcatttgtcttcaggttcccattgtaatttctaaagcaccgtaatctcctagcatattgattggttgctgttattggccagctccctcaatattaaaaagtaaattttaaaaatcttttattttagcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccgtgagtagtcagagagcccttcaccccctgggcacgtttctgcagagagcacagttctggtgcttctgcttcatttctggatcagcacacgcctgtgtgtgagtctgtgtacttgcgtaaccatgctcttactgcattctccacaagcgctttgccacgtgcacccataccattgcgttagtcaccttctttttaataagttgactgcgttttaaataccaggagcgtgtccaataaaaatactttctgaatgactaagataaatattttaaataggtttcataagcatgtttaactctttaaaaacgcccttggggaaagccacaactcttctgtatgtacattcattcttctggaagtatttagtgagcacttactgggcgtagaagctgtgttattagagggtttgcctctagcaccccattaagaaaattcattctcagtccttagggtaattatggttggtgagatagtgtgccgagccacatggggaataatcacagggccatctgagcccagtgtgaggtgatgcatgcattctctacgggtttggagttggtgggtcctggtgtttggtcctctgatgaacccagggaggatctttgcagtgagtgatggagggagacactggcttctgcaagcgtttatcctcatgtgaccagtcagcgcttttcagtccctggctgcacgctaatgccgccgttggctggtctgtcctactgtagcagacttgggagggcatggctggacggtgcttatgcagccccccaccggcctgcctctctgacggttgggtgctgctctggctcggggatccctgctttgcgggcctcccctccatccagtctcctgctggctgcagacagcagacgtcctagccagtcacactcccttccttgccaggataagggcttcgtccgtgcttgcctgattcctgtcctggtgaatgtagaagacgcccctctcactctctgctgagagcctccctgccgccaagccctaaccctaagcagcaaacgcctcagttcctccactttgatccctgttctggtcccattttttttttaatcttaaaataatgacttcctcaaccaatgaaaaactgagcctcacttggaatcctaccaagtcttaccatttagagatggaatagaatctgaggtggaggttagtcatctcttaattcctctaattcagtatttacaaaatttatgggacttagcaggatcatgtggaagtgcttataagagatgtgaatttggtgatctcacctcagaccactgaatcaagagcaatggtggaggagatgctcgggaacccaagccttttcagaggtgccctgtctgattcttagcatcagacaagattggcaaatactgctctgtcctaaatagttcacccagtaaggctcagggggaaagggaagagggagtcggccgtcccttctctgtctgtagcgttgttctccacagggtgcccgactgggctctccctggagaggcttggttaagaggaaggagtgtggatccagtaacatcttcagtttggttggacaaatttttgttgatcatgcacagcgtggcaggcattgatcaggtttctggcaatacaaattctttgtgttttttttctggcaggcattgatcaggtttctggcaatacaaattctttgtgtgtttgtttgttttttttttttttcttttgagatgtcatctcgctctgttgcccaggctggagtgcaggggcgggtgggatctcagctcactgcagcttccgcctttcgagctcaagtgattctcttgcctcagcctcccgagtagctgggacgacaggcatgcggcaccatgcctggctaattttatgttttcagtacagacaggttttgccatgttggccaggctggtctcgaactcctgacctcaagtgatctgcccaccttggcctcccaaagtgctgggattacaggcctgagccaccacgcccggtgactggcaatacagattctagtgggagggacatcaagtcagcagctatcctacagtgtggtgtaggcagtagcagaagttatccaaggaactggcatagtttgcaggtgggctagcttcctggagaggtggggacaggccaggagaggcagccccattgatggtgcctggacaacggtgggacaaggtggcagatgatgggcattctagacacaagggacagcatgtatattccaaggctcagaggcataagaaaacagacctgtagagtggctgtgggtgggacaaaggtgagtgcagagaggtaggcatgaggtagatagggcgacccctgtgcttggagtttatttttctggtcctaaggagcccttgaagatttcagagatggggtgtttatatcttagatcacttggacttcatcatggggggaatgggttatagaagaaggctgaggtgagattggaagccaggtgcccattaggaggctaatttgatgggactgtgaagatgaaaaaggaagagtgacctctttgtatattggaggtactattaacagcatccagtgagtttttttggctgtggtaataaggaaaaaggaagaatgagggttttccccaggatgacagtgaaagctgatgctaccagctatgtgggggttactgaggatgaggagtcgcagctttccctgggtggggctagcacgatggtgggttcattgattgacatcagcatctgaggtagtgcaagtcatcctggaagaaactgaaaaggggaggtcagaaaccggggcattcttgtcttccttttcattttactgcattaattgtccatgcaagtgatcttcgcttgcctgttgcaatgagtctttgccagttttcacacttttgttgttccttgtgatgatctctacggtgatggacttctggagacgaatttcattctaggccttgatgtgctctgacttgagagaaaaatcatcttggccaagtccttaacttgaaatatgaaactaatttatttccaccatgcataggtttttctcctaacacttggcttttcggaggggtcccaggacccccatcgttgatgcgtcctttcctctccaggaatgtcacttttgcttttgtttcggctgcctgaagggtcttttctttgactaaaagtcaaggaattggataagttgctacctagaggtctttttttcaagaaacaccctttgagtctttccaattcttcaatttccaaggtagggtgatttctttttgttttgtttatttatttgtttgtttattttagtttaggaaaatcataaggaatctttcattactaaactattcctgttggaactcagatccattttggggttggatttctctctgtccagaacatgccacttgttatctggaacccaagaaccaaaaagattaagataatttgatatctcttgatacttgtgtataaatccatataaataaataaatgaatctatataaataaaccaaataggccaggcgcggtggctcacacctgtaatcccagcactttgggaggccaaggcgggtggatcacctgaggtcgggagtttgagaccagcctgaccaatatggagaaaccccatctctactaaaaatgtaaaattagctgggcatggcggcgcatgcctgtaatcctagctatttgggaggctgaggcaggagaattgcttgaacccgggaggcggaggttgcagtgagctgagatcgggccattgcactccagcctgggcaacaagagcgaaactgtcaaataaataaaaaaataaaccaaataaattcagatggtgggggatattttaatctccttggttaacatttccatattacatctctttctcatttctttgtcatgtctttcagttgtaaggttgagctttgtcatttactttcaaagttaatgcaagtttgcacaaataagtgtttggatttgctgatggagtttgtcttcaatataattaattctcctgctgtgtacttttttttttttgaagttcttcggtgtttagcaggatgcggcagcctttgataaaccttaaaagattcttatttctctttctgtcgccttatgcctgtttgctttcctgcattttggctgttttgtttttcactttgctttatcataagtggtctttttcaggctgcttctgctttactctttctatttgctgtggtaatattttctgatgctttttaaagtggccctatcttctttacaaagtcattaatgaccagatgaaaacttggaaggcatgcctgtcatacttgcaagtaatacagagttacccagatagcttattttctggcaaaacactcaggatttacaaagggaagctaaactttggtggtgggttttaatgtgctattcattattctcaagcaaatcatgtattcgtttcacttaattctcaaaataactgcgattttggtcttatctcctttgtggagataggagaattaaggtcccaagaggatcacctagccagtaccagattgggttatttatttaggttgaaagccatgttgaaagttctcatcagggaagaatacaccaaaactaacacagatgaactgagtagggattagtgtacagttctacacttacattaaaggaatgaacaaagtagactcctagagtgttaaaccaacagggacaggttgatcccacactcaccaaaatgacagtaggaacatctgaggcgaataagcaaccacataataagatgaacattggagataattaagaaagagaaaagaaatgggacctccctcctgggtgatattaattcattaattggcattctttaaatcagtgttttcagcctgtttccaatctggcttattcacagggatgttgcctggtaaagggtcttaaaatcaagatgtgttatatccacggtttttttccaacattaatttgataaccttatctaaaaatgaaatgagattagtgtggtgcgattctttttagagaacctgtcccctgaaggcgactaagttctattctaagtgcctgttaatcatcggttaattatcagtttaagaattttcagagttaatgacaactttattcccagattctattgtttttttgttttaatttaaggctctttttttttattatactttaagttttagggtacatgtgcacattgtgcacgttagttacatatgtatacatgtgccatgctagtgtgctgcacccactaactcgtcatctaacattaggtatatctcccagtgctatccctcccccctccccccaccccacaacagtccccagagtgtgatattccccttcctgtgtccatgtgatctcattgttcagttcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacctcctctccagcacctgttgtttcctgactttttaatgattgtttttttttttttttttaagaaacagggtctggttatgttacccaggctggtctcagactcctggactcaagcaatccagcctcagcctcccaagtagctgggattacaggtgcacactaccgcacccagcttacttccagagtctaaagcccatgcttttttgctcttaaaattttgagacatactttataaagaaacctccaacgtcctcagctctactgcttagctgttgtttgattatatttgaccacattgttacccagtagaatacttctgtgatgggggttttggtatttttcaaaataatcccctctgggcatagtctctccctggcaatcctatataaaatggcataacctgatcagattaatgtacttgtttgcagtttctctcaatagaagataactccctgaggacaggtccttcatctgttttacatatccccatatttttaacatctggagcagtgcccgagtcatggtaggacctccatgaatgttcacagaattccatcttgggcttctgagactattacagtagtggttctcaaacctttctctaattcttgaatacacgtttatttgtcatgagcttccccccaccatggcaaaccaatttcagctcagtatataatagaattctgaaatgcaatgatcttcctggagaatgggggattatagtttgtgaaaagcctcataagtggttttgatagttcccttctattgacaattttttatcaggattgtttttgaataagtagtgaactgaagtctgtacctccatcctagagactcgtgcaaagaagtcttaattcttctttctcatgaaaactcatcagtggagaacacttgtcagagtggtctgcatgtcttctcaccacctcccccatccttgtatcttttcacctctaggaaaatatccctggatcctttatccattcctcttgaccatcctggttgctctcatgggaacattatccagtttctctacctatatctcaaagtgtggttgtttatgttaggaggaaggagaagagggagggggtcgaggtcaagaggtgacccatgaccacatgcctgggtctgaagtggggcgtatgaagcttccttgctcaggtcacaatgctcatatcacctttaacataactttgttacttgtgtgtacactctctttatttcctcagggcttagtttcaggaagggactattatcatccttgctttaaaattaaactataaacaaaattccttccatagttagcttggcctacgtgcagagataggcagaggccgttaacctacaagatgtcaccatgggcagggggcagggtgcggggagcagaatggagccactcatgttcagcctccttttgtctgttataatttccccattttcaaagccagtgatgttgcatgtctctcacctgtcttctgtattctctctgtctctcaccacaaccagaaaagggtctctgcttttaaggacccatgtcattagacagagcccacctggataatccaggctgaactctcctacctatgggtccttaatctaatcacacctgcaaagttgctttgttacataaggtaacatattacaggttccagggattaggatgtggacgtctttgacttggaggagcaagattgattttagaccctcatcactggtgggattggatttctgatgtagcccttccttgtccaggactgggcaggcaggtgtgaatctgtataaggaaggcctcaagttactgttcctgggctcaaccagctacatagcagatttgtaccacccaggtacacagcctgcatagcagatttgctgtctacagccattctcaccttttctcttttcaggagcatttgcaattatacggtcattgctttctttttggagcctcccgtgcagttttaatctactttcagaactggagagcacatcacattttggtcaatagcctagacatacagttgcataacccttaacttaccagtgctcattatttgcattatttcattttctgttcaagtactttgaaaagccaaacaactttaaatactacataaagtatgcatgcctcttaatattgttgggattcatctcattgttatttctgttactcaaaccagaaatcagctcctctttctagattgcaaactaataatagtagcagaataattaatagtactatagagtaatagctacagtttgttgatgccggccaggagccaggcagtgttccaggtgtgtgatctcattagatccttgcagacatgatagtgatggaattgttacttccattttttatagggcaactgaactcaggtgatattaagctgtttgctcaagctcatgcagatctaggatttaaactctagtttgtttgactccaaagtgctcactcttcccgaatgcagattccagttgttaatgttagatgagatggcaccttagtgccggtatagattccaccactggtcattccagaggtgtgttttgaagcagaagccaattagtactttgcctaaatgggaataaacttgggcccagcctttagtaccatacggcccctccccgtggacttaagaagcctctctgtgtttcagccacacacagcaccttgacttgcatgagcagggagttccagtgcgaggacggggaggcctgcattgtgctctcggagcgctgcgacggcttcctggactgctcggacgagagcgatgaaaaggcctgcagtggtgagtgccggtccacgggctgggctgggctgggctgggctgggaggctcgcttaccccagggcccctcctgtgtagaccttgagctaggacccttttgaactgttgctcaatctaaggataaaacagatttgtgcctagttttggagccccaagtgaggtgagccttggccagactctgatacaacatgcagctgtctcctccctgttagtgaaatgctagtcttggatttttttttttttatggacttcccacctcatgcccatacaccatggctctcacagtctcaatctgctggtgggattaactcagttcttatctctggagtgtctagtaatggaccctatgacatggtccttggacttgtagcattctctatggagaaataggcttaaattgtcataggcaggaggaagatgaaattcgagggaaaatatcacgaccggaaaagtaggagaccctaggagggattgtatagggaggtttcaactacattttctgagatttcttttcagataatgattatggcctcctgataatctagatcatggtagttctgtttaaaagcaggagtcctttgaaatctaaggatttgtaagatgtaacttttttttttttgtatttttagtagagacggggtttagccacattgcccaggccagtctcgaactcctgagctcaggcaatttgcccgcctcggcctcccaaagtgctaggattacaggcgtgagccaccacgcccagccaagatgtaactttgtttgtctttttctcctttatctctctagatgagttgactgtgtacaaagtacagaatcttcagtggacagctgacttctctggggatgtgactttgacctggatgaggcccaaaaaaatgccctctgcttcttgtgtatataatgtctactacaggtaggtcccatctttgtcatgggagatgaaaatgatgtcttcattgccccaggatgttctgtaaactctctagtggcatgcaccatgctattaacggagtcagacatctcagccccccatgctgctccagtgtgacaatatctttatttttttttgggccagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggatgtaagtgtttcagttaatttttatggcatgggtaagacctcaggtcggggtttgtgagggtctttctgagtattctcaggaatgtgggaacatatgtgtgcctcacatgtacagaagtatggtggctaagctttatagtcttgccagagttgtcaaacatctgttcttcttactgcatcagagactgttcttgtaccttaagttaatttaagattctctccaccattgccctcttgcattttttgtctagtttctacctctacgttcctcctctagatatttcctagtacttggtacttaggaggaggtcatcgtcattaaaatatgaggcatatcagcaattttgtggctaagtttttttctttttggagacaaggtctcactctgacacccacactggagtgcagtggaggcgcaatcactgctcaccacctcagtcttcccaggctcaggtggtcctcccgcctcagcctctcgcatagctgagactataggtgtgtgccaccatgctcagctagctttttgtatttttgtacagaaagggttttgccgtgttacctaggctggtcttgagctactgagctcaagcaatccacctacttcagcctcccaaaatgttgggattacaggtgtgagccactgcacctggctttgtggctaagtttttaagaaatttaccaaatttatgtgtctaagagagttcctcgcctcctccctacttcaaagtagttgacatgagcaactgtctgcttgaatgtcatcttttttcattgcctaaagtatcctgaatatgctagcgctaaactcattaaggagcctgctttgaagatgatcaaattcatttggatatagaaattctgtgatgttacaaaattagtcttattttttggtagtcatgcccacagtacagtttttgttgtacaagaagcagaggcagcaggtgctgtcattgacaattaagatctcagcatggaagtctcagggtcagtggtgactcagcctgcccaagtgattctatcctgcagcccttatgagccacaaatttaccacacactcaactgagccatgatgtgatgtgtggacggcacaccttgctttttggaagaagaggaaaagtgtcttttcaatgtgacgaccaagctagcagcctttctagtggatagtctcaatgccggctgtggagtcgttcttgtccttgttctaagcccaggaaaattcctctggttggctgctatgcagatgggttttaaccttgagttgactctttttctagtgccagatgcccctcgaaatctccagctgtcactccccagggaagcagaaggtgtgattgtaggccactgggctcctcccatccacacccatggcctcatccgtgagtacattgtaagtaccttccatgagttggctgtatgtgtgttgggggtgctaggagatttctgggtattctgtatgacgagggggttgatttggtttagctttgtaggtgatgacccatccgtcagaacattttgctcctcaccatcttttctctcctccagcctccttgcaagatattaggatgccctggacctttggttccctttactcacattttttttcttctccctttaggtagaatacagcaggagtggttccaagatgtgggcctcccagagggctgctagtaactttacagaaatcaagaacttattggtcaacactctatacaccgtcagagtgagtgtcgtcatccattccagccatccatgcagtcttagaactgagcgaaattgctgctgttttgtgagaactctctactcacctttgtgagatgcatattagtaatctgcaaaatacccaacttcttgccctgggacgggggagctcagagtttctttcagtctcttaaatggacaccacaaagagcttgacatcagagtttctgtagataaccgggcgtttatgggaatgccgctttccctgcttttaactccggtattctgctagctttccagctcctatacttttgcagtcagctctttcctgcttatctttagctgcaggatgatgcagagctatgataagtagtctttctaaactgattttatgaggttcttatgaaatatatttttagtatttttagcagaaagagatagattttgtgaacaacatgtttgctgagaccattaagtgtgcacattcatgactctcacactgataattttgtcagtaccctttttgtatatgtgtgtatttatgaacacacccccccatacacctgccctttagaagaaccttgatatttgtggatcaatagaaattttctgatctcaggactgtcataatgccctttacccaagctccttcccttggcttttttgccctcttatttcagatgctggggcctctgaatattctggatcactctgtataaaatttttccagcctcactgccaaaatctcacccctttagctcattcagtattcttactgtatggtgtatggtgtattgcctttatttcatattaattcaccctctgatttgaaaaggtggctgcggtgactagtcgtggaataggaaactggagcgattctaaatccattaccaccataaaaggaaaaggtaaatgatcccagcatttgcagatttagagaaaatattatacaaaccctttcaaatgactttcagtatgaccggaaaatggagaaacgtagtttagaaaaacatcacacaactttcttctccccaacacacgcacatttttgggtgtctctgtagtgctttagatagagtctttttggggtgactgagtgtctttttcctcctagtattgagcatttcttctaatgcagacatacaaagggatttccaaaggccatcatgcgcagccctttgtgagtagtcaaaatatctaaaatagaaggagtccttccttctcaccaaagctgaagatgattttgtgcatgttcacttacggggttttaaagaaagcaccatgctgactcttgttattctcccagtggcactggcaaactgtgtgtaggtggttttttatcttgtactagagctgatattagtaataactgatggcttgccaagggcaggacactctagagtgttcactgctttgcgtacatcagctcatctaattgaacagtcagaacaactacaagaaaggataaggaactggaatgaggttatgtcacttgtcccaggccacacaatcagtaagtgacagagctggccctggaacctgatctgcctgactccaaagcctgtgctcttaaccactgtgctccacgcttctctctgggctgagacacatgcggcctactggaccgccctgcttgccgggggtggcgggctcagcatcttgcacgagtgcctcatgagggcagagatctggtctgtttttctctactctatcacgggcatctagtagagactaaggaaataattgatgattgagtgaatcgaagcagttaaatgaagggttctggcatactttgggagatggactacaactcattttccagagtggttttcctgaccttagccttgacactggggacttgcatttctggacttccaggtattaaaaccagatggacactgtggcatgcaataggactggaagattttactttaacctaagcctgtgaggaataggctctgggtcatggagagtcactatctagtcccctctaaaatctggagcctttgagatcagggcccaaggcggccaaacgtagtgccaccagatggtctttggagctgaatgcttgcaggtattagagaaagcctgctgaattcacactctcctagaatttttattgttgtatctcttctctctacaaagtctgtttcaaaacactgaccacacataccaagaagggatgttggaagagcaaccaaatacatgtaccttgaattccgaaggcacaagtcacaactgcatttgaaaatctcagtggatggttggttctctttaacttcttttctgtgattttgatgaatctcagctgcttgcatatatttgggctaggatttgtacagaaggcagctgtgtgccacatccaaaaagtgtttgttgtaaaatatctgtgacatagtatcataataacgttttaagataaaggacaaagacagcagaggcatcagccagacgcgccaggttaattggtgaatgtagtggattagtaatgacaatgagaaaagccaccattccctgagcacttcttatacactaagcaccatgctattgttgctcgtgaatggatcccttattaatccttatgaatcctatgagataagtatccttatcctcattgtgtagctgaggaaatgggtttggagtggattgtgacttgtccctggttgccatgattataattcaagtcagctttaccatatgcagcactcgcactgttttgctctgtgttggccgcctgaagcttccaatatcctttcttcttccggttattgcattttcctgaagcctagttttattacatgattgatcatctggacagacctcttcagactttgacacatctcttttgccaccaaatcttatctgctcctttgagtctctcttgcccagtctatagaaggggcatatgtgtggagagtctaatatgcaagttgttgtttaaataatattttctgataatattgatccattgagctcttttagatcatgctgggccaagcactgtcagccatctggtgggaagaccttccagatgacaagcatggcgctcattggttgaactgagaggggtcttttccttggccacttctccttgccccctcgactcttagcttgagctccagtctttttgagagcaccagtggtttctagttgtttagttggccatatgtgacgctatattggaaaggaagagaaagagagtatcagttgagtgctaggcatcacacatacattattttagttaaccttcccagctctgtgaaatgcagataacatctctaggctccaggaagatcagtaacttgcctaggttacacagatgccagaacaggaattcgaactcaagtttgccagcttccagaggccacattctttccattttgccacacgcacgtttaccatttacgatttactccattgtcagccttccgaaaggacttgagattggtgggactttgttagtgccaatcaagatgccactcgcagtgaatgatccctgttcctttaagaaccaggctgaagctgggctgttttgggacctttacaaaatggaacttttctgcctgacctaattgccaggatagccgactgagccaagatagttttgtgttcaccaagcaactgtggaccaaccttagcttcaggaaaacagtggtaaaaaaagatcgatgaggaacactgccaaagaaataccctttcttccccgactgaaagatggctttgtccgttgagttgaaaactattaagtcctgccttcctcacttttcatcacgtggcttctgtttttgaattcctttttgttttcagtgatcccaccaccagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactggaaaaaaacaaaaaacaaaaaacaaaaaaaacgaacggctagatctagtgaagctaaaataccaggactagggtggttccttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatcattgttacctgtgcccatgtggttcctcaagctgagatccgctttccatagtgttccttcttatctgtccctcctcacagcctctccattgatgaatttgtgttgggacaagttgggacaagcaaccttcagagtctttctgccatttacttaactgccatttagtgtcatgaccttggcttcagaatgggttgatataagaaatggcctcggccgggcatggtggctcacgcctgtaatcccagcactttgggaggctgagatgggtggatcacctgaggtcgggagttcgagaccagcctggccaacatggtgaaaccccgtctctactaaaaatacaaaaattagccaggtgtggtggtgcatgcctgtaatcccagctacttggaggctggggcaggagaatcgcttgaacctgggacgcagaggctacagtgagtcaagatcatgccactgcagtccagcctgggcaacagagtgagactctgtctcaaaaaaaagaaaaaaagaaaagaaagaaaaaagaagtgggcttatatgcttcttgtcttgtagtctttgatcttgaaaatatttttgttcgttgtcccatatttaacgatcttcagatcaaatctttttatgagctcaggacttggaaaaggtagtctttcctgatgggtggatgtattttctgtagttagacaatgagatctaaccagcctgttttgtatggattgtcttcttggccttgactgcaaggatttatccttaatttccatggcctaattatctttccagtgtttcctctttctacctttattaattggttctcgtccttttattcttcattcacttttttgtttcattgaatctataaattaaatatggtctcgtttgtttttagaagtaggtggagtacaactaaatattagctaatggtagcacaagtagaacctgtttaaaatttttaaaaaacaacctgttcactgtaagaatgagatacccaaggaaagaacaggaaagaggtgtatttttaatcctgccttttgtatttagtgtgccccatgactagctgttcatctaacatgcttcttggttctcggcaggtgaatggctatgtggtgaaccttttctgggcatttgacacccacaagcaagagaggagaactttgaacttccgaggaagcatattgtcacacaaaggtaacactttggtgctggtcagtgtgtgtgcaggaaggggtaaggctggaccaatgctttcccgctgtagagcttgactgggggtgccagggaaggggaggtattctctggaagctgttctgtgttgacaggttcttgtgcattgaggatcctataagtgtgctgctgattctaggcagagggattcactcagtggcccctcgagccctcctccaacctcatgacccttagtggaagttgggggccataaggaggaaaattggacagaggcaagactaattctctgcagatgagttttgatttccaaaagaaagagttcttagatatagacagttacctgtctgtcctttctagtctggttcactctcccgttgctaatgagagacagcagaaggccttatgcataactggtgttcagtaaatacatgttgactggagaaatggacaacaaactaagggaggagtggtccagtccctgttacgtatgtaccagcagcaagtctcagctaaaattcctctatctaagcacgtgctaaaggatggattttaatttatttctaagtggcgaaagctgcctgtaactgttgagaatgacttgggagcttcttcctgtctcctccttctaggctgtgaagcactttcagtcatgtttttattgagtccttgtcatagccttataaagtagagactacaaatgttctattgttactttttttttttaactgaaagtctacaaggtgcccgaggaggctgttattttgacttttgcacattgagcacctaccatgtacaggcatttacacaggcattctacgcatattatttacataaccccaagtataattccgtgagatatgcccgctttacagaggcaaaactgaagttgaaagaataagtcatacgctcagacggtggcagagccaggattggaacccacatctttctaactccacagcctatgatctcattgccttagtgttgccccagtagaaactggcagagtcaggagcagaagccttaactagctgttgtttgaaatctattagggctagtgcgatgctaggcattatgccaagcacttcctaagcattttctttttttctccctgccagccagcagctgctgtaagtgctgttatttttttctccatcttacaaacaaggaaatagagagtttaaatactttacccaaggttatacaaccacaaagtatagagtcaggccttaaaccccagtccttctgattccaaaggctatcttgttagcgtaacctcccccttctcacttttctttttcttagttttaatagcatttcctctgatcagaaaggggatacatatttgtttcagaaaattgagagaacaaaaagagtgtaatgaaaattaaaattgcctataatttcacttttacatttcagatatcttctaatatatttttccatggattgatctctttatatcttttttctaaaatcagaataatgccataggtagtattgtatcctgcccttttcacttcacataaaattgtgagaattttccagtgtcatcaaatatttttgaaacaacctttagtgcctgcacagtagttgatggaatgcacattatttaattattatcctgttactagacaatcaaattacattcagttttttcctgctgtaacactgtgatggggatccttgttaaacacacttttgagtctttctctgacttcatgggataactggattgaagggtatgatttccaaggttcttgttatacaaggccaaatggcttccaggagcgttgtaccaactcctatccgcggatgggcagctttaaagaaattacccagtgcttgtgcagtgtgttacgtaccgtcatcatcagtacataaacgttgaatgaatttgtcatctaatgacagtcctacagcacatgggactcatttaagtcaagagattactatttttttttaaaaaagtgcatgtaccaagacacgttcttgactaacacccccaacttcctcctggaatctccttttcctgttttcacagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtgagtcagccagaatgaccatcacaaagtgagtgtggactgtcccctaatgctacgccaccacacaactccagggcttttctctcttttgcaaatgttccggtgcccctgctgctcttggatataggcctttctttttcctttgttttcatacgtgcattatgattcactatgatcagatctgtgctcctttttgagtctactgttttactttccactcctccccagtgtgtcccctttgcttttagatcaaccgtcccaaggctcttggcacattcgtccccctcttgcctctgtacttggcttatgccctttctcctccttggtgtccttccctcctcttgctatgcaagaaaatcctcccttctatagttgatctctctccctatgaactcctaatatatttatagttggttccatatagcatgatatttcattgaatacagctttaccctatttgataatttttgtctgttactcttaccttcctaactagtttgtaagttccttgaagggaaggattgttttctggattttctcaatggaaaagcatacagaagtaaatttataataaggaattagtaaatccttagtgatgagcggaggaactagcctaggtctggtcttctgaggatatcttcagcgtgcatttgtcacagggctgagtcatagggaaataaccaaagtttgcaagtagctgtctgtaaaatcagtgaagaagaaggaagaagtaagatttactgagcagccagtaagtgccaggaacaatataaaatccgataaacccctgttcccccttattcctttcattggttctgtgggtaaatattcccattttgccagcaaggaaactaaggctcagtgaggcgaagtaacttgccagagttaaagctctcacaagcagtagactgagtttcagctcaggtctggctaatttaacagcctctgctcttttgtgtgtcccagcacctgacgctgaggcagggacagtgatgagaagccctgacctatccccggagctctcttttacctggaagttgagtctactcataaagaaccctttctttccatttatatacctggcagcacatgaccgcctcatcacccccaactatctctccagagtagggcaattgcacagaacactgaagcctgacttgatttagggtctccaattgtgcatgaagttggaggaggcttcctgcacctcatctcagctcatgcactggtcacactaaaggtggctttcagaggtgagagcgcaaatgagatcacctgtaggaagctctctgcttctgcccctctttagttcattgaggaccctggcagctctcatgattttcctgtctactgtgagaagtgccattgtcactgtgcatgtggggaacctctcatcccttggctcccgtggctctgtggacccctttcctctccagagacaccccatccctggcggtcaccagccttgtcctcggtgatgtcatcctccctctgtactctaagccccgacttggcctactcccatctcatgctttgcagctccacctgcatttgctttgggacccctttgagtccctcagcgcttctctttcctacatcctcccaggcgatcacccccttcggggcttcccttcctgtttctctgtctgtgttctcccatctgtctgtcctttctcatctgtcaacaaaaagagtcaaactctgtaaaatatatgaaaagatttattctgagccaaataggagtgaccatggcccgtgacacagccctcaggaggtcctgagaacatgtgcccaaggtggccgggatgcagcttggttttatacattttagggaggcatgagacatccatcaaatacatttaggaaatacactggtttggtccagaaaggcaggacaactcaaagtgggcatggggaagcaggggtttccaggctatagggaaatttaaacattttctggttgtcaattggttgagtttgtctaaagacctgagattgacggaaaggagatgttcaggttaagataaaagattgtggagaccaaggttcttttgacgtcttttagtggctgcctttaggggaaatagatgacagatgtttcctatccagatctttaaaaggtgcaagacttttagctaatgtctttaggattgggagggcctggaagaaaaagatctagctatgttaatagagattctttacagatgcgaaggttcccccacaaaggacagcttttcagggccatttcaagatatgacaaagaaacatgttttagggtaaaatattttgattttcttccttgtctcataatgttatgccagagtcaacttggaaagtaagtcacgatatataggattaaataaaacccatctgatgagaatttatggtttgtaggacatgactccccagaccccttagatagggatttgggcaagatttaaaaaatcagagcttagtcctcacagctgctgagcagtgctggagaaagtcaccctgttgcctgggacttggaaatccctttgtggatccccgctcagttcctgctcatcccatggatcctgcagctcctacagtcctcgtcaagcccatgtcttacatgtgcacataactcttggagaaaatgctctttgattgtgccttacaaagaaagcttcctcagctcccaccctccagttataaactccctcggcttccactttctgctgtaaacttcatcccattcccacttccctgcttgaaactccctcagtttccaacgtttaccagttaggactaagcagggatgcatagagcagaggaagtgacagtaacagtggcttcgaacagtttatttcctcttgtaattaaaacaagtttagagttgagcagtgcagggcttctgtcgtggcagcacgatttgattgggcacctgagccctgtcatctccagcctgtggcatgtgtcttcaagctcacctcatggtacaagaggcctcctgggcctgcagtcatgatctgtattccaggcgaccagagggcaggaagaagggctcctccctctgttgtaatgagccctcctaaagcttttcctgcgacacttctgcatctcaatggctggaagctctttgtctagcctcttctagcttagggaggttcgcagtttagactttttccaggcagcaattctcaatcagaaccagagttctgaggaagaaagggaggatgggtacctgttggacagccagccgtgtctgctctccttccctccctccacatacttcctggggtgttcgcatccactgtgcaagctcccatggctttccttcccactcagcacatccccttggagcccacgtctgtgctgccaatggtagaatgacaccccctctttaataaccccccgttccctggctcatcatgtgggtttctggtgtagcatctaacactctatgtttgccacttgttatttataattatgtatgtttttcttctctgcccgcctctcctccagaaggagcgctttgaggacagagaccacatcatatttatttttgtagctctacatacagtgcctggcccaagtgccttctctgtaaatgctgtaaatgtaataaatgttgaatgaagacttctctgtgagctcttttgaagcagttccagggtcttaaattggggatttcaaggaaatgagatcatcggcccatgagctgatgtcctcttccattctctgcttttaccaggtttatggtattttctatgccacgtcctttcttgacctctatcgcaacccgaagagcttgactacttcactccacaacaagacggtcattgtcagtaaggatgagcagtatttgtttctggtaagtttcccataccgtttcagttttttaagggatgtcttaagtcctgggctctggtctcaacccaggacctggggagcttgcatacctggactccaggattgatgtgtgtgacgagaggcaacttcctcttcttcataagcatcatcaggttcttgcttgaaatacagaatgaacggccactttcaccaactgcagctccgttatggaggactgataacttggcagatgatcacaagtatagataaatcaaaaatttttatcaggttccacttctaggaatttagcctacatacttttatgtgtgtgccaagatatatggagaaagatacatggtacgttattattcttatgatagcaaaagatgtgaagcaacttaaatgtctatgaagagaggactggttaaacatatcatggtttattcatgcaatggaatgcaggacagccgttcataagaagtatgacaactctaaatgtactgatatggaaaaatctctacgctatattattatataaaagaagccaagagcataatatgtgtgccattttctcagttgtataaaaaatatttgaggaagataggcttcatatacacgtgcatatatgtgtaaggatacacgtacatacatatccttccttatatatgcataggggatttctggaaggaagcacaaaaactcttaccagtggtacctcttggaaaatgatttggggtaggtgggaaattattttatattttatggttttttgtactaactgaattttaattgttgtcattattttgttgaaaaaatactttaataaagattgcataaggccatgatgtattttttttcctacgtgtgtgcttgggcttcaggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttggtgagtgggttgggcttccaggcctctttgtttattcctggcctggttagggtggggtgggatggaaggggatcctctaatggggcaagaaacacaggcctggtttctggcgctcagcaggaggtctctctcccatttcagtctgaccaaagatggggtccgtacagggacctcttcttagttggcacttctccattattcctagctaccattttggtttgtccctctttctcctccgctgctgatatttccttccctgaccctctcacacagggattagcaaacaaaggcctgcaggccaaacacagcccattgcctatttttttaaaataaagttttattggaaccaagtcatgcctatttgtttatatattatatctgaccactttcatgcaatgatcagcagagttgttgtggtggagactatctggccctcaacacctacagtattactgtgtgtggacccttacaaaaagtttctgacccctctttaaaaggagcattgatcctaaacaaaacaaaaaaactgccattttttccttgctctgggttgctcttccctctctcctctctccactccccttcatccagcggtggttggtttaaaatgcttggttgctaatactcctctcaactctccacttccttgtcatgattgaatttcctgtgcttactatatgccctgttattttccccttgcccccctatacccagaagcagcctgggagaaagtaagtagagccttgccctttagagccaggattgaacactttggttcattctctctccaccaacaacatccatgaactattgcagtggtggagatgtggaagttgagtactgagtttggatgtgcttgcttgttccaacctacctgctgatgtcacgataaatgtggccctccctagagggttaaaaaaattttagttgataactctatgtgcaattctatgagtgaatagttattttaagattggatctggtcactccaaaggccttccaaagaatggagtcagatttcgggactcaaactcttgttgctgtgggtcccagctattaatatactacattgtccaccattgaactacaaagagtgaaaaatgtcaactttctgattatcattcacttgttcttttttggtcctagttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacaggtaagcaggagagaggttagaggtcttctcacacagcctgccctcagtgctgtgccgctagacctccagagacagacttttcattaggcgtttgtttcacagggagtgcaaacgctgcccttcaatattcctacaggggcagagtagtgcagaggctccagggtctgagccgtggcgtggtggccagggcacagtgggctggggagtggctatcgttttctttattttctaagtctttttaactcccctcgctggttttgatattactaaaggaaaagaggagggatgcccaagagaggaaataaaactgaatagttgccactaagaccaagtgctgtatctgagaatctggatgacaggttctcagtggtccattgtggcaatctgacatgttgaaatggagggagacccacagctgggcagtagatcaaagggcagtcaggctcaagttcagagagctggtagtaagctccgttgctcagacagcagcaggtattattgggagttttgatattgggtaatggaggcccagccccatttatgctggtggcgtgcagtgggcctgggccatgtgccattgtcactccagtgtcctgtcttcagatggaactccttatcccatcccattccttcctcaccacccttctacccaaccccatttgtttttgtacacacttggttacaagggctattaagtactgtccaaatttcttggctaaagatgttataacaacaataaaagagatgccaataaagaatatctaccatgtgctaggttctgtactcagcaatctatgtgttttattttttctgtaacccagccctccaaggctagcattatttaatctctctttgatagacaagaaaatagagtttcaaatgtatatccactaaccgcatcccatctcatctttaattttcagtttcattatcagcacctgatgccttaaaaatcataacagaaaatgatcatgttcttctgttttggaaaagcctggctttaaaggaaaagcattttaatgaaagcagggtaagttcctccctcattctcaatgactttggaaatttaattgaaatgctgtttcagagatgagcttgttgacagcatgctggcatagatagtgtaaaaaaaaagaaagaaaaagaataggacatggacatgaacttgagaattaaaggaccattttcagtgggattgctaattagcgaaatgcttatactgcccgttaaagatgagaatctctgcactaagcacttttcaatcctgacttgtcttcccctgaagaaagacaaatgggctggaggccatgctgtgcttcccgcagaagctgcagctgggctggggctcagggtgttaaaccaggagcctattccacactcgctgagggtgggactgtggcttcagtaccaggagttgagctgcactctcagcctggcatctcagcactctcttcccagataaattacagggagcaggaggcacttgaagatactgtgctaacttatgaagaacaccttgattttgtttggttttgctattggtaggccaatatggtattcacagcaaaagacaggggaagaggagtgagacctgggagtagatttaccacccaagggtggacagattcttgagtaaagctgggttggccccagagacagcaaagcctttgctaaataggaatgtgatgaatcaactatggctacctggagatgcagcataggcaaagagccatgggttctaaatagtcaccgtgcaataccaaagcaaagtgaaattaaaattggaaaattctcaccacacactctgtgagaattctcataactcttgtaactatgacatctaaatggctaatatccttaaatagaaggaaagctttcaagtaagttcaaaatggaaatattctaattttgaagaagggacatgtaacaaagcggaaaattccagcagcagtaagcaaaaggagaaaagttcaacctcaccggtaatctaaataacaaagaggtaaccctctcatgttaaattggtaaagatttgcagggaagagtataactggtatgaatagtagttggggaagtaaacgttctgggaatatgaattggttcaaactcaagtaaggttcttgggtaatacctatcaaaaacgttgaaagtgttcacacccattgatccagcagttgtaggattttactctaaagcagcaacgtgcatgaagaatttgtgtgtagtatttatgacagcaagaaagaggaaacagccgagatgccgaacagaagaggatgggttaaataacgtatgggtggttgatgttgtgtaatctcaattattttctttataacctttgtgtattttacaaatgatcgacaccagatatctattaggtggaaggtaataactgctggcttataggaaagaatgcggggatgagattccaggcaggtattgggaatcccagttcggcagccagtcgccattaggggatccttcctgggtggctggagcccggctcttaggttaagattctaggttagtatttcgttcctagtggagggtctggcataggcatagcatgtccttcttcccttcccctgacaaggagttcaaagaattgtattagtccgtttccacagtgccaataaagacatacccaagcctgggtaatttataaaggaaggaggtttaattgactcacagttccacatggctgcggaggcctctccatcatggtggaaggcaaagaggagcaaagccacatcttacatggcggcagacaaagagagaatgagagccaagtgaaaggggaaacttcttataaaaccatcagatcttgtgagactattcactaccatgagaacagtataggggaagccgcacccatgatccagtgatctctcaccgggtccctcccacagcacaggagaattataggagctagaattcaagatgagatttgggtggggacacagccaaaccacatcaagaatagatgggtcagtggtattgggatcaagagactgtgattatgcaagggggcccaatatgtggctagagaaaagtgatggagtcttttcagggggatggtggagagtgtcagtagctttgacactggaatagttggggatcagcagagaagtcaggttgtcagccctcatcccagctagtatcctgggccagggctgtccccaggatggctttttccagcaccagagtccagggctgtaactaggaagacatttcatcctctcctccagtgaacaggggcctgagctggcttcagtgcttctgatttcaaggccaggttgttggggggctgagatcggctcagaaggagctagagagcagggagacaggaagtgagccgacaaggtcattcctacatattgttctggggacaaatgtcttgtcttttctaattgcaagttctcctttctcaccccattgctggagtccactgcgacctggatttattattagtcaaattccattatggcaaactgttcagattcttggtggcatttaatattgcttgagacaggcagactgctgagcaaatctctgagtgtggctttggtaaaatgactttcctgagggccacagttttcatttccacgatatagcttgttgtgggggggtggtgtggcagttatttgagatattggagatgagaaaaattttcattttctgaatccagtatctcagtggtaatgtaaaaagaacaaggagaaacccagggcgctttcgcgtctgtagcagcccacagtgaggagctcacataaagatggaaccagtaatagaggctgtcagtttccatattcgacttcctgagcaatctcttgtgtttgttttcagggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgagttgcgattgctgcccgtttctgtcttcagttctagggaaatagcaagaatgtcatatggtttcatgaccatgtgtctttctaaaacacatggaagatattctcagcttaaaagaaaatcatttatatatcagtttggtcaggtagtgatgtatttaacaaatacttcctgagctgaacatggtacaggaagctgagattacagggggaccggattctgaacataaagtgcaagaaaggcaaggctttgtttaaaaagggaaactctaggttcacaagagtttcatttgttttttgtgggacttctcagcacctctaacatgctaatatatcctgtggatctccaagccagtagatcatctccttgtcatggattttacatgtaaaatcatataactgattttacagtgcacacctctgccccgccccggcttcatcttagctctcagcataagcttaggactggaatttgtcctgggatctctgtcttatgtcttatgctgggccatgctagtgatggaagagaggacccttccgttcatacagaaagtctgcttacattatagtagtttggccaggatttcaacaaatgttttgccactggtcttttttagttccatttactctcagccaagaactaaccagtgctcaagccaaaatcttgtgttagagttgttaaatgttccgtctcatagtgtttctcagggtgagatcttgtgcaatatttatccttggcaccccccactaagagagggaaacactgcctgccacttcccttgggagaatcttaacatattagaggttctaagaaggtcctacaaaaaccagcccaactcttgttgacctagtatttcctcaacagagccccatttttaggcaaaactaattggcaacctgtgaaatatgctttgggaaaaattcctgtgcagacccctcccggccacctttatggaaccaaggttgtcaggcagaagggctcttggccaacatcttgccccttcacgttcaccttccccttggaagtggggtgggggagggagggcactccttcctggagctcccagccttcattgtgccgacttcctcttcactgctccagccgcacacacccccttcattaaccactgcacagttggaataggttggaacatattaaataagatgttgctagagtttttttttttttctggcaaggaaataatgaaagaaatgtaaatacagacacgaatattgaattgttagattaggtttgcaagaaacaattgttctctggcccatcttgatgaataccctgtcagggtgaatgcctggggagtgacagagctttctagtgaagcagagacctggcctgcgccacctctcccgacaccagggagcaaccctgagcctgttgaggctcctcatggagacctagactgagggaagtccagtctgtttcctttgccaaaaactgattcctaggtttcattttcaagttcagacttaccctgggatttttaacatgaaaagtctaccgttttcaaggagactggcccctaccccagcaggatgggacgtggggcatggctttgccctagagccctggtggtacaaatctattagtgaatcatcacagagcctgtttgtttaagtcaataggaaggggccatgtttgttaggttataaatgccgaaacggctttgcaaataactttaaaaaatgttaaatgtatatggaaagttgtttttctccctcactctctttttcacttaagtgaaaaacctcataaaacttcatgagctgttaagtctgtattgtggtgtaggaatctcgtttgtatcacttaatggagcttcaggtaattgcagttcagagtgactttggtgccaagtagggggaaataattgcaatctcgttaattagtggtctgatttcacatcctcttatgtaaggcaagcaagtggtcttaagtaataatgctaatgaaatcaatgttgataccccaacaaaggtctcccttccaagagattatctaaataaccaacaaggcagtgattaggagtctaatgtaattaccatatttgcatgcacaaggcccttggtctatcagctcatggcaagtagtggggaagcaatcaggcatcacgcacatgcagaaacgtctcacaccagacaggcagtttgtgtagctgtggctatcgcccagctttttttggtgggtggggccttgaggagtcatctggtctgttctcctgccctcaggtgggcttattggtgggaactttgccttggcaggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggtaagtggggcagggagagtcggttcttcctcccagggctgacccccacgcagccaatgacttgattaggaaacacccaccttcagctcctcttttgaccctggaggagctcttcatcagccagcgatttgattccatgagttttggttaaaccattcagagccctcactttttaacttttaagttaaattaaaatgttgtattctctttgattgtgtagttctggcctgaaacagggagcttgccccaggccttgagactcccaaagtatcggaaaatcctcaagaatatctgacccctgtctcatccttcactgagctggaggtctgacatctctggagatcctaactcaagataaaaaataatgctttcccaatcagcttctatcaaaggagaccctttccatcttgctgtttctctttctggttgctagtgtaacctcaccagccattcttttatgtaccttaacacagtggtccccaaccttttttgcaccagggaccagttttgtggaagataattcttttttcactggaccagcggtggagggggaagggttgggggatgatttcaggatgagactgttccacctcagatcagcaggcattagattctcatagggagcgctcagtctggatcccttgcacgctcagttcacgatagggtttgtgctcctgtgagaatctaatgctgccctgatctgacaggaggcgaggctcaggctgtaatgctctgactcaccactcacagcctgctgtgcggccccccattcctaacaggccatgtactggtactgatggccctcggcccgggcattggggatccctgtcttaacacatagcaagggaaaaagtaagaagtttcccgttttgaaatctttgcacaatgaaaaccctaaatgctaatagagatagtaagatagtaatataataaagtgggtgtgttacgaggcttccccaaacttagactaatcactgtgaatgtacaagtttatttctttccgttaactagttacaattatatatctatgtttataaagacatttgtatattccccttcactgatcatatgatgttagctctgttccctttccttgtcagtttcctttcttgcctaataagccggcacctggactgccttgtgtgaatggggcggcttctttgcttctgccgttggaggcaacaggagtggacccatcagcataccctgcgatagtcactgagtgtcggtccacacttggtgacacaggattataccgggcgtcacaaggggacagctgttagtctgggaagctgtcctcaaaatgcttaaactcctcccagatccttttcctcagagcactttgggttcagaagagaaagcagacactgaagttcactgtgctagtgtagggtatagataactcaaactggggaacccaaactacccacttagcttttgagtaggtaataagagtcttctcctgagaagctttgttttcctaatttggctacgttcaaacgaccactaaaataaatgtgaggatccatcgatgggtagaaggtggccaggagggacagtgggaagctgggctaggtttcacagctgattatggtggctgcctggctatggcattgaccttctcagctagagggttgtggtagggttgaggggtgggtagagtggtgggatatggggtcaggtgaaaatgtgttggaactcaccaaggcctgactgttttgtctctaggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaac

SEQ ID NO: 36423 - DNA, 12893 bp, Homo sapiens
gctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacggtaataaataccaataactgccacttaacttctctcttactatgtgttgggcaccgggccacgcacgttacagcatctcagttaatctgcagagtagcccctatcagatggataacattgccgttttacagcttggagagcttacgtaatttgcccatatttacacctgggaagttaggatttggacccgtgtttaactccaaagctaatgctaggagctgactgttaggctttactcttaggctacagtgtctcgtactgtggcgtgggtattgtgagagatgttcagatactggtcgtgccagaaaggaacgttttattcaatggaataagagatgggccagagtaagcagtgagtggtgcccctctaatggagtgggtggctcccttctttcccagggaatagtttggacaccatatggtcctataaagttggactaggggctggggctgcagacttaggtcatttttctttcgttcttccctccctccccccgcccccagacgaaatctctgtcacccggggtggagtgcagtggcactaacttggctcactgcaacctctgcctcccaggttcaagcagttcttctgcctcagcctcccgagtagctgggattacaggtgtccaccaccacgcctggctgatttttgtatttttagtagagatggggtttcaccatgttggccaggctggtctcgaactcctgacctcaggtgatccgcctgtctcggcctcccaaagtgctgggattacaggcgtgagccactgcgcctgaccaatttttgtatttttagtagagacggggtttcaccatgttggccagcctggtctcgaactcgtggccttaagtgatctgcctgttcaggctcccaaagtgctgggattacaggggtgagccaccacacccggccaaaagacgagaatattttgttaggaaacaatgtcaggtaaggggaaacacatggaccttggttggaattctgacttacttgattgatcttcaatttctttatctataaaatggggatagtaatgtctacctaatattaaatgggatggtgtaaaatgtgaggggcatggtaaatgtttctttctccttttcctatgagatgagtagaggtcttcctggttagtttttgtactttgctctcattttatccattttttaagcctgaaatcaatattgaaatctttaacaaaaatctgcagactctacccccagcccccagtattcttcgtttcagtgaagtaaggtaattagggaggggcagcagcatactcctgccctcaaggctcttggaactcccttcttctagatagtcacttagcccactcctgccttcattcatagttactcaaatgtcacctcctttgagaggccttccctcctgattacctgcctaattctctaacctctaactctatgctggttgtcttcatagcactgtctatttaattttaaatgatatacccaggctggagtgtagtggcatgattgaggctcatccagcctgacctcccgagttcaagcagtcctcccgcctcagcctcccaagtagctggtactataggtgtgcaccaccatgcctggctaatttttttttttttttgtagagctaggggtctccctgtgttgcccaggttggtctcgaggtctcgaactcctgggctcaagcagtccctccaactctgcttcacaaattactgggattgcatctgtgttccatttaagcttgccaagacctaaattgttttgttttgtgttttgagacagagtctcgctctgtcacctaggctggagtgcagtggcccgatctcagctcactgcagcctccacctcccaggttcaaaagattctcctgcctcagcctcccgagtagctaggattacaggcacccaaccactacggctggctaatttttgtattcccaggttggtctcaaactcctgacctcaagtgatctccccacctcagcctctcaaagtgctgggattacaggtatgagccactgcacccagccttcattttttgtttcttgaagcaccaaaagcacagatttattgaaatgaaagtacactccacatagcaggagcaggctcaagcaaacggctcaagagccatctaaattgttagtatgcccaagtaactagattttagtctgtgcaaacagaaacagcccttttgtccaataaacttttctttagccccaactatatgcagagctctgtgctagatgctgtgggagatgcaaggatgaagtcctagtccctaactttgagaagcacatactctgtgagggagacagaaatgtataccatatatactgtgtatcttctagcagtggaaaaataaaaagaaatgtttgccatacagaggtgtagtaccgcctgcacctgagttctagtttcaccacttacttgctgtgttaccttgggcaagtttgttcattgttctagcatcagcttaatcatcttttttttttttttttttttttttaatgaagtaggctgggtgcggtggctcatgcctgtaatcccagcactttgggaggccaaggcgggcagatcacgaggtcaggagatggagaccagggtgaaaccccgtctctactaaaaatacaaaaaattagccggtcgcggtggcgggcgtctgtagtcccagctactcaggaggctgaggcaggagaatggcctgaacccgggaggcggagcttgcagtgagctgagattgcaccactgcactccagcctgggtgacagagtgagactccatctcaaaaaaaaaaaaaagagagaccatcctggccaacatggtgaaaccccatctctactaaaaatacaaaaattagctgggtgtggtggtgcacacctgtagtcccagctactcaggaggctgaggcaggagaatcgcttgaacccgggaggtggaggttgcagtgagctgaaatggcaccacggcactcccgcctggcgatagcaacactccatctcaaaataataaataaaataaaaaggccgggtgctgtggctcacgcctgtaatcccagcactttgggaggccagggcgggtggatcacgaggtcaggagatcgagaccatcctggctaacacggtgaaaccctgtctctactaaaaatacaaaaaaaaaagttagccgggcgtggtggcggccgcctgtagtcccagctactcgggaggctgaggcaggagaatagcgtgaacccgagaggcggagcttgcagtgagccgagatcgcgctactgcactccagcctgggcgacagtgcgagactctgtctcaaaacaaaaataaaaaaatgaagtaataatagtacctatattatagggttgttctgaggattaattgagagaatgcatgtaaagctagcagtgtaacggtgcacttagaacacagttgacacccagtaagtgtcctctagatgtgttattagtaaagctagtagccttcatgtgcctgtacgggggttggctctggaatcccatggacaatgagacctgcccttctcttgcgttggcttactgtgacccaacccagtgtctattcccctgagctcaggtgagccattacttacgtagtagcacttggagtctccatgacaaaaggctggagggtaagagagttggctggatttagtcttgctattgatcctcctccagctgctagaggggattcacactggattacctattttgacaaaaatagtatgagtcttggagcattggctctaaagatcagcctcctggccaggcatggtggctcacacctgtaatccctgcactttgggaggtggaggcgggtggatcacagggtcgggagatggagaccatcctggctaacacggtgaaaccccgtctctactaaaagaaaaaaaatacaaaaaattagccgggtgtggtggcgggcgcctgtagtcccagctactcgggaggccaaggcaggagaatggcaggaacccgggaggcagagcttgcagtgagccaagattgcgctactgcacttcatcctgggcgacagagcgagactccgtctcaaaaaaaaaagaaaaaaaagatcagcctccttaaggagatttgacattttgtttggggcactaacgggaagaaaggcctcctgaaaactgtcaagtggtgtctcacctgagtgtagagctggtttcatttactttgttcaggttgtgcctgaagtacttggagatcatgttagcatagctgctataaatcctgtggtttcttgtctgcaaagcacattcaagtccattatcttactagatcctaccaacaaccctgtgaatggcatgacagattttactgttttactgttactttttttgagttagaagattgaggcttagcccagtgaattgatttacctaagtactcacagctgttaagcagcaagtccagactcagaatcaggctttcaggatcttgctgtgttgtccaggctggaatgcagtggtgtaatcacaattcactgcagccttgacttctcaggctcgagccatcctctcaccttagcctcctgagtagctgggactacaggcatgtaccaccatgcccagctaatttgttctattttttataaagatggggtctcaatgtgtttcctaggctagtctcaaactcctgggctcaggtgaccacttccgacccctgcctccgcctcccaaagtgctgggattataggcatgagccaccatgcccagccagaaagttgtttatattgattcaaaatcttctttctttatgacttgccctcccttttttttttttttttttttggagacagggtttcgctcttgtctcccagcctggagtgcggtggcatgatcttggcttaccgcaacctccgcctcctgggttcaagcaattctcctgccacagcctcccaagtagctgggattacaggcacctagtaccacgcccagctaatttttgtatttttagtagagacggggtttcaccatgttggccaggctcgtcttgaactcctgacctcaggtgatccgcccgcctcggcctcccaaagtgctgtacttgccctccttgaacctagttcagggtgtgatctagcaccacaccacatggaaccagtttaagaataaaaataagtatgtatttcttgagtacctgctgtgcagcaggtgctccacaaacattatctgattggaatttcattggaattacacagtaactctgaaaggcaggtaacattgtcaccattttacagatgggaaaaactaatgttcaggaagattaagcagtggcttaggataacaaagctttttacaggataatgctcaactataagtaggctgttgagtctcagttacttaacctgtcatctgtaaaatggggatgaataatatttgttctgctaacctctcgtggttgttatgagaaactgttacaaaaatagatgtgttgcagaagcgattcatgtttctggtggtagcggagatgtggtgcttatgttcagtgaagagattgggctggttgacctttatgacctttatgatcccatgagaacttttgttttaaaagtcacaagggctgaaaacccaggtcttcagactctgcaacctcccgtcacttatctgatttccttttctgttctctcttgcttactcctctctaaggccaagagtctcccgctgtttctcaaacacaccaggcatacttgtacctcaggatctttagaattagtgcctagaattttttctagaccagctatctatccagatatcttcatggcttaccaaatatcaccttagtgaggccttccctgattattcgattaaaattaaccacccccccaacacacacacgtaaatgcccccaatctgtttttgtgctttatttttctccatagcacctatcaccatctggcaaatcatgtatttcatttggctgtattgtctctccccctcctgttagatagcctggcacacagtaaatgttgaatcagtgatttgttttcattatactatagcccattcctattttatttgtttatatttatatttatttgtattttttgagacagagtctcactcttctacctaggcgggagtacagtggtacaattacagttcactgcaggcttgacatcccaggctcaagccatcctcccgcctcagcctcccaagtagctgggactataggcatccaccaccatgcctggctgatttttaaaatttttttgtaaagttgggggtctcagtgtttgcccaggctggtctcaaattcctgggctcgagtgatccttctgcctcagcctcccaaagtgccgggattaccagtatgagccactgcacctggccatcccttctatttttaaagcataaaggcctttaagttatacatttatgtcactcacagttccacagaggcttggttcgtaattgaagatgaagatagacttgcaaatcaagagagggtatggagagcctaactcagggatcccattccgagatcccaggtatatggattccatgaccaccaacagatctgtccaggaccttgattgttcttattggtaaataggaggtagctgcatgtataaggtgcttgataacatcatgatttgcttgttacttggcatcatggtggcctgaggctcttggagtctccatccaagggctcattaataatggaatgaaagctctcctgatttaatgcagtggtgccaattctctggactggtaactgctggattgtttccatccattcatgctcaaaccattctagtgccaagcccttgactttactaaaaaaatcgttcccctccttaacagcttccccttaattgccatatttggtaaatagtctcttggagacactgatctgactgtttatttgagttcaaagggcctcctgatcctgaaactgactttctttgactctagtgcagctaagttttttgggtattttttttcttctgtttttgtttttattgaggagggcttattaatactacagttgtggggaagagtggataggttgaccattggcttggaaacctttgattttttttctccccaaattacttttgtcaataattagctgtttgtccttgggcacgttctttttttttttttttttttttttttggagacggaatcttgctctgttgcccaggctggagtgcagtggcgtgatcttggctcactgcaacctcctcctcccgggttctagcgattctcctgccttagcctcctgagtagctgggattacaggcacgcgccaccacacccagctaatttttgtatttttagtagagacggggtttcaccgtgttagccaggatggtctcaatctcttgaccttgtgatccgcccgcctcggacttccaaagtgctgggattacaggcgtgagccaccgcgcccagcctccttgggcacattctttaaccattctgggtctcagtttcctcatctctaaagtggggttaattcctgcctttcctggattactgtgttatcatgggatagataatgagatacaagtagaacgcagtatttaagcaaaaggcattcaaattattattcttgtagtgcccccatcatcaggccatggggatggcgtgaggagcattgggtcctcagagcctgggcttttacatttcttagactttcttccccagaaaacttgaagagaggaaggttctttgcttcaaatctgacaaatctccattcagaaggaagagtgtgggtggttatcctgatttttcagccttatttctgagttaattcattggtccagatgtgctgttaatatgtttctcactttaaccctgataatgcctttccccctgcctgctgctttcattcttcagtcttggtatttgtcactcatttcaccttttacatcaatttcttggtagataagtgacagaattcttcttttttttttgacagagtcttgctctgtcgcccaggctggagtgcagtggcacgatctcggctcactgcaagctccgcctcccgggttcatgccattctcctgcctcagcctcctgagtagctgggactacaggcacccgccaccatgcccagcaaattttttgtatttttagtagagacagggttttgccatgttggccaggttggtctcaaacccctgacctcaggtgatccacccgccttgccctcccaaagtgctgggattacaggcatgagtcactgctcctggccccagaattctttatgtgagaaggagtttctgtgattttaactgctattgtaatagaaaccagttgattctgaagagtcacctcttttcctggaaatattttggctgtgagttaagaggaacattattttctcccatgctggtgactttggaaaggggttgtcatcagtgcaatgaacttggtctgggacttccttccttccccatggactgggcccctgggtcctctgttgcttctgggaggggccttgggagtacagtttactctaggccaggacattctaagacatgtggaaaccattggtcacacctgccagcaacagagattagtttgtaaatgtctgtttcaggtgtttcacagcatctagtgaatgaccgttgctcccataccagattctggtgacctgatcttaggcttgacagctgtggtggagacttgggttggcagaagcctaccttggtgtgttggaagagtgattgcttagtgcatgaggtgccttttacagcccattttgcagtagttctggctgcagccctgctgctttgaccttgcaggccaaatttcctggctcctccaaaggggatgatgttctttccctccagacacagttagagggaatcctgacagttgcatcaaggctggtccagactctcaccacgctttctcttttgtgctgcttggtcctgactgccttttgaatctcttttagagctctgagctcttcaccctgacctatggtgccctggtcacccagctatgtaaggactatgaaaatgatgaagatgtgaataaacagctggacaaaatgtgagtgagctccttcataggagagacagaaatggggcctcccagcacactgagtctacattgtcctttagagcttaaaacagggttctctctctttcttagccaacattttgggtacatttctcactaaactcatttactgggatgtttttgagattatccccattttccctttaccaccaacaaccttatgttcaaacataagacatttagactccatcatagtctcttctctaacttccttcccaggggctttaacattggagtccggctgattgaagatttcttggctcggtcaaatgttgggaggtgccatgactttcgggaaactgcggatgtcattgccaaggtcattattctgggccacctgtccatgctgaagaattgctgctgagaggcactgcttaccactctttctatctcccttagagaggcctttaatctcccaaaagactggctaggcagctctttgggtcaaaaaaacattccaggtcgttagggaatagcatagattatttaatccctgtggattaaagccccactgaaatcaaagcctgagcttttccactgtgaaggtgtagcagagtagcatgggggtaaagaatacagactcggtcgggcgtggtggctcacatctgtaatcctagcactttgggaggcccaggcgggtggaacacaagatcaggagttcaagaccagcctggccaagatggtgaaaccccatctctactaaaaatacaaaagtttgctgggcgtggtggcgggcacctgtaatcccaggtactcaggaggctgaggcagagaattgcttgaacccaggaggcggaggttgcagtgagccgagatcacatcactgcattccatcctgggtaacagagcaagactccatctcaaaaaaaaaaaaaaaaaaaatacagactcacaaacctggctccagtacttactagttttgtgtttttagataagttactttaaatttctttaattaccagtgacctcatctttttttttttttctttttttcttttttttgagatggagtctcactcttgttgcccaggctagaatgcaatggtgtgatctcggctcaccacaacctccgccccccgggttcaaatgattcttctgcctcagcctcccgagtagctgcgattacaggcatgcaccaccatgcccggctaattttaattttgtatttttagtagagatggggtttctccatgttggtcaggctggtcttgaactccccacctcaggtgatctgcccacctcggcctcccaaagtgctgggattacaagcgtgagccactgtgcccggcaccagttacctcatctttaacatgaagaaaataagagctacccccagggctgttttaaggagtaaatgaataatggacatgaacatttaggtaaaatgctagtgtttagcatagtgttgtgcatatagtaaatgtttactattactagtattagtgctatctgttatagtattaataaatgacatagcacccataactttgtggtgtcagttacttaaaagttggtctttctgttgtaagcttgctggtcatacccaaatcctaaagaggattgacagtggagggagctttgtgagagtttggaattaggagggtggatagggtaggactttttctctgcccagtaatgtgtattcactttcaagaaggtgcattcaggtagcacagacagaggacagagaagtgggttagggcctctgcactcaggcagccaccgtgtcgaaagactagtgctcccttccactgagaagtacaagcacacagtgagtgagttgttgcttacttgtatgatgcctaggaaagaaaaatgtttctgggaaaacaaaacaaaacaaagcgacaggcaaaactgtatgatgccgtgaaggagaggggtgcagcatcatgtacagatgcttctcctttgttgtcctgagtatctgaagtgtcatcttgcagaggccacaggtttgttcctgagccacttaattcccctttgccagttctgtcaccttccctgtggtacagttcctgctgctcttccccaaagtgctgttgtgtgtcccctgacaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtgagtgcaactctttatcttctgggacacccgaaatgcaatagggacttgataagtgtttaaatgaatgaaagagagaaaagaaagggctttggctcaccccagcgctttactgcctgagatggtgatgctgctgaggtaggatccaagtcggacatctttacatggtgatactcctccataccaggctggtggaaggtggtgctgtcagtccccaaagcccaggaacatccattctcagataggcttatttggtgacagtctcattcttgggtattctttgctaagtttctccttaagggttggagccattgtcttatgcaacagaatgttggcgctgtcaatcttgtccttgtgggaaaccagccccccttttttggatgctgtggatgagtcagttatgccccatccccactggttccctagaggctgtggccaggcagctaccccttcgttttcccactgtcccccaggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatccc

SEQ ID NO: 36424 - DNA, 206368 bp, Homo sapiens
acgctgctgagcccgaggacagacggagacgccgggagccagtggcgcctgtggctccgggcaggggccgcggccgaaagatgccggtccgcaggggccacgtcgctccccaaaacacttacctggacaccatcatccgcaagttcgagggccaaagtgagtgtgtgtatgttggggcggggggacgatctggagtcctggttccgtgaaagggggggctggacccctttactaacttctaaccgggcaaggtggtgagtgccgggtgctgaatgaaaaatccttcttttgatgtccccaacaccttctcctccagggggacccgcttgccttaaatgctgtcctcttttctggaacacaaggagcagcgtgcaggccttccctccctactgccagctgtttccttggtgccccaagttcgaacctccccttccagccactgcctgccccctcatccgcgtcctccagaggcttctctgagtccttcttttccttccttttcatatcctggttctggtcttcccaggagctttcccaggcctgacccccatctggtcacatccctgcctcccttccccacacttttcctgtttccaggaggccttgggccttccttccacctcaagaccctcactgccctagtcttcccacaatccccaggcctgactccctccctcattccggtcactgccctgctcctctgcctaaattccccttactgccaccaagagtccttatgatctttccctcccagccgctggatcctggctcccatggactttttgcctcccacctcccaccccaggtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatggtgaggcatactcaggccagaggctttgcagggcaggcttggccctctgtcttgtccagccagggtggccttggggaaggcactgacccagggtccaaagggcctgaacaaaccctgtttcttctaggggccttggttcctccacaggcattggatatgatgccttctgaggtcctttgcaggagctagggatcaggctgggccacccactggttctggcctggggcagggcctcctgctctgccatccctctgctgtgtccctggtctcctggctctccactatcttactgtcagccccagcggtcaggcagctgggatggaaattaaccttccctcctctccgtctgctccaaggattagaggaggagtcacctcctgaagacctctgtggccaggcaaggcatgggggcttttggctggcaaagtggggtgggcctgccttatccagtctcagctctttggggagacagggtctggagttttccctgaccaagaagctcattcagatggagtttgggttgttactgccagctggagcatactgcaagcagaacagaagcgtaagtcaggagctgaagacagatctcagcagcccttggaaatcctcccccaccccccaggaccacagggtcctcactggacctggcagcatgggtgggaacgaggaaaagagcctgaatgtcctgggaaatctcttgaatcaatggcccccaacctggttctgcatcagaattacccagagcatgttttccaaaacatgctttctctacagagaggctgactcagaaggtgtgagatgaggccaagcgggtgtatttggaaatatctccctggtggttctgatgtcctgcttactttaggaaccactggcttaggtaaatcccttcatttcatagatgtggaagggatttgcccaagatcccactgctagagtccaacctgggactggaacccaagtctctggattcctccctcggagatttcttttgagtaatcccaagaggagagaaaggaccccagctgcctttgtgtttacaggcaggatttctggggaaggaggtgctcaggggagagaagtccccagggaaggcaggcatgaggccacctgagtggagataaagaatggatgtctctggatcgggaccgaggagtgctgagagaccaggtttcaggggcctggagtgtgtgaaacatgagcatgtgtgtgcttgcatgtgtgtgcctctgtgtgtgagtgtgtgcttgcaagttcacgcctgtgtgtgtgtgtttgcaggcttctcagagttacagcttctcgggtaggtcctggttgttcctgctgctgccacttgagtgagtggcagtgggaagtgcaacaggcagcggcagccaggaagggactgggaagaatctggcttagtgtggcagtactcacagggttaatgaactcagaatatttttaaaagctgtgacctcacctcctcacatcattgcagaggagaggtggcagtcaggggagtgagaagggtcctggggaacaggatgggacagcaggaaatgggggttacagcaggtcctttcttttcctctccttgacactagagctatacctgatcccagattcctagggatgtcaggtgatggctcttgaggtcccctcagcaccctgaaggtgtctgggcagagggcagaagtcaaagcctggccttggccccctgagatcaggactcagatcagaatcctgtgggagtcctcaggtctcagaagggaacctaggaaccttgtcttgggggctgaccctcggtgaaaatgggaaattgcccacatacctggtgccccataagtcccaatctactcccatcccaccctcggcccttccctatcttattgcccaaggctttgatttacctggaccttcctgaaattgtcctgaaacccagaaaggggagcttcctggcctgcattacactaagggaaggatattgtgctcagataactgatgttcaccttaaggtccactctgacctcatataatcctttttttttttttttttttgagacagggtcttgctctgtcacgcaggctggcaagaacatagctcactgcagcctcccatcccagcctcctgagtagctgagactacaggcgcgcaccctcacacccgactaattttttaattttttgtagggatgggggtctcactatgttgcccaggctggcacatgatccatttttgaccatattcatgtacacttacagtcctgctgaggggcatcctaatggtgatttctttcctcctcgggtcagtacctcccttccccccaacccccaactccagggaggtgggaaggggtcctgagcagatctctagctgatttatgtataatcctcttttcctctaaaggggtaatccactgaaaattctcgaagtcaaagtggagggtttgtgttcacatagctccacgttgtgcagctacagacatttgggctcaaagaggccagggcacttggcaaaaataccccgggagacatctcagagacccctgggaaactggctcttcctctatttgcctttgctaggagtggtgagaacctaacagataaggaggaatggggatgtggcaggactagaactggtgagagtttggcaggaagaaaggagagcactcagatccccccactgtcacccacgcctgccccgcactggcacctgcccgggagcccaccccagcctgcctttcctgggtcctcttctctgaggatcccgaaccagagagtcccctaatccccaagccagatcagaggagtcctgggacttctccagtcctcagctcttgatgaggaggatgggacaaggggctgctgtctgcccccaccctcctcccatgtttaccatatgcacatctgtgaatgccaggaggaccaagctaggaggcagcatgcagcggccaccctctcagtggcagctttttggctttttgtagcaccagcctctccctggggactcaccacagtgctggatggggtgtgcatcgggagacagaggtgaagacaacaaggaggttgtgagtgctgggaaactgaacgaaggagcacattcaagagggagagaagaggagagagaattggggtctcccaggggagagaagtggggtgcctttgctaagaaaagtaagaacctagcatataagaaggaatgggaattcccagggggcagacaaacctgctgcccttggtcagaaaggtgggtgctgggaggagctcctgcaaggaagaagcaggcagagactgtggctcctcctccagggccctggtgagggcacaggaacaccatccctcctgggcataacctgagatggtacagttacccacttttggtcacctagatgtgggcttttgttgtgtgggggctctgagccacgggtaagcaaggacaacctggggcagggggagagagaatgctctggactcttccaaatcctcctagcctcctgtctgcctacccaacaggccacaggcatgggggcagggcatggggtaccacgcactggcaccccaccccagccccagacctcactgctataacgggctggtctttggtccattcccagccgcagttttccaattgcatcaattttccagtaacatcaattgctgggtgcagccacgccaagactgtgtattgacagcccccagcagcttagagagccctggaggccttctgcccctctgcccagctctgccctctccctgccccctgccaggacagatctctgcagtgccagagagattgacaatataatctggccttaggagcagtgtccgaggccactggccaaggaggctccctgtctaggtcccagcgtccacgtgtcaccatgccccaggctgactggagttatgggcttgggcctgggagtctgggcctatagcactatgtgcccaggagtgggtgaagcaggcaggcgcctctccccagtgtgggtgtctcccctgggcccaggcagcagatggtagatggctgcctggtgcctgggagtccagaaatccaatacgagagattcctactccccagggaggaaagcgagagggaggatatgggtggctcagctgcaccccagctctgatggctgtgaggaggggctgaggacgaaacaaggagtctggtggagagtcattccagtgagctccacagcagtgatactcccaccagcggccggcctgcgtcccccacacgtgggcttccatacattcagtcaacaaacaacacctgggacaggtgaaacagagcctaacctgccctcagggagtgcagctctgccttctcatctgcgtggtcacctgaggcccctgccccctgaggatcctgccctttgggcctgacatctgccaacagtttgagttgagggacataggactcccatggagagggtgctcgtggggtgcctggcctggggctcttgggtatggggtattttgtttgtttgtttgtttgtttgagacagagtctcgctctgtcacccaggctggagtgcagtggcatgatcttggttcactgcaaccttggcctcctgggttcaagcgattctcctgcctcagcctcctgagtagctgggactacaggtgcgcaccaccacgcctggctaatttttgtatttttagtacagacggggtttcaccatgttggccaggctggtcttgaattcctggcctcaagtgattcgcctgcctcagcctcccaaagtgctgggattacaggcatgagccaccacgcccggccaggcatggggcattttagctggtattgttccatccaccaaagggggctgcagccagaccctggaggggcagagtctacgacctgagaggcacagagcagccagccgctgggtgtgggctgcccaagataatggggaaggtggccagaggggcctgccctgcccccacagggccatcctcctccctctgtggtgcccaggccactactctgcctgctccctgggcccagccctgccttgggaccccacactcctcctaggcccagagcagcagcctggttctggccccagcactctcctcccaaacaagtcccttcccttttccaagctattgtgtcctgcaaacccagggatcctctctccatgctccctcccagcccttgaaagtcagtttctgagaacctcaggctctcttctgcagaatgggggtccatgcctgccccccaaggacctcctgaggccaaatgttccaactggccccatgcccagcacttagtgtactttcaacaacaaattcctccctgcatcacaggagcagggcatctttgcaggatgggaatatgggaagagcgcccagggccaacccagctccatggggtagaatgcccagcctcacctccccacttaatccacccccatctgctcagctttaattacagcagaagcagacctcgaggttaagctctgagctgatggccgagcgtggacttgggcctgatctgatgctaccttatctcctaataagcagcttaaccgctctccccacctctgccctgtgggtggagcaccagctgagcagcctcacccaccctctgcccagtatctctggtcactgtccaagcctcttcacccgtggctgcccttcacttgaccttcactcagccccttccctagccaggccactgcaggaggggaccccttcagggcccaccccccatcctcccaatggtgttcgcagcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccggtgaggcagagtgagggtggtggtgggagggacgcatgagggtcccctggccgtggctgctctgactcctggccctggtttcagagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtgcgggcctgcagagcagggtgtgcagagctgtgccaggcctccagggtcccctcccaggctctgggcccaggcccttctggggccttggccgataaagagatcctgcctgtccagcctctaatatctggtttgagccccgggcctcctgtcctgtttgagacctaaagacctgaaggcctgccctgaggtcacagcccttgtgcccagctcctagagccagaggaggctggggtcagtagggcctgtgaatgatgccacctcctaggcctggagaagccagggcaggggatggacatggaggccaccatgggggcctgaccaaggctcagcccgtcacagggaaggagaggcagagaggagacatgccaaggccatactgagaggagagctggtgtgggggggggtcccagccctgtgccagccctttgcctttgagacaaaagccaccctccctacttccttccaatgtgaacacaggatcctcctgcatgccaggcagggcaggatgaggctggcacctccagctatctttaatcagcttcctgggggccaggccctgaaggaccccggcagctcctccttggccaccccaaggcaggcttccctgggttctctgctccagctcaccctgctgtcccttctcatgaggccggaagccctgaccattccagagggaaatgcgaggagccctgcccgaggctccagtgaccacagtcctggcactgactccctgtgtgaccttggccaggggaactatcagccccctttctaggcctcagggctttcatctgcaggagagagatggactaaatggtctctggggacccatttgacattgagtagttctggccccaggaggcagacaaagctgtaagtcatagccaggggcccaggccaaggttgagcaatgcagagcatggaggggcctgctcccagctttcctggggctgtccctgtgttggggctggaggcagctcttttccccctgcctgttttcacctaaagcacagttgctgctggaaccaggtgtggggaagaccactcagcacctcactgacctcaaggatcctgaggagggtgggacgccaggctgcaggactgtgtcctctgaggtcaggcagagtggcccaaaggcctgaccctgggaagccccccagctgcttactccaggacatcttaggttgatgccactgttggtggctaccacggagggggctgttagactggagagtggtcggtaaagacagccaggcctggctgggcccatagtcccggcacctgcccaacctgcctacccgtttgttcctcagcttggcccctcttggtgtcactcccctgctccatgtgggtcctaggtccagggaggtgcctgacagatctcaggggaaagagcaggcgaggacccagatcagggaagtcacatcggcctcaaccagaacttaaagagcctcgatggctgtggcctcacactggagcctgggcatcctgagggccttgcagctctgggggacactgggcagggtgggctttgccacgaagagcctcgagctggctttggaggcagtgggagattttgggggtccccctgtctgggggccctgagaagctgaggaactctattctcagcctactttaaaccaccccccaccattccttctgtctccctcccactccccacccaggcaggcctagggaagggccttgtttcaccctagcagggtcctagcagccctcaggaggaggaggagcagctctgatgcccagggtgtgacggcagctgctcctgatcagagccccagtttgcagtgctcattcaaggacctgcagttgagagcccatgtggaccaagagctgggcacacagcggggagagggccagtgagggagccaaactcagtgagcccatggctcagtggagcaccaccatgcagctaggtggatacaggggcagggagaaaataaaaaaagagcccaagtctatgtggagtcggagggggcttcctggggaagtacgaggtgaggcctcaaggctgagcaggtcactgcagggtggggacatggtagccccactcaagggtttggatgtcagatagggaccctctggttgaaactaaatggatctgccttactgtgatcccatctgctaattgatttggtttgcaaggtcaaaccttacattgcaaattttcctaaatcagaactatccaccagatctcatctggtgggagaggaggtccatggaacacccctccggctccatccttgtctggagcagtgtctgatgaggctgagggaggaggagggtggacagggaattactgtgtagagcagcacctgccatctccatgagaatagatggatctcactaactacatgagaagagatgcatctcatttcctcactacccatggcttttgttgtcctttgtgattccattttgcagatgagggaactgaggctcacagaggttacaaaacttgcccaaggctcacctatagcacatgtcagacctgggattcaaccggggaggcctggcttcagtacccatgcccttcctaatgccctggctgtctctcatgttgggcagctgggcagagccagggcatgttgtgctgggacctagagatcctgggttgatcacagtcttggaggcgggggcgggaggggagaagggagaagggaaggctctgcagaaggtgatgattccaaacccttggagatgtggggaggagtcagttttccttggtgcccaggacccgttgagggtccaggttggctacacccctaccccatggactctttccatgggaggctctgagttggcctcagagagggcactcactggtcctggatccccagggccctcagaaaggaagacattcttctaggggtgacctgttcccatcaggaaccctgaccatagggagcctcctaagctcaccagagaggatcagcccatcagctaccccttctgtgggctcttgtgtggaatgggtctatagatgtccatgggcctggccctcccctgcctggctccacccactccaggatgtttccaagggagcttgtgagcatcaaacctggtgtcgctatggggcggagccatacccctcctcttgcatcccaactcctttctctgcacttcctctcgaggcatctgtccccttaggaacttgccttctcagacaccccccaccccatctctccctcatcccctctgcccaccagagccgtggtcacccaccctctcccactacaccttccccaggcctcagccctctaggccagtctcaccagcagtggctgccccgtgcctgacctccctcggcccccacccccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgatcaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgaggtgagcagaccccctccaggccagcagccatggctgtcctctgcacgctggcctcaagccctccctgctgcacagcactgggtgcggagagtatctggcactgggcacctttgctgaagcacgtggaggtggagaggaggccccaaacatctgtcacctcccagccctggagaaggacctgccaaggctgcacccccaggcctctgtccctctgccccctctctgagcaggccctggtaagaggagcaggctgccccttccaggatgggcactcgtgtggtcccggcccctcatgctgacttccaaactgcactcaccctggaggaagaaagggatccccaggccactcccccagtgcaccctggctcccaccttgctccctagccctccactatgtccacctggctgcccataggtgacgtgaaggcatctacatgcctttctcatagcttccagtcccacggtctcctcttgccccctctcctcacgatcagcttttcactgaaatcaactctgccttctgtgttccagtgcccccttatcaccccagcctgtccagcagggggtgtccagcagggctcctctgctccaaagccccctaagaccacccctcaacaaatccaccctcctaccttgctgcccccacctggacactgagtggccttcgtactcacttgtgtcccatcaccaaacttgccagtctcccgcccctccacacagctgccacagcgactttcagatcgcctacctgaccctgtgttccaccctctggggtgtacagggtcctcagaattttcagtggcttcccaaggcctacagactagaagccaagttcatgatggaccctgaagcccacaggcagcagcccctgcccgccctgcccttcccaggcacggctctcactgctcctccatctcccatgtgcgcatcgggctgcagtgccacactcggtttcccacatcggccacgcacttcacacctcagtgccgctgctcatgctgctccctgagccaggagtgccctttccctctctctcctgtctgtctggagccctagcctcctctctccaggctcagctcatgcgtcacctcatccatgaagcctcccctgacctccccttcctctgttctcccactggacttctgtcctagcaaccagaacactattctgagctttaggctgagatcctcaatgtcccatactgtgccacactgccaagtgcgtggcccggaggaagttctccataaatgtttgttgaatgagtatgtggttgtatgcatgagtgaacaaaagcaggcctgactgcacccttccaagggctgaccccagccctgtgaccatttccctacccctccagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctgtgagtgagacctcatgccacggcctaacttcatgctctggtcttacccgtgaaattttatgtgtagttttgtactgagatagaacataacacatagcaacaattcatgcagtacactgatcctaagtgtgcagcacaatgaatttttgctggtgtgtgcaccaagtgtatacaatatttaacacccacacagcccatgctatctgccaggcaccaagacaggctacataatttgcagagcccagagcaaaatgaaattgtagggacccttgtttaaaaattattaagaatcggccagatgctgtggctcaaggctgtaatcccagcactccaggacaccaaggtgggtgggtcacccgaggtcaagagttcaagactagcctggccaatatggtgaaaccccatttttactaaaaaatacaaaaattagccaggtgtggtggcacatgcctataatcccagctactcgggaggctgaggcaggagaatcagttgaacctgggaggtggaggttgcagtgagccaagatcgtgccactgcacttcagcttaggtgacagagtgagactccgtctcaaaaaagaaaaaaaaattattaagaatttttcgccaggcatggtggctcactcctgtaatcccagcactttgggaggccgaggtgggcggatcatgaggtcaggagttcaagaccagcctgaccaacatggtgaaaccctgtctctactaaaaatacaaaaattagccggcgtggtggtacacacctgtaatcccagctactcaggaggctgaggcaggagaattgcttgaacctgggaggtggagcttgcatgagccgagatcacaccactgcactccagcctgggagacagagcaagactccgtctcaaaaaaaaaaaaaaaaaaaaaaaaagaatttttcgacagtgacagcagagtattaaaccaaatgcagggctcttagcatgcggctccgtgtgtccacatgggttgtacacatgaagccagctctgccaggcactcttttaaacactttacaaaagcccacatttcattcccttctgagcctggtttacaaagcaagaacccaggtagtgctaaagtgccagagggcacacagctaggaaatgtccgagtgactcaatcccagcccaggggttcagctccaaggctgtgctgttctcaatccctgctcccagctgcctgcctcccaagacacctggtttaggaaaacaagagtcagcgtggaattttacacatagattgagttgtgatgttcagagtatttagagatatgaaagtccagaaaaacaaaaacaagggaagaaaatgggtgaaaacaagaaattgagagtttgctcttttttgttgttgtgggtttttttgttttgagacagtctcattctgtcgcccaggctggagctcagtggcatggtcttggctcactgcaacctctgcctcctgggttcaagcgattctcatgcctcagcctcccgagtagctgggattacagacgggcatcaccatgcccggctaatttttctatttttttggtacagacggggtttcaccatgttgtctgggttggtctcgaactcctgacctcaggtgatctgcccacctcggcctcccaaagtgctgggattacaggcctgagccaccacacccggcggagagttttatctttattgtatttttacaacttaaaggagaaaacagatctgaactttaaaaatccattgccttccttctttcttctcgggagtttgaccgctaggcccagtaagatgccaagaggcacaggacagagggaggagggcagaaagcccaggggcctttgtcccgcatgtgccctggcgctgtcctggtcactcctgacttctccctggacagaggggtccttcaccagggggctgctggaaggaggaagacctgggtaagcccttggtggtgtggcccagtggggccgcggaggagctcactctccgccccgcccccagccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgagccccgccgctccggctaatgccccgggcgtgggggggagccaagatcctgcgggggcggggcgtccccagagccctcaccaccctctcccccagccccaccccggccgcgtcccgctggacttggccgcccgccttgcaggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggtgggtccggcggagtggaccaggcctgtgttggggattggatggaagagggcgggattggagatgccctgcccaggccaccctcttcctgatgaggattttacttttactggcagccacttgcacagcatgtgcccgggagagctttagacccagctggctgaatccttaaaacaaccctctgccggaggtcccattttcctgagagggaagttgaggctgagggagatcatgctagtctgtggccaggcagggattccagggctgccagtgtgactcagaagcccaggcaggtcttcctaccttcttgcactcttggggagtttagggagaaaggccaagggtctttctgggtggaggtggatgccctggctggggaccccagtctcattcagtgcagacacagggatagctagacactttggaggaaggacatgagcactgggcaggggggacagacaggtcacaagcagcctctgtcacatacctgctgtgtgaccttgggcaagtcactttgcctctctgagcatcacagggtcctcttgattctcatcttccttgcctgccccatgacttcatctccaccccaacttcagcctcgccctcctttggtacccatgacctggctatcctccagcccctctggacaggttcccctcgggcagccctccccctctgcttcctctggactgctggtgatctgctctcctcgcccctcctcacctgacaccctcccctgggcctgctcctcgctcccacggcttcagccttcacctgtgccacaaggagccctgtcctcaccccactgtctccttagaccagaatattccatttcttcctgggcatggccgccctagtattctatgaacagatcaaactcaatgtatcccaacctgaaatcacctttcctcaaaaccagctgcttcagcatccccatcactgtgaagcatctgcctattgcccacgccacagtctgccaagggggcatcctacttcattcctgcccactgtccaccagccagacttgtccatacctctccatctcacacctgtctccctgtccctgcctggatccagccctctttgggtccttcctggaaaggtgttgggaactcctttcccatggccctgcgtctggtttactcccatgcctgtcttccaccttctgccagtgacctgaaatagacatctgtacatctgcctcttctgctcaagatccctccacagttccccatggtccatgcatggcatccccagttatcccaatccgaccaccctgtcctaccaccctccccctggtacttcatgctccagccaaactacttagagttctctaaatctgtgcccttgcatgtgctgccattctgcctggagcgccctaccctgtgccagtccggcagatcccagttgtcctccaaggctgggcttaggcacaggtttctgtatgagaccttccctcactcccagcctaccttagacgtgccatccatggccaggcacggtggctcatgcctgtaatcccagcactttgggaggccgaggtgggtgatcacaaggtcaggagttcaagaccaacctggccaagatgatgaaaccccatccctactagaaatacaaaaaattagcccggcatggtggcgggtgcctgtaatcccagctacttgggaggctgaggcagagaattgcttgaacccaggaggtggaaattgcagtaaaccaagatcacgccactgtactccagcctgggtggcagagcgagactctgtctttaaaaaaaaaaagtgccatcacatgggagggatgattattattattaataattaagaagttaatccaatttaagtttcagttagagacatgaaacctctcattttgtcctgagtagaaaaagacactagatcagaatctttcatctactggaaaaccatcacattataatgttgcccagatttcaagcttcagggtttcatgtgtgaccctggcaagccgcttccctctccaggcctcagccccctcctttgtgaataccctttgatcctgttctcttgtggggacatgtctcagcctccacccatccttctgtgctaaactgttactgccacttgcactaacaagtggactttctgggggagtgggaatcaaagcagtcatgctccgtggcaccccggccctgggctctccacccctgagccctgacagtgcagtgctgatcacatgctgtttcttctgtcctgactgcctttctcatgggggctggtccttgtttctctcgacacagcccccacttcacttcctctgtaagccccctcctctctgccccagccacccctggcaggaggagcccctccctcctccatggccccataactcttggttcttcctgtttctagggctctacagatcatgctgtaaacttgttggctgcttacgtacctatcttgcagggatttgggagggtccttgtgggtggcacaacatcttatatttatatcctttggccagcacagcacctggcaccaggagggcccagtacccttgccacataccacatacctgaacatcacccatgtctaccctgggatattcccccttgccttgcatggacctagtcaggtgcctcttgcttttttttttttttttttttgagatggagtctcgctctgtcacccaggctggagtacagtggtgtgatctcagctccctgcaaactctgcctcccgggttcaagtgattcttctgcctcagcctcccgagtagctgggattacaggccaccatgccctgctaatttttgtttttgctgttgttgtttttagtagagatgcggtttcaccgtgttggccagactggtctcgaaccgacctcaaataatccactaccctcagcctcccaaagtgctgggattacaggcgtgagccgctgagccctgctgcctgttgctttttgagtcactttctcaagcatcacctcatctgcttccctgaacagtccagtggggttggcaaggcagatcaggttttatccattttagagatgaagactctggggtctagacagggggagtaacttccccaagcttccttcaccagggccatgctggttacctggccccacaattgggagtgggaagacagagaagcctctggccctgccctggcggagttaggtgctctggccctgggttccctgcaccctgctccacagcactggcaggccaagcagcaggaagacgttgagacagatgttgagcctttagggccccttcctgcccactgtgccaaagagtatgggctacaggagggagattctgatggagggtggttctgaagggcctggagacagtgagaggagccacacgccggatctctgtgccgctcaaaggacacaggaagagaacagccccacccctaccctgccacccacagccagcacatccagccatgtccccagagctctatcccaggcagcaggccccggcctagaaggatgtccgaggttgggggaggtcacggtcaaaggaccctcataagggagcatggagtcagaccctgaagagactcccacccctctggctggcaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgtgagtcagggccaggtgggccagggtgggtggaaatgcccaggcagcctgcctggcctgagggcacccatctgaccaacacccttcctttcaaccccatcctgcaacctttgccataatttcttttgtgcctaccatggctggcgtcatgctaagtatgaggatagctactatttattaagcagtagggtgctaagggtggggcttcttttacatgatcttcttgcaaatggtattattatccccaattttcagatgaggaaactgaggattagagacaataaataaattggccaaagccattcagctagtcaacggcagagccaaaatgtgaatttaatttgtctgactccaaagcccaggcattcctactacatcataccaagctgaaaaagggggtgccttctgtccagagggctcacagtgccagacacaggggctgccaagaggtgacaaagctgtctcttctcatgctcatccctcagtagaggagattttgacaactcaagaaaaataaagagccacaaagtaaaacagccaaagtcacgaaggtataaaggagaagccatgtggagctcaagcttgctaaggagtgggacagccaggaccgacctgggaatgcccagagcggggtatcacggaggaggaaactaatgggaagaagggagtgtgcatctggcagggaaacacagagcccgggctatttcttccctggtgccccgcccctccaccttgggggagggccctgctggcgtaggccctgtgcccagcttcctgagcatagagctgggtgggctttctggctgtggacagccctccccacaccatcccctctccccctcctcagtttctcccctccctcccgcgatctgcacaggagactgacaggttaggactctgccctcggcccccagccatcaggtggccagaatgcccagcagctgggcaccaggacaggaggggtgtggtctctgcagcctgggccacctgcaggaagtcgtccagggcatcgctgctgtgcccagctgcttgtcattctttcacctagttgtgacagcaccatggggtcagggcagggaagaacaaagaggccccatcccagctttggttcctgttatttcaccctcttgcttcccataaggcagccgggggtctccactcatccccccgacaggctcctggcagccaagaccaccaaggtttctttctcagtgacaaccagtcaggtgagcaaagccagcccccacccccaccagcctgtagcccctgcccagcctcctacccctcccatgtcctctccatcctgcctccccagcgccaccccactccatgagtggagaggggctccctctctagacccagagctggagccttggccctccttcctccccagtctcccagtcctgatggtctgtgtcctcagaggcagagtgagggctctgtggttcaaatgcaacccccaggggtgtatggagactagccagccccctgaggttccacaccaaggcatcaggggggccactgggctgcagctccctgggcagtgaaaccagtgctaaaagtcctcaccctgccagggtctccccatgagctggggccccagttcccctctaagggctacagcctcctgggtcctgggagccagaactccatgggggcaggaccttgtgctccagggcacccaggtaaggagagccactcctcacaccctgtgtccccagggcaggtagggggtgggggacaggctctattgagaagggtcaggcctgtggaaccagctaggcccagctgagacttccctttccctcctgcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggtgtgtgtgctgtggtcagggctgggggctggtcatgggtagcccctcctagtggctcagacacatcacagggtgccaggtgggttttagaatggggcaggccatttagctgcaggtctccccatacctgtcattaagcacaattcccccaatgacttcccctagcaaactctggaacatgccaagggagcttctcgggggaggggcacaaccatgtgcagaaacaaattccataggtcctgggaaagggagtgtgtcctgtggatggcagggctatggtggcagagcgagggcttagaggcagaacagtccaggttcaaattctggctctgttccctaccagcaagagtgtgggcaagttactaaacagctctgaacctagtttgcccttttgtgaaatggggataattggaacatccacatcaaagcatcttggggactgaatcttgtatgcttggtgcctgctcactggtgttgttaagagtcaggggtgtaccagggggattctgggccggggctgtggatcccagtaaggaaatagcttcaggtaggccccaggccgccattccatctagcaggaacagcacgcaggctacaagattgacagctgccctcaggaactacttttgccagccctgaccctgactgtggggttctgtctggcaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacaggtaagaggtgaggggattcccaggggcttacctgcgagcagctgcatgccttccctaccctgacttgttcacagtgcagcatcaggcccagagcctctgtggccccagagcagccagggcttctgcttacctcctttatgatcagagtcatgatagggttagcctgggcaaggtgctggcaaagcccagaatgtgactccagagcctgcagctggggccagggcagcaggaccctgaggtgtgggaagggcaggtacaatttttgcctgatcccatccctgaaatcagggtggattaacccgcagcctggcctggggtgcatccctctttcttgctcctcccagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactcaaaaaaaaaaaaaaaaaagatcttggggaggcagacagccccccagatgggcctctcctaaagtagctacaaactgctgatccaggtgacccaggatggcgtgggtgaagaagctcacgacttttcccagcctcctccagggctccatttaaacagcaagcctggtgcagggtgggagagtctcaggtgtggaggcagcttacaggattgagggggcagtgaagaaagaggtttctgatctacatgagtaccttgctctgagcctcccagctcagaaccctccagcacctcatggctcagcaccaaggcccggggttggtcagaactcttaccatgagcctctgacctggctggagatggaggtatgttctgtggcagacatgtcaggacagtcctccagccctctgctcctgatggttctgtgacattgggtctcttgagggcagtggagtgtcacacagctaataaagtacacatttcatgttggactgggtgtgtaacttatctgaaggtcattacgtctttgactgtgctgtggctttctccaaacccttcttgtaaggagctgcagacttaccctccaccatatccagtgtgttggggacctgaaggtggttctgctgggcccagaggctcctggagcctggggctgttaggccgaggtgaagggaagcagaggcactggcttggtggccctaggggatcatgacaacagccaacacttcggtagcactcgccccgtaccaggcactgtgctgacagctctgcagatacttgttcatctaatcctcaaaacaaccccaacgggttggtattattatccccattttacagatgtgggatcagtagcagagagactaagacacccaaacatgagggggatttctgaggtgcaggtactgttctgtttcctgatctaggtgctggttacaggtgttcaggttgcgaaagagtgtgcttctgtgtgtaaattatacctcagttaaaaagaaaataaaaataaaaaaagaggccaggtgtagtggctcatgcctgtaatcccagggctttgggaggaggatgaggcaggaggactgcttgaggccaggagtccaaggttacagtaagccgtgattgcatcactgaactcacaccctgggcaagggaataagaccctgtctcaaaatgaaaattttaaaaatcatccccgtgcccaacacggggcatttgtattgacccatttctacccaaatagcagcgatttgagagccaccaccatctattttaaaaacacaagaaacccttctttaacatcgttcttttttcttttctcataattcccacttattcctcccatagttttatcctacatgtaatttattggtatgcttcaaagcctaatattgatcaccctatcatatgtttgcaacacaaatatgtatacaggctgggtgcagtggctcactcatgcctgtaatcccaacactttgggaggctgaggctggaagattgcttgagccaggaattcaagaccagcctgggcagcatagctcaacctggtctctacaaaacaatttttttttaattagccaagcattgtgatgcgcacctgtagtcccaggtactacagggcttgctgggaggcttgggtgggagagtcacttgaacctaagaggtcaagactgcagtaagccatgttcatgcaactgtactccagcccgggtaacagagcaagactcggtctcttaaaaaaaaaaaaaaaagtggctgggcgcagtggctcacacctgtaatcccagcactttgggaggctgaggtgggcagatcacgaggtcaggagatcaagaccatcctggctaacagggtgaaaccccatctctactaaaaatacaaaaaaaatagccaggcgtggtggcaggtgcctgtagtcccagctactcgggaggctgaggcaggagaatggcgtgaacccaggaggtggagcttgtagtgagccaagatcgtgccactgcactccagcgtgggcaacagagcaagactccgtttcaaaaaaaaagtaggtcggtcatggggtggctcatgcctataatcccagcattttgggaggctgaggtgggaggaccagttgaacccagcctgggcaacatagcaagatcttgtctctacaaaaaataaaggaggcaggaggattgcttgagcccgggaggtcaaggctgcaataagcactgtttgccccactgcaccaccacctggataacagagcaagaccctgcctcaaaacgaatgtgtataaattaattgacattttaaaattaatttttgtaaccttaataaggctttaagggttacatctattagtagtacagttgttcaaaacaacataaatatatattcaattttctaataaaaactaaaattttattggaaatatacgtcataaaagagaaaatttcctccccccgttagttcctatatctgtggataaatatcattattttttattagaataagacaaggtaccgcgaattttgtacgtctttttctttcctttttaaatttgtttttaaactttcctccttacaggggatttcctttagctgggcatggtggcgggcgcctgtaatcccagctactcaggaggctgaagcaagagaatcacttgaaccctaaaggcagaggttgcagtgagccgagatagtgccactgcactacagcccgggcgacagagtgagactccatctcaaaaataaaataaaattaaaaaaaaaagaggatttcttggccagatgcggtggctcacgcctgtaatcccaacactttgggaggccgaggctggaagatcatttgaggtcaggagttcgacaccagaatggccaacatggtgaaaccccatctctactaaaaatacaaaaattagctggctgtggtggtgcacccctgtaatctcagctactcgggaggctgaagcaggagaatcacttgaacctgggaggtggaaaaatcatttatcattaaaaattatatttagtgcccagaatggtggctcaagcctgtaatcccagtactttaggatgctgatgtgggaggatcgcttgagcccaggagttcgagatcagcctgggcaacatggagagatctcatctctacaaataataatttaaaaatagctaggtgtggtggcaaatgtctgtggttccagctactccagaggctaaagtgggggaatcgtttgaacctaggcagtccaggctacagtgagcccttatcacaccagtgcactccagcctgggtgacagggcaagaccctgtctttaaaaaaaaaaaaaaaaagtatttaatgttatcatccaacaattcaatacaaacctccttcaattttgatgaaagctgagaattggaaataatttatataaaggtgtcatttggtctctggcccttccccttttccaactcacaggcacagatacctttggggctggattagcatttgcgttgggatccacggcgggaagggtacaggatgggaactgacaaaaacagagccaagctggtcgggtcggtgcctaccccagaattcggggacatttctagatcctgcaggaaagcgcgggagggcctgactcaagctggcctggccctgagcgcatctgcgcgcccgaagcctgtccctgaggcacggagagagcagctttcgggttaaaagggccctgggaagagatggggcgggaaggtggtacccgttgggcgcaggccaggctgccaggccgcagggctctgtcccgcgaaagtcagtaggtcttccactaaggcagaattgtacttttactcgacagcgtggagaggccgctcagaacagcagcagcggaggggaagtcagcgcaggtcacagacggtttcactctcagagacttggcctagaacttggaggcccgctgctacagcacgctcgcctccaggccacccacgcccccaccacccgcactgagccgttatctgcctgactgacatcttggccaaccaatgacctttggggctgccaaagcgcctgcctccgagagttgggcggggcgagtagttgcaatgacaaacatttaacccaatagcgaggagatttcagacgctacggccgcaataaccaatgacaagaaagaatcctttcgaaaggacgtgtcaggcaaccaacggccggtgccgctgcgggggtccggcggcttccgttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggtgggccgggcaggggctcggaacccagctggcggggagcgggccccgggagcgccctttccgggccggagcccaggcctcagaaccctcttgcggactcgccctagggccacggagcggttcctctgtctggccctgtgctgaaggtttcgtactcgttgtctgtctcctttaatccaggcagcattcttgtgtagtcggcagtgtagtggggaaactgaggcacggttttgtgacttgcctgggtcaggcagctatttcggggtggaaacaggtcttaaaaccgggtttacgccccaaagatactccatttattcatcccgtgctctccactcctgccgcattgctttcgttggtgggcggggaagggaagagagagtgatagctgtgaaggaaaatgcaggcgcttctattggtggtcgtgcactcctggccacactagatttctattaagacgatctattgtacaagcttccccgccccctactcccaccccccccgggtactcatggatcctagcccttctgccagaattactgttgctcttgcttcctgatatccattctctctaaagcaatctctttggaaatcttggcctgtggcatgatcccgccgttgtttcctgaacacagaaggatgacagggccttatctcttggcttgtttcgtgctagtacagttgtgtgacctttagtagtaagtcttgctggacatacatcaatttgagaatcctttatagaagcacggtgtagtaggggagcttttaaactggcattgcaacaaactcatttttgaaagttgaataagtcagttggaagaattttctttcttccttttactcaaagttgtgaatgatagcgatcagagcaactgaaagctgtggctagtgatatttaaagccactactcctgctttatgccatgaacatcagatttaagaagagtaaaactggccgggcgcggtggctcacgcctgtaatcccaggactttgggaggccgaggcgggcggattacctgagctcaggagttcgcgaccagcctgggtaacacggtgaaaccccgtctctactaaaatacaaaaaaaaaaaaaaaaaaaaaaaaaaaaaaaaaaaaaaaagccgggcgtagcttagtgcgcctgtagtcccagctactcggaagtctgaggctggagaattgcttgaacctgggaggcggaggttgcagtgagccgagatggcgccactgcactccagcctgggcgacagagtgagactctgtctcagaaaaaaaaagaagaataaaactgttcagtgacaaggctgatgcaggggggaagaaaccaggtggtcctgtctggttattgactagctgtgagatgttgcacaggcctgttttattatctgtgacccacagtttgtacggaaggggttctggtttacatgtgagggtcttgtaaaaaagaaatttgaacatttcacagtttgtttacagtttttcaggagcacatttgtttctctagagtaggtcctctttggagtccactttgagaagctgatgaaagctatggattctcattgtccagacattacacatacatgaacaatttacaaacaaatccaaggaatatgcactgatctttaagtccacccattgcccgggcgagatagagctttctttcctctgttgcttctttcttccttatggcccatagtggacagcagaactggaaatgggattcacgattctgatgtggacaccgtgttaataaaattaagaccactagaactattgtttaaagatacacgtggaaaataaaaaagtatgtctttcaaagggcttaagtctttttacacaaattaatgttttttcttgtaagtttttccagggtcgttgggtaagcaatagttactcctattcctcagagaggagaaactgagccacagttaggctgcttggtaggatcagtggagtagtcaaactgctgttgcaggaactctaccccagtttgtcctttcatttagcaactatctggagcttcctctttgtgacaggcacacaggtagcatggcttagcagtgaaatgcaaactaataaccccactatcaacagcattagcagttaactatatcttaactcacatgatgtaggcaatgcgctgtcttaaaatcatttttgtgcctccacctatcagtagatcagggttcttaaattctgtgtgccatggtcatctgataccaatagaccccttctcatagttatgttttcaaatgcataaaacacatagaattacaaaagaaaccacttatgttgcactacagatataaacaacatgttttttaaagtggtgatgtagtcatatgtacttttaataaattaacttattgatttacaccatccactgtaattattaatgtaattttgaaatggtgacaagggtaaacagcatttcaagatgcttaacaactgtgctgtggtgggaaaaaaaaattctcttgctggcaaagtcacagacagtcataccactgtgagcacctgaccccatttgtaattgaaggaaacaaaaaaatttagctagaggttaatggaaatatggggataattttccaattcaagttcacagaccccaagttaagaaaccctgcgagagagaagtatgtgtagtggttggtgagcagcaaatcctgccttaaagtgattctcaggctaagtttgtgagaaaccctgccaaagaggtggtcgacttcataatttggaggaactttagaattattggttggaatttttagaccattggttcctgcttgccatggatagtggtcaccagcagaggataaagtaaaatggacacagcaaattaacactgatgaaaaaggctagaagtggtcatctttttagtgtggagacattcactaagaaaacatggttgtaatttttaaaaatttgcattagcataatcatgttttcctaacgtaaaattgtacctagttgatccatagaattaagtctatcaacagtttaagaaattgacttccaggtgttccttcatgtgaataaatttgggaattgttgcagagtaaagaaacagattctatcaactacacttggaataaaaagccccattatagggctgggcgtggtggctcacacctgtaatcttagcactttgggaggctgagatgggagaatcgcttgagcccgggagtttgataccaacctgggcaacatggagaaaccctgactctacaaaaacattaaaaaattagccaggtatggtggcatctgcctgtagtaccagctacttgggaagctgaggtaggaggatgctttaagctcaggaggcagaggttatagtgagccaagatcacgccactgcactccagcctgggcgacagagccagaccctgtctcaaaaaacagcctcattattggttattatgtttctaccttcttttgttgtggtctcttgagggatacagcaagattggtgttggagcaacaggttctctaaattttagtgtgtgagaatcctgagggagctgcacattcctgggctccacccctgaagttaacagacttggagataggtgacagacacactagtggttgagtggtccagatggcactctcagaacatggccctggagctgccttggcatctgttggccagaggcgagaatgtgatctttttgtgtctgcatgctcctaaacattggttctgcccttccatccaagttcacccatgaaaaaagctctgtgattagcctgggttatctaagtcctgccacttcccagttttgtattgccttgggcaagttatcctctgtgtctcagtttcatcatctgtaaaattagggcaataaataataacatctaccttgttcaaagattaaatgagttaatatatgtaatggacttaggaacgccacccggtgtggaataagccatatagagatgttagctgttatttaattattatcattactgtacctgtaattgaaatataaccaaagagaattatatggctgtttagtaaatttacttttgtattttccagaaaggattcaggaataagaggtcagaaaggtagctgaaaaggtcattatttcattctctgccttttaaagactctggggggaaaattcccttatctctttcaacccaactcattttgtagtctagcagattcttatagtcagactccaagtagtgtaattttctagtttaaatccattttctcttgttctacctggcttacctacgtaagtcagatataagaatttggcatttctcctgtgttttgacaatatgtttggtctttaggcccaggtgttatttcccctcttttattgggaaaagctgggtagcagttcctgggcttctgttccacttaagtgcatgtttcagggttggttttgataaagatggcagtgtgattgggatttagtttgccccagtatttaactgactacttgtgctctaagatttggcatccagagagtatttttgaggttctgaggagagactgtaggtatatctgatgctttttggagaatcctagtagtgagtctgggtggcatgaccaccttgtacttgaaacactgggatgggtactcacctcaccagcctgtgttgattcctctgaggtttttaatacaattactttatatgtttgatgcataattatttcgactccggtatttaatttttcatcttggtatttgcggtagcccttcaggattatcattcatttgctcattaatttagccggtctgtattgaacacatactcatgtgttttaggcacaatgtgttttggtacacatcagtacttttgatagatatttagaatgtcgcagtgttccacgagtccctgtcaagactgtcagcaggggaatttaagacataaaactcttctggttttaacttcctcctttttctagacagtgagaggactcattccctgttgtgaccactggataaaagtgataatgctttaaaaaaaaatgctactttattgctttttgtcctaatcttgttcacatagacttattggagatgctgtcacttgaacaaggagtgaatctatgctctgtaggtagcctggcttgcctaaggacttgctgccaaagctctcgctgccagagctctctggtcagcctctgagccacgagccaaaggtgtgctgtgccagaattcatcttaaagtttaatagggcaggaccttgggtacctgcagacactggtccttggtaatcagtcaggaagaggcttgaagagaaagcaaatagaaaagaccaggaaaagctagtgtatattctcagaatattgtgttagccgatttttgttttattaacaattgtgggaaaatgttccagtgactggagtgttatgttgatttggataacttgggagcttattttaaaaattacatatacatacacacattcaccttcttcttctgcactaggactgtgtgtgttaaagtggaatatggccaggcgcagtggctcatgcctgtaatccctgcactttgggaggtggatgcaggcagatcacctgaggtcgggagttcaagaccagcctgaccaacatggagaaaccctgtctctactaaaaatacaaaattagccagacatggtggcacatgcctgtaatcctagctacttgggaggctgaggcaggagaatagtttgaacctgggaggcagaagttgcagtgaacggagattgtgccactgcactccagcctaggcaacagagcaagactgtttcaaaaagaaaaaataaatcagggccgggcgcagtggctcatgcctgtaatcccagcactttgggaggctgaggctggcggatcacgaggtcaggagtttgagaccagcctgaccaacatggtgaaaccccggctctactaaaaatataaaaattagccagatgtggtggtgcgtgcctgtaatccaagctacttgggaggctgaggcaggagaatcacttgaacctgggaggcggaggtgtggtgagccaagattgtgccactgcaccagcctgggtgacagagtgaaactccatctcaaaagaaaaaacaaattagctgggagtggtagcatgcacctgtagtcccagctactcaggaggctgagatggaaggatcacttgagcccaggaggtcaaggctgcagtgagccaagatcttgccactgaactcccgctggggtgacagagcgagaccgccatctcaaaaccaaaaaaacaaaacaaatggaatcagcacaatagctgtagaaagatgctattagaaaggatggggggaaatggaaaataagtggcagataaagtacccatactaaaaagatgtctttagcttggttgaaaaataattgtcagtcctaccactgtgagttcaaagaacttaagaaaatacagaacttcaagcagagatatagaggattgggtaaaataaggcatggcaaagagaaaatataacatcagctggcagagcacacaggaaagtagtggaagagaaaactaaaattatcacaggattaaaagccacattggaaacagaataaaggctgggcacagtggttcactcctgtaatcccagctacttgggacactgaggcaggagacttacttgaacctgggaagaggaggttgcagtgagccgagatcatgtcactgtactccagcctgggtgatgaagtgagactgtcaaaaaaaaaaagaaagaaagaaacagaataaagatgaacacacagtgctgaaaacagtaaaggttagggaggacagattgaaaaatgaaactgaagaaaacaatgagaacataatagatgcagaaagtaaaagagatctgacgtaagtataattggtgtccctcaagaagaggaccaaagaaatgaaacaaactcaaatatatggttaaagaagaacttagaagtaaagatttgaagtgataagttcaaattggcatgatttgaacttgccaaagatttgaagtgataagttcaaattggcatgaagtgataagaaaaattggcactgaacagttggcactgaaacatttcctaggaaaatttcttttttaaaaaatttatcttatttttcgtgtgttttgttttgttttgagacagtgtctcactctgttgcccaggctgggtgcagaggcatgatcccagctcactgcactcttgacctcctaggcttaatcgattgtcccacctctgcctcccgagtagctgagactacaggtgcacaccaccacgcccgctaatttttgtatttcttgtagaggcagggttttgccatgttgcccaggctggtctcaaactgtgggctcaagtgatccactaacctcagtctcccaaagtgctgggactacaggcctggcacagagcctggcatccctaggaacatttctatgttttaaggatgaagaaagaattatttggacacccagacaaaatgatcaagtcctctttaagaggggaaaagaaattaggctagctacatttgatgacagaaggccatggagcaatgtctaggaatgtacaaatactgtagattgtgctgctataaatacttggggatatacttaggcatatgtaaggtttatgtggaaataataatgctggggaacacaaaacaatactcgaaaaatgggaaggtattctcttttcttgtatagtaaagcttggtatcctaaagatgtcagtgtccctaaacttaatgtaatccctgtttaaaataccacagttgttttttctggagacagggtctcgctctgtcgcccaggctagagtgcagtagtgtgagtataactcactgtaacctcaaactcctgggcttaatcagtaggtgtctcactatgttgctcagactggtcttgagctcctgacctcaaacagtcctcctgcctgcccaacccaaagtgctggggttacaggcataggccaccatacctggccaaaaatactccagatttttaataatggttttttagaaccaggcaaactgattgtttctacagataaattttacaaacatgcacacattgtcaaaaaacttctgaaaaggtggactaatgatggatattaaaacataatgcaaagatataataaataagatcgtttgatactctaagaactgatgtataaacagagtctagaaatgaactcagaatacaaaaagaaatgtagtctgtgctaaaggtgataggaaatgaagaaaaaatatttttaaggccaggcacagtggctcacgcctgtaattccagcactttgggaggcgggggcaggcagatcacgaggtcaggagttcgagaccagcctggccaacatagtgaaagcccgtctctactaaaaatacgaaaaattagccaggcatggtggtgggcacctgtaatcctcgctacttgggaggctgaggcaggagaatcacttgaacccaggaggtggaggttgcagtgagccaagattgcatcattgcactccagcccgggtgacagtgtgagacccatatatatatatatatgtatatatatatacatacatatatatacgtatatatatgtatgtatatatatatgtgtatatatatgtatatatatatgtatatatatgtatatatatacgtatatatatatgtgtgtgtatatatatatatatatatttttaataattggtattgaaaccagaaaaaaaaattggatctctaccttaagctttgtaccagccgggtgcagtggctcacacctgtaatcccagcactttgggaggctgaggcgggtggatcgcctaaggtcaggagtttgagaccagtctggtcagcatggtgaaaccctgtctctactaaaaatgcaaaaagtagccgggcatggtggcaggtgcctgtaatcccagctactcgggaagctgaggcaggagaatcgcttgaacccaggaggcagagattgcagtgagccgagatggcaccattgcactccagcctgggcaacagagtgggactccgtctcaaagaaaaaaaaaccttgtaccagaattccagataaatggaagaatgtaaacatataactgtaaaacacgggagaatcttggtgtgagaaagccatgaaagtagaagtaaactatataaaaataaaatctctgtaacaaaaccaaagtcaaaagataagtgacaaactgaaaaaatacatgtaatgtcctagacaaagaacaaatcccttaataactgcatataaagatctgcaaatcaccaggagaccagtcacccagtagaaaaagagaaatagataggaagagtttccagaaaggatatgtaaatgattcttgaacgtatgaagaactgaacctcataagaaaaaaaaaaaatggagtttcagctagattaggaaaaataaaaaaccgtggtaatctactgtgtgtgtgtgtatacacgtatgtgtagctttcccatgcagttgctatcaaaatttaaattggcattattttccacctggtagttccgctagtggtaattcatcctacagctatactcatgtggttgaaatgactaaagtgcaaggatattcattttagcattatttgtaaaagaaaaatatgaaaatattattattagggaaattgttgaataaattatgctacctccatgcagctgttaaaagaatgagctagcttttcatatactgatatggaatattttaaaataaatattcggtggaaaaatatgtagaagagtaaacacctgtgttttttaaaagcatatgcatatacatatgtacacccatatgtggttgtgtgtagaagggatacacaagaaattgataacattgatttttccagggaaagggactgggatgtaggggctctaatttgtactgtaattgctttgcttttatgcctttcaaaatttgggccttgtgtatgtattacctagtaagaaagttagtaataaaaaagctaacattaataaaaattaaatcttagtagaacttcagaaagaggaataaacagaaaggaatgaatgaagaagcactaggcatatagtagcaagaagcagttctttttatagagaagaagtcaggcatgataatattaacatcagataaaattcaaggcaaaaatgttgaaacaaaaggaaatattttacatgttaaacatacaggctgggcgtgatggctcacacctgtaatccccactacaggctgggtgcagtggctcatgcctgtaatcccagcactttgggaggctgaggcagtcagatcacttgaggtcaggagttcaagaccagcctggccaacatggtgaaaccttgtctcaaaatacaaaaattagttgggtgtagtggtgtgtgcctgtaatcccagctacttaggaggctgaggcaggagaatgacttgaacccgggaggcggaggttgcagtgagctgagatcacgccactgcactccagcctgggcaatagagcaagactctatctcaaaaaataaaaaagaaaagtacaaccgactaagaataaaaagtcataagtctttacatatctaagagtatagcgtttaaatagaaagcaaaaattttgtaaatatagggagaatttggttcatatgttggaaattgttaagtgaagtagacaaaacaaggatatagagggttagaaaattacagtttgttcacacctgtaatcccagcgctttgggaggctgaggctggcagatcattgggcccaggagtttgagatcagcctgggcaacatggtgaaactccatctctatcaaaatataaaaaatagccagatgtggtggcaccatgcctgtggtttcagctacttgggagggtgaggtgggaggatcgcttgagcccagaaggcagtggcttgcagtgagcctagatcgagccactgtacttcagtctgggtgacagagtgagaccccatctcgaaagaagaaaatgtgttataagtatagagagctttgcattcaacggaaaattcactttaaacaataacccaatttacaaaaactgtgtatttagaaaaaaaatttttttaagttgaaatcaactgattggaaaaaaaatgctacatatcaaaacttacaggaaggtgaggaacctgaagctcagctatgtgctaagtggcttgcccaaagtcatataaggggtaaaggagggccagaactagagtgctgtctgtctccagagtgttcagaataaatgtatgtcaatgtccaaaaaaaaaaaaaaaaaacttagggggaaaaagaacatgttgaaaaacagaggaacacttaccctaccagattagaataaacatactggaattgatatagccagagagataggtggaactgaatagaatatttcaaagacaactttagtatatataaatgtgaaatatgtgataagatagaactgtaattcactgggtaaaagattacatcgtatggcacagttgttcatctagcagaaaaatttagaacccctaattcacagtgtatgatgaaaactaattccagatcaaacgtctaattataaaggaaagtccacaaacattattagaaagttgatcaggaaatttgtcatgaggcagtgggggtgcgcacggacactcattaattaattccagagtcaacaaaggaaaagattggcagattctatagtacatacaaataaaacatttctctgtgaaagatatgccatggacaaagtcaaaagacagcagaaaatattttctttttttattttttattttttattttttattattattattatactttaagttttagggtacatgtgcacaatgtgcaggttagttacatatgtatacacgtgccatgctggtgcgctgcacccactaactcgtcatctagcattaggtatatctcccagtgctatccctcccccctccccccaccccacaacagtccccagagtgtgatgttccccttcctgtgtccgtgtgttctcattgttcaattcccacctatgagtgagaatatgcacaagaacaaaaaaccaaacaccgcagaaaatattttcttttttttttttttcttttgagacactgtcttgctctatgagctgggctggagtacagtggcacaattcacagctcactgcagcctcaacctctcaggctcaagagattcttccacctcagcctcccaagttgctagaattacagacgcacaacaccctgcctggctagttatttttattttttgtagagatgggatctcgccatattgcccaggctggtcttgaactctgggctcaagcaatcctcccaccttagcttcccaaaatagtgggataatgggcatgagccaccaagccctgcctggcggaaaatattttcaaaacatgacagacaatagtagctaatactcaatgcaatagaaaaatggacaaagggtatgaatatctagttcataggagaggaaatgcaagtgatcagtaaacaggaaaaatgctgaacctcacaggtagttaagggaaatgagaattgtgatatcatctttcccttttaaatttataaaaattaagttattgcttctagtgctgttgacagtatggagaaatgaacacctttacatactgctgctaagaatgttagttgctacagtctatttgaaaagtaagttggtgtctattaaaatttaaaatgcacatactttctaatacagaaatcccactgttaggacattggcctccagaaaaaaatacagcagttcataaacacatatgtacaaaggcatataaataagtagtggtggctgggcgtggtggctcatgcctgtaatccctggagctcaagagtttgaaatcagcctgggcaacatggtgaaatcccatctctataaaacaaaacaaaacaaaaatttagcctagcatggtggtgggcacctctagtctcagctactcgggaggctgagatgggaggatcacttgaacccaggaggtggaggttgcagtgagctgagatcgtgccactgcactccagcttgggcgacagagtgagattctgtctcaaataaataaataaataaataaataaataaataataaaaataagtagcggcaagtaagagaaaacagtgtacagcactgggggaatcccggtacatagattaaaaaaatgatttggctcttcatattgctctgagggatgtccattattttgtcaaattaatagagattcatagccttggctctagaatttcatttttctaaaagttgagggaaaactttacacttaatgtatatatgtttgaccatatagaagaatgtagaagcaacacacaacaaattatgtgatatcttggggatgacatagagggatgttaactttatacacacacacacacacacacacacacatacacatatatacacacacacctgtgttttgtttgattttatatgatgtgatacactttataatcctcttacaatctaaaagtacatttaaagaatgtaataaacccaattggaatgtcatcaaaatagataaaacttgtaaaaatggacaagaaaatgttagaggatataatggtaaggggttcaggctagaactctggtatctaaattctagcactcacctctttttccactggagtcttatcaaggaaattatatacaaataatagtagccaaaggggaaacctagcatcattttattaataaccgaacaagaaccactaatgtggtgctgctccctggtgaactaagtggggaaaatgcagtttggccttgaagcctcagtgaaactttctgcttttctacctctgactcaaggacagacccaatctgacctctcctacccagttgtaggttcagagaaactggagcggaggatggtcaggcccattctgaggaggccaatttgcctgtccatgtaggagcaggataagccagagccagagagccatgggacatgtctgactgtagagtggtcaggcccatgcacctgtctcgggcttcagccaatcacttcagcaattcttcccccaccggaggagctagtgagtggtggggacagaagagcagaactcccacgctcagtattccctccatgggggactggggcaaaaactcatccttcctatgggcataggcggaaatgtggtgttgggggatgaggagcttaaagaatgagagtgctactaacaatttgtaacagtacagtcacgaatctagatgaggagttgggctcagtggctcatgcctataattcccagcactttgggaggaccaaggtgtcaggattgcttgaggccagtaattggaggctgtggtaagctatgatcatgccactgcgttccagcctgggtgagagtgagaccccatctcttagaaaaagagagaaagtccttacaaatcaataagaaagagatatccacaacccagtagaaaaactggacaaatgttctaagctggtgatttccgtgtaatggtgaagagtttgggtagtgggatgggactgcctgtatttaaaatagagctttgtggccgggcatggtggctcacacctgcaatcccagcactttgggaggctgaggtgggcggatcacctggggttgggagttggagaccagcttgaccaccatggagaaaccccgtctctactaaaaatacaaaaattagctgggcgtggtggtgcatgcctataatcctagctactgaggcaggagaatcacttgaacccgggaggtagaagttgtggtgagccaagatcgcaccattgcactccagcctgggcaacaagagcaaaactctgtctcaaaaaaataataaataataataataataaaatggagctttgtgatattgggcaagatatttaactcaacattctttactgaaagtgggaagaataatagtacctacctcatggcagtattgagaggattaaatgagatgatgtgtgtaaagcattaataatgcttatacttggtccatgtaagtgctcagttattaatgattattgttattcaaaagtaaaggtagtcaatgaacaaatgtactcagcctctggccaggtgcagtggctcacgcctgtaatctcagcactttggaaggcctaggtaggcaaatcacttgaggtcaggagttcgagaccagcctgatcaacatggcgaaaccctgtctctactaaaaatacaaaaattagctgggcatggtggtgtgtacctataatcctagctactcaggaaactgaggcaggagaatcgcttgaacccaggaggcagaagttgcaatgagccaagattacaccactgcactccagcctgggcaagagagtgagactccgtctcaaaaacaaaacgaaaatcccagcactttgggaggccgaggtgggcggaccatgaggtcaggagatcgagaccatcctggctaacactgtgaaaccctgtctctactaaaaatacaaaaaaattagccgggcgtggtggtaggcgcctgtagtcccagctactcgggaggctgaggcaggagaatggcgtgaacctgggaggcggaacttagagtgagcagagatggcgccactgcacaccagcctgggcaaaagagcgagactctgtctcaaaaaaaaaaaaacaacagttacacttatagaatctgtccaataaaaacatttgcacacacatacaaaaataaatgagtaagagtagtagtattagcaaaagtagagtagtattgtattagcaaacaatggtacataaccaaaacaactgaatagttaaataaattatggtgtgcttaccataatctgctatagaagaatgagggaaaggagagctatttgtactgaagatcttctaagattattgttaaaagcaaattgcagaatacagctgacaacggtggctgacactggtaatcccagcaatatgggaggccagggcgggaggattgtttgagcccaggagttcgagggagaccctatctctacagacaattcaaaaattagctaggtgtggtgtctgtgtacctgtggtcccagctccttaagaggctgaaggatcgcctgagcaggaggatcgcctgagcctgggaggtcaaggctgcagtgagctgtgatcatgccaccgctctacagtttgggtgacagaatgagaccttgtctcaaaaaaaagttgcagaatacattttatgatgcaagtctatttaagcttttttctttctttctttcttttttaaacagatgaggtctcattatgttgcccaggctggtctcaaactactgggctcaagtgatactcccttctcagtctcccaaagtgctgggattacaggtgtgagccactgcacctagcacctatttatgcttttttaaaaaaagaaaaaaccacacacaaatacatggagaagtatttggaaagatgcacaccaaatagcatcagtaaggatttttgagggtcagtaagcagatgggaggctttactcttttactctgtattatatgcatattcagagagaacttatattttctttcatcattaaatttaaatggatatctgaacaaaaaaaaattgaacaacatgagagccaattgtaattcctctcaatatttggttggcaacttggagcagaagagccagtgtcagtttggctgaggctaaaacacacacttgtgcaaacacaatgtagtctttggaaagagaaactaggctgtgtgattagaacattcaggtgggccaggactgtctattgtaagtagtacaatcttgaaatgttgaagaaaacacaatcaattttggaaagagatgaatttctggtcagaaatattataaagcacacaacatgctaaactctagtcgtaggcaaagcttacattgttttgtaacagtacatgagattttatttggcgtccttcttttttttcccccctaagacaaggtctcactttgttgcccaggctggagtgcggtggcacaatcacagctcactacagccttgactttctgggttcgggtggtcctcccatctcagcctcctgagtaactgggactacaggcccgtgcaaccacacctggctaatttttttttacttcttacagagatgggattttgtcatgttgcccaggctggtctcaaattcctcttgggctcaagtaatcctctggccttggcatcccagggtgttgggattatagtcatgagccaccgcacccagcctggcatccttcttaaatatagcatgtaccctgaaattttaccctgattttgttttgttattgtttttgttttttgagatggagtctcgctctgttgcccaggctggagtgcagtggcgtgatctcagctcaccataacctccacctcctgggttcaagcgattctcctgcctcagcctcccaagtagctgggactacaggcatgcaccacctcacccagctaatttttgtatttttagtagagccaggctggcctcgaactcctgacctcaagtgatccacccgcctcagcctcccaaagtgctgggattacaagagtgagccaccgtgcccaggtctgatttcggatgtagaaagatacatggtagaattgggcatgccctaagatattccagagaagctttgcattttattcggggtactatatgtagaaagttcttagtctttgctttggttatcagttatattaggttagtgcaaaggtaatttgcagttttggccatcacttatgatggcaaaaaaacacaattacctttgcaccaacctaacattaaactcaggcgctttaaattttacactgaaatacgttgaaagctagcttagttgatctctgtcattaacagaaaccatctctgtttttgttattttcttggcttgatttaacgttcgttgctcgcaagaaacagaaacccactcaaggtagttgaaggaaagggaggttttcattcaagggagttggagaatcggaaggcaagaatgagcctcaggcctctcatgggactggacccggccagtggaaagctgttgtctcacaccctgccccacctcacaatacatgtctcttttctgcctctttccttgcatgcttgtcattctcactcgctatgtatgccagctttccctgcagctccatgcacgctgcgtctgtggccctttcctgccttttgccttccaggctaaaactagatagcttttgggtcttaattccaaatgcttaggagtgaatcggttagctcagaagtccaaccagttcaaacacctgtgtcaatctagcacattaattctcaaccttggctattatttgatgtcactgggagctttaatagataccaaagcctgtgtcccattaccagaaattctggttttagtggtctgggatgttactaaacctaatttgttgggatatgtttaagttcccagaggattctaacatagagctgtggtccatggttaagaagcactgatctaggagagaagagggtcatcttataggcgtggaatgctcagatagtggggtcttggcctaggtagattattctcccaaagatgtcctctagggtgtccccatttttggctttaacctaccagtcctctttcttatagggtgtgttggaataacctatggagctctactttaaggaaaaaaaaaaaaaaaagctcatgcccagacctagtaaatcagaaccttcagagggtggggaccaagcaggcatagtttttaagctgccctgcaaattccaacagtaccaccaggcctgatctccaggccgtgcactctcacatagcagcaccatccacagtcatggcttcatatataccactttggtggttttttgtttttgtttttgtttttgtttaattctaaggtgtctcaaatcttggtcagatatttaggagccaatactatctgacctctgagtaacaaatgtacctttttatttttaaatagtctagatgtctttttgtttttgtttctgtctttgttttgagatggagtgtcactctgttgctcagggtggggtgcagtagtacaatcttggctcactgcaaattctgcctcccgggttcaagtgattctcctgcctcagccttctgagaagctgggattacaggtgtgcaccaccacgctttgctaatctttgtattttttgtagagacgggctttcgccatgttggccaggctggtcttgaacttctgacctcaggtaagctgcctgcctcaacctcccaaagtgctgggattacaggtgtgagccaccacacccggtctagatgtctttttccaagtactttggtaagagaaactgggaagcaccagctatgtcaagtgtgtgtactacagtgggttaaacattactggtggggagggtgattcattacagggatgttggtcacatcagcctaacagctgacagaaatgataggaaaggcaaggcgtgatggctcacacctctaatcccagcactttgggaggccaatgcaggcagattgcttgagctcaggagttccagaccagcctgggcaacgcagcaaaaccccgtctctacaaaatatggaaaaattagccaggcgtggtggtatgcacctgtaatcccagctactcgggaggctgaggcacaagaatcgcttgaacctgggaagcggaggttgcagtgagctgagattgcgccactgcactccagcctgggcaacagtgagactccgtctcaaaaaaaaagaaaaaaaaagataggaaaaatgtttattatattctttgcctcctagatactggtcctctcatatatatccttgatagggaagcctcctcttcccttgtgagggagggtgtagggaaacaggcatttgcatagttaggtggtaagagtgtaaattgcaaggcaagtcagaaagtagtgctctgctctatagagcactataacttactagtgcagaaaaacattattaggatatatattgaggcattgtttttcatagggaaaatgggaagtagtctaactgtcttttgggattaaatacattgtaatttggctatcttgtggaatgctatacagttgtgacaattagacagatttatttgtattggcaccagcatgaaaaagaaaattgtcatgcagaatatgattggaaaaaattttaaaattttttgaaaagagaaaagatggccaggcacggtggctcatgcctgtaatcccagcactttgggaggccgaggctggtagatcacttgaggtcagaagttcaagaccagcttggccaacatggcgaagccctgtctctactaaaaatacaaaaattagccaggtgcgatggcgggtgcctgtaatcccagctactcaggaggctgaggcaagagaatcacttgaatccaggaagtggaggttgtagtgagccaagatcgtgccactgcattgcagtctgggcgagaaagtgagtctccgtctcaaaaaaaaaaaagaaaagaaaattgatatattgtgtaaaggaagtgagttgcagaatagtataattatatttatgtaaagaaaatttgtatctgtaaatctgtaggcaagatctggaagtagttatatcaaaccaaatggcaattactggtatagagggatggggtggcattgaaagagggacttgtacttttaattctctatacttagtaccttaattatttacagttagtataaattacttctgtaatgcttgaaaatacttaaaaactataaagaaccatgggaaaaaagaaaatgaatggttatctttatgtggtgggattttaattttaattttttgtgtgtgggggggcagtattttttataaagaaaaagttttaattttctaattggggaaaatcatttttaaaaattacgtcaggacttgaatttcatgagccttttctgaaaaatgaggatggcttttttcttgaattcaaattaaaaatttaagtcattacctcttctgaaagcattgataaggtcaaggaaagatcgaatctcagctatttcctgacttctctcttaggttaggtactatttttcagagattgtcaaactttgctgaaatcacatcaccaggggtgatgaattcctaagaatagagagtcctgggcctcacttgacacttactgaatcagaatcttaggctggagttgaaggcctaggaatgtaaacctcttcaggcaagtctgatagctaagttggaaaaccattgctgtaggcagtacaagcagaagtaagacacaggcctatatttaaggcatttactaagtgaaatagcataagacagtaatgtcagtgctttcatgaggcactatgggattagtcaccaaacagatgttagagataagcactgaaagaaagagcactggaccaggaagactgtgaatgccttatgaaggaggcaagatgtcataatattcaaagctcatatattgagtaagacagttctatgtagagctgttacatacaactcaaggtaggtactgtgaatatcctcactttacagattgggaaacaagatgagcagagttaagtaacatgtccaaagtcttacagctagcaggtggttaagtggggagccctagaagcccaattccactgtgccgtattaacattgggcaggatttgggtcagtggaaaggatgtatgaggattttacaggtatagagggaagtgtaaggaaagggatgggaagcagtgactagataaatgaaggtggaatataaggtaagttagggctgggtggtagaaagtcttgttaggctaagaggatcccaagtgtcaaatgctcacaagattggatatttgaagcttgggaggaaatctctgatgacttgaaagacattttctcttccagttgaacttcacagtgttatctgcaaagttagagagggatttggggtttcatgctccctggtgtatccacagcacttaaaacagtgcctgactcctaagagctgtctactaaatacttcttgaatgaatatataaatatctggctcacaatctacatcagagacttattctttcttttttctttgtttttctgagacaaggcctcgctctgttgcccaggctgcagtgtggtggcatgatctcagctcactgcaacctctacctcctaggctcaaaccatcctcccacctcagcttcccaattagctgggactacaggcatgcgctaccacacccggctaatttttgtattttttgtagagatgaagtttcaccatgttgcccagtctagtctcgaattcctgggctcaagccatccaccctccttggcctcccaaagtgctgagactacaggtgtgagccaccacacccagcctcagaggtttattctttattctgcccaatgagcctcagaatttagcctttcatgtttttgttgttgttgttgttgtgtgggtacataataggtgtatctattttggtataggcatgcaaaacataataatcacaacttggaaaattgggtatccattgccccaagcatttatcctttgtgaaaatacagaacactttacaaatttccatgtcatccttgtgcagggaccatgctaacctttgtatagttctgatttgagtgtgtgtgctgctgaagcaagcactctcatctgggtttttttcccgtttctcctccacaaaggctgataccaaaaattccacatttcatctagaatcttccttctttatgtaatattttctggctgggcgtggtggcttatgcctgtaatcccagcactttgggaggccaaggcgggtggatcacctgagatcaggagcttgagagcagcctgaccgacatggtgaaaccccatctctacgaaaaatacaaaaaaaaaattagcagggtacagtggcatctgcctgtaatcccagctacttgggaggctgaggcaggagaatcgcttaaacctgagaggctgaggtagcagtgaaccaagattgcgccattgcactccagcctgggtgacaagagtgaaaatccgtctcaaaaaaaaaaaaaaaattatgcaaaggtgagaatgtcaactttttagttccatgtaaaaactgttcatttggtcacagtccctcttgtggccattcctggttatcccttgccattctcactatcccttaatttttcccctgttcccctctgggctccctgcctccagccacctccttgatccagtctgtcccgcccagcactaccagatgtgtggccctcagaggccttgtaatcataccactgtcttctcagacaccttcatcgggggaaggtgaaggttgcttttggtgccttccagcctaccctcagcacaccttcccagctgcatctccgctgcactcccacgtggctctctcaaacaggcctgcttgctgctatcaaatgggtcatttagtttgccacctttgtatgtgtgacccttctgttctacctacctgggatgcccttccctttcctatttgcctacccagatccttcctattctcctttgaagactctgctcagatgcttacttttttcctcaggtgccccatttgaattattgctgtttcctctcaattgttatcgattattatctgtgtcataaataagaagccaatcatgtattaccttgtgacattacttgcattgctatcttaagtgttttaggacactgggttttgtctccttttacatctttatacgttaactcccctaacaattatatgattgttgaaagtctgtgggtgctccataaaatgaatatttagacttagtcatatggatttttaagagttaaacatggatgacaagatctatgaatatatgtagaaaaatccttaggaatctacaaaaaagctactaaaactaataactaatgtagcaaagttatagaagccaagattaatgtacaaaaatcagttgtatttctatatacagtaccaatgaacaattggaaatggaatttaaaacagtttcatggtcaagcacagtggctcatatgtgtaagcccagcatactgggaggccagagtgggtggatcacttgagcccaggagttcaagaccagcctgggcaacatggcaaaaccctgtctctacaaaaaatacaaaaattagctgggtacggtggcttgtacctgtagtcccagctacttgggaggctgaggtggtaggatcaattgagcctaggaggtcaaggctgtagtgagctgtgattgagccactacactccaccctgggtgacaagcaagatcctatcttaaaaaaaataaaacacaatttcatttataatagcataaaacttgtgtagaaatcaagttaatgggccaggcgcagtagctcatgccaataatcccagaactctgtcaggctgagatgggcagatcacttgaggtcaggagtttgagaccagcctggccaacatggtgaaaccctgtctctactaaaaaatacaaaaaataaaaattaaaattagccaggcgtggtcacgcacgcctataattccagcaacatgggaggctgaggcaggagaattgcttgaacctgggaaacggaggtttcagtaagcggagatcatgcccctacactccagctgaggcgacagagcgagactcagtctcagaaaaagaaataaagaaataaaattaatgaaagaatcataagaagtacactgaaaactttaaaacattgctgaaagaaattaaggcagccgggcgtagtggttcacgcctgtaatatcagcaccctgagagggcgagacaggcagatcacttgaggccaggagttagcgaccagcctagccgacatggcaaaaccccatctctactaaaaatacaaaaattgcctgggcgtggtggtgcgcacctgtagtcccagctaaggcatgagaatcacttgaacatgggaggcagaggttgcagtgagccaagatcgtgccactgcactccagcttgggtgctagagcgagactctgtctgaaaaaaaagaacttaaaaaaggcgtaaattaatggagaaatgtgctatgtttatgcgttggaagacttaatattgtaagatgtcagttctccccagactgctcaatagattcaacacaatcccaatcagaatctcagcaggctttttgtaaaattcgacaagctgattgtaaaatgtacatggaaaagcaaaagtagagaatagcaaaacaattttgaaacagaagaacaaagttggagaactcactgtctgattttagaacttactagaaagctactataatcaagacagtttgcctactagcagacagataggcaaataaataatggaacagaatagagtccagaaatagatgaataaatacatggtcaactgattttcaataaaggggtcaaggtaatgcaaaggagaaagaattctcaaccaatgatgctggaagagtcagacgttcatatgtaaaaaagcaaaccttgttcgggagctgtagctcacgcctgtaatcctagcactttgggaggccgaggcgtgtggatcacctgaggtcaagagttcgagactagactggccaaaatggtgaagacccttctctactaaaaatattaaaaaattagccgggcgtagtggcacatgcctgtagtcccagctacttaggaggcagagaggtaggagaattgcttgaaccaaggaggtggaggttgccgtaagccaagactgtgcccattgcactccagcctgggtgacaagagcaaaactccgtctcaaaaggaaaaacaacaacaaaaagcaaaccttgattcatatcttgtaccatataaaaatttaacttgaaatgactcagagacctaaatatgaagcctaaaactagaaaacttttagaagaaaacagggaaaaatatttgggacctgggattaggcaaagatttctcaactaggacataaaaaattttttgggtgcggtgcttacgcctgtaatcccagcactttgggaggccaagccaggaggatcacttgagcccagaagttcgaggccagcctgggcaacataaggagaccccatctctacaaaaaatttagaaattagctgggtgtggtggcacatgcctgtggtcccagctactcaggaggctgaagctggaggattgcttaagcccaggaggttgagcctgcagtgaaccacgattgcaccactgcactcgaaccagtgcaacagagtgagaccctatctcaacaacccaaaattatactgccacattgcacataatgcaatattattcagcagtaagaaaagaagcaactactgatacacacaagaacatggatgaatctcaagagcagtgtactgatgaaagtagccagacacaaagactcaagaccatctgattctatttatatcgtattatggagagacaaaaccatagatcagtggctacttggggtaggtatgaggggttgactgcggaggagcctgggagagctttctgggttaatggaaatgttttatatcttactgtgggggttatacaactgtacatttgccaaaactcatttaactgtacacttgagtgggttttattatatgcaactatacctaactttggggggaaaatgtctggaagatactggtgtgtctgagactgaggtcagaaagatgagtagaaggaattttattttgtgttgtctggttagtgcttttccccttattgtggatgtttaccaaatatccccactattccatcttccagttggaagttcataagcaaatgtacagttagtgtcccattgagccagattgagtttgacagcaaagattggaagttaatggtgggctaaaattgactctaagaaaaagtgatcagagctaggtgggactttctcatcaatggcgccgactttttttttgccagtcacagtggtttgggctctcaaacggtcatttgacatacctttatgtgtaaacataatgagccagtgttgagtttggggttggtgagggttgtgcactattggatttttaagtgagcattagtttgtttaatgaaattgcaaagggtgtttcatattcctggcccctgagcaccaaatgtcctcagcacttcagtcattgtggcagccaagaaccacccctggtcattttcaaataccttaggggtttcaggggaaggtgtgcctggcctggcagatagtgcacttatgtagttggagtcaagaatgcagacttgagtcagaaaacctgtaatctctgtctcctactggctttgcagtgttgagtgtaaccacccctttgagtctgggtgtccttgtctgccagaggatggttggactagataccctctcatggcaatcgtttttgattctgcagtttagtgtagtacagtgtcaagacttctgtcactggccaggcatagtgactcatgtctgtaatcccagcacttttgggaggctgaggtgggaggatcagttgagcccaggagttcaaggccagcctgggcaacatgtgaggccttgtctctacaaaaaatgaacaaaattagctgtgtctggtggtgcatgcctctaaccccagctacttgagaggctgaggtggaaggatcacttgagaccaggaggtggaggctgcactgagctgtggttgcaccactgcactccagcctgggcaacagagcaagatcctgtctttaaaacaaaaaacaaacaaaaaaaacctctgtcactgaccagggatctaatgtatttgctgtactgctcacaaatgcttatgtggctcaactttggtatgttacaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggtaagcggatgctttattagcagccagacaagtgggctttctcagcctcagctgttagcagtgaaaagtcacagaacagacaggggtcagaggcagcgagtgtcattgcagcacaggagaagcaagcgaagcttaaatggactggcctcgtttggctcagcagattttctagtatatcaagtcaagattccatgaagtctggctgctggctgcagtcagctcagtcaacccgaggtgatgatgacggccttcagtggaggtgggaatacttgggaactcatattctgtttgcagccaaggtatttttgagtaaactaaatgaaataccaggccattgattctgataaagtgtgtgagtggatcttggaggcttccctccaccctcagctgagctcatcagcagcagcgtcctctgtagcatgggcgtggccttagtacacctgtgcagaggttccaggctgggcaaagtgagaagacctctcctctaggaaggtgcagggatgaaaatgtagaaaacaaagctgggcagaggagaaagtatgggaaaaagtagcattcagggagtcctgggtttattactgtttttgataaaaatgttttcccctcatgtcttatgtttgctaagatattttctaaacagggattttttaaaagactttttatgaggataagactggctgattttttttaaaattcttgttccttcaggttggtgaaacagagaccaggctggagtgtttgctaaacaataataagaactctgatttctgtgctcccctgacctcctttgactggaatgaggtggatccttatcttttaggtaagggagttagggagtatgtatttcagctggaagaagccaaaataaattttctcagatgtcacactgggccatacatcctagaacaaggctcagtgggaagtaggctaggcgtggaatgtggttatttattaattcctttgtgtgggtgagctttccgtgtgtatagatcttgtctctccagttagaatctaaggtcctacggtgaggactgaagacttgactgcctcggtggctctgccggtagcccccaccttgttttctgtagtctttatggtatgctgctccctgggctgagcagatgagtaaacacaagagggaagcttgcatgagaaccttggtcccgtcagccctgacttgcactggttgtttgcaggtacctcaagcattgatacgacatgcaccatctgggggctggagacagggcaggtgttagggcgagtgaatctcgtgtctggccacgtgaagacccagctgatcgcccatgacaaagaggtaagatgcttttccatttcgtctttcctcaaatgcttcctgtgccttccgcacaggaagaggtcagcttgttctctcattgttctgcaatttatgtagaaaatcataacataacatcttcttgtctaaattgacaatagtaatgtatcaaaaacgggaaaacaacactattgtaaactaatgcttttttttggctaatgtaaatgacctattctacggtctgtcattgttcttttcatgccagaggttgctttttttaaataacaaagtctcttatagaggagctgggaactgatgtgattaaaaaataactttagagtaatacttatcttgaaacagattagatttggggaggaaagaagggagacaggaagagaaaaaattttctgagagacaaacgtaattattcatttttctctataaatgttttaccaaatcctagtatgttcacttaatctttatactttcattactgttggcagtggaggcaatggaatatattttattttgatggcgatgcttctgtgtttattgggaaaactgagaagagctatttgtgattgcttttttttttttttttttttttttttttgagacaaagttttcctcttgttgcccaggctggagtgcaatggcgcaatctgggctcactgcatcctctgccttctgggttcaagcaattctcctgcctcagcttccggagtagctgagattacaggtgcccgcaaccacgcctggctaatttttgtattttttagcagagacagggtttcaccatgttggccaggattgtctcgaactctcctgacctcaggtgatccacccaccttggcctcccaaagtgctgggattacaggcgtgagccactgcgcccggccaattgcattttaatcaaagcattcttctcagtgattttggaaaatccccataagtcttttcctcctagagccattgcatgctcctggtactctcatctcctgtgggtactatttcctgttcttttctaccttaccctgcacagctaggggtattaatatctatacagataaaaggaatgccttgatcttaggtcagaaacttgaggttgtcaacagcataggaagatgtgacccaggttatcattcttagtaaggggttgtctttggctttctgtactcctgaaggtaagccctgttacaagacttctagagttgactgctgctaaaccaggggtcaaatgaagagtttgtcccacagagaggaccagtaaggaacttctggaaaccctcttggcatcaagttgaacaagcggctacattttagttatatgacaacttagcctgctgttgtctgttaggtccaacccagaaaatgggaactactcttaagtatttgaactgcagggatttaatccaggggctgcttatacagaagatggtaaagctgagaagccacataggtagcagtgaggtcatccatagaatgggagcagcaggaagctgcagctgcctataggccagagggaccatgggaggaggcagggttcctggagcccaggggctggatttacctggcagagacgcttctaggaacagagagaggggaggagaaataccttagcttttccctgcctcccatcatccattttcccaccaaagcctcccatgactgaaccagccagaagcagccagcagatctgagaccctgccaaatgcacgctgtaggaatcagttctcttgtgacacagagaagaagagcagggagaaaggccaggaatggatcttgacagcagacaggcctggaccggcagccttgtcttgaaggaataaacctgagaaaggatagtggctctagagaaacagtaatagcacctttctagcacctttgatttttctcagtccacctttctctaggaaaagacttgtttggaaggctctcattgatacctggcagatcagtgtagaagagggtttagtgtacttgggagttgtcaccttcccttggtttcccagtgaaccatgctagcggagcactgaaggagcagtcacttagagccgagagagcattacacactcagccacgctgcccatggcacctgtgggatctctgtccctgagggttaccaggagctgtcattggggggtatacatattgataaacatggctgtgccttaaagcagctgtacagtactagagaaagcctcgatctgtcaggcacgtcaggcctgagtgcctccttgttgatgactggcccggtcccttttgaaccacttctacttcctgccatagaaagacaagcataatttcttcatagccagaaaaaaaaggaattcgtgaggttaaatagcaatagatgctcatttggcagtgtccctctgtaggcagaacttcaacactggagctgtaatatttagtgagaaattctagtcgtgtctccccagaagtcagctgttattatccccagaagatgagttttgtttggcattagtttttctgtttctctctctatttgtctgtctctggctctctcttcgtccctcttcgtcctctttttttttttttctttaagacagagtttcgctctgtcccaggctggagtgcaatggcctgatctcagctcactgtaatctccgcctcccgggttcaagcgattctcctgccttagcctcccatgtagctgggattaccggcaccagacaccacactcagctaatttttttgtatttttagtagagatggggtttcactgggttggcccggatggtcttgatctcttgaccttgtgatccgcccgcctcagcctcccaaagtgctgggattacaggtgtaatccgcacccggccttcgtcctttctctgaagctctccgttgctctctgcctctgtttcctcatagacgttagtgatatgcaatgtttgcagcaaataaaagcagaaaacagtgattcagaacctaaattgattcacttatgatctcaaaccaactaggagaagaaaaaacatgtcctaggacaagcgggtgctactaacctatttgtgaatacaggaacatctaggcctcccgtgactcaaaatttctgttacctctttcttgcaaatgagtctcaggtccaggtttcacagaatcagcttggctgctattaagtggccacaggagggctgctttcacctctgtgattgatgatctaggccttaatgagctcgtagacctgcctctgattgtgcacaaggcccaggaaataagtgtctcattcttgttgtgtggcagaagacagccactgttctgttggtcagcagggcatgtgcctttgttttatcacgggttggaggaagaagacttggaaagcaggaatgtgggaagaagccagccaatttctatagcagaatgatcttccatctttgggaagccactgatattagagctctcgggtttcagtactcacagacactgtttgggcttcatttatctgcttttgtgtcatgagcgaggtttagatgaactggacgtggcagatttccctcctataggaagaagaggtaatggatctgaatctgactggagcttcttgttcaccaacaggtctatgatattgcatttagccgggccggggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtgagcactcctctcaggctaccatgggccctgcctaactccagcactgcttagtatatctagaaggctggttctcaactggagcagtttggctcccggagtatctttgggaatgtctggaggcatttttgattgtcacagctctagagacgcagttggtactatggcatctagggggtagagaccagggaggctgctaaatatcctacagtgcccaggacagtcccccagcaaagtatatcctacctaaaatgacagcagtcccgggactgagaaagcctaatctggaataagaattacttgttaagaacttttaatttttgaagagttggagttagagccaggaaaagcaatatctaaagagtaaaccaaatcgtatgtgcctatggtgctgagtgaaaaagcagattttcccttctgtagtctggacagattcatctagctttagcaaacagatgtagaaatggcagccctctggccgggcgctctgggtcacgcctgtaatcccaacactttgggaggctgaggcaggtggatcacgaggtcaagagatggagaccatcctggccaacatggcgaaacctcgtctctactaaaaatacaaaaattagctgggtgtggtggcatacgcctgtagttccagctattcgggaggctgaggcaagagaattgtttgaacctggtaggcagaggttgcagtgagccaagatcgtgccattgcactcaagcctgggagatagagcaagactccatctgaaaaaaaaaaaaggccaggcacggtggctcacacctgtaatcccagcactttgggaggccaaggtgggcggatcacaggtcaggagatcaagaccatcctagctaacacggtgaaaccccgtctctgctaaaaaaatacaaaaaattagccgggcgtggtgtcaggcacctgtagtcccagctactcgggaggctgaggcaggagaatagcttgaacctgggaagcggagcttgcagtgagcggagatcatgccactgcactccagcctggtgacagggcatgctctgtctcaaaaaaaaagaaaaacaaatggcagctctctctagtctgttacttgattaaagaggtgaattgtgggtggggagaatgcattggttgtccttggtttggtggcgctagcacctcagattctgctttggctgggctctcattccattcatctgagatgcatagaattcttaccacatgcacctgctgggacccaggattacccagactcctgttgtctgtttctgcatctcccctatcagtctaaaggcccagtgttgctcaagatagagactatcaactacccgtgtcctttgtcttcttttccctcaatcctatggaaatcctgtctctagttctttaaatccacaaatgaaaaattatgcctaaaaagatttttgcatgtggatagtattttttgtttttttctatgaaactctgatgatcccaggccttttacttgttatttccgcaggtggtgattctagatgtccgggttccctgcacacctgtcgccaggttaaacaaccatcgagcatgtgtcaatggcattgcttgggccccacattcatcctgccacatctgcactgcaggtaatcatggtggggagaaagaaatctgggaaggatggaggaaatctgttctcttggctccttagaattgtagttgttactgttttctaagcacagtcttgagagatttatacaaaatgactagttggagcctctccacacttgtgaaattcaatcagtacaaatttttagacgatcttgtaccctcatggacatcagaacatcttccatatatgatttacatcatgtgtcagttatagggctgtgccttgtactgtgcccctgaaatctggatggcacagaggactcaattccaggaatatggggaaagggaggcatccctcatggatataacagaatctttgggactgtgaagatcaacatctccatgggacctttcaggtttcactataacaaacccacagtgtgctctggatgcatcggagggccccacagaactttgcctggttgtggtttgtgacttgtggttttcatttcactgtttcccagaccaaagctagcaccccttacgggctgggtgcagtggttcacgcctgtaatcccagcactttgggaggctgaggcgggtggatcacctgaggtcaggagttcgtgaccagcctgacaaacatggtgaaaccctgtctctactaaaaatacaaaaaaaattagccaggcatggtggcacgcacctgtagtccaagctacttaggaggctgaggcaggagaagcacttcaacccaggaggtggaggttgcattgaccagagattatgccactgccctccagccagggcaacagagcaagactctgtctccaaaaaaaaaaaaaaaaaaaaaaaagtaccccttaaaaatatgttgggccaggcacagtgtttcaggcctgtaattgcagcactttgggaggctaaagtgggaggattgcttgaggccaagagttcaagaccagcctgggcagtatagtgagacctcatctctacagaaagttaaaaaaagactatctgggtgtggtggtgaattcctgtagtcccagctacttagaggctgaggtgagaggatcccttgagcccaggagtttgaggttacagtgagctgtgattgtgccactgtactccagcctgggcaaccaagcaagaccctgcctctaaaataaattttaaaaaaagaaaagaaaggctgggtgcagtggctcacatctgtaataccagcactttgggaggccgaggcaggtggatcacgaggtcaggagatcaagaccatcctggccaacatggtgaaaccctgtctctactaaatacaaaaattagctgggcgtggtggcacatgcctgtagtcccagctactcgggaggctgaggcaggagaatcgcttgaacctgggaggtggaggttgcagtgagctgagatcgtgccactaccctccagcctggtgacagagtgagaccccgtctcaaaaaaaaaaaaagaaaaatatgctggttgtcaatgcacttttattgtagaaataatgccaatctgttatttaaattgaaaacagtacagaagcatatttaagagcaaggcgaaagtcatcttttctccttcctatatcatttctgcctccatccccctctgcatagatgacctctatcaacaggtaatgtgtctccttccagacccttttggtatactttcagggatgtacatctatgcccccaaatacaactatatacttcttccttttgcactgataggattctgtcctagtcctgtgatgttttgctccttaacttttttagtgtgttttttttcttctcctcactaatcaggagccttataatggacaaggtttgttatggagcccaagaagcaatgtactctggtgtttttctgccatttgagcattatttggaaggcatgaagcttttcctgattttggccctctgctcatgcctgtatgtctccttgaagagcagctgggggcctgctgctgccttctgtacctcagattgtggtctgtcttcttcattattgccctctttttttttttttcccaggggtgtggatagggagggatagaagaagcagaagagaaaggtgtcatccattattcatggaaagcaggactggccccgtagaagccccattttctgctcctggctgctgcctttgtctggctcgctgttgttttgtgtgttgcacctgccttgagccccttcaaccgaaggagctgttgctcaagtgtgctcggttgagcattgaggaaaagggccttagtgctctagaggtgcaattccctgacctcttggcattgattgtccctgggagagggatcttgcacctggcccagactatgcggccttggcaggagactagtattgcccacaattagtctattagggtttagtttattcagattttctttgtatctgagaccagctttcatcagaatgcatggcagagtcagggtacactgcagctctgaaggccattgccttatttttttcttttttaaaaattaacttactattttgattataaaagtaatataggccaggtgcggtggttcatgcctgtaatcccagcattttgggaggccgaggcaggagaatcgcttgaacctgggaggctttggttgcagtgagccgagattgcaccattgcactcaagcctgggcaacagaatgagactccatttaaaaaaaaaaaaaaaaaaaagtaatatgagcacattacgaatcacttaggaactagagaaaagtaaacataaatcctaaccttgccatcttagtattgccatcattctcattttaatatatttccttctacttatttttcatgtgcttttatatatttaaagtgattaccatctttctggtgtttcccatagctattttcttggattttttttttttttttgagatgaagtctcactctgtcacccatgctggagtgcggtggtatgatctcggctcactgcaacctctgcctcccgagttaaagcgattctcctgcctcagccaccgaagtagctgggattacaggtgtgtgccaccacacctggctaatttgtattttttttttttttttagtagagatggggtttcaccatgttgtccaggctggtcttgaactcctgacctcaggtgatccgcctgcctcagccttccaaagtgttgggattacaggtgtgagccaccatgcctggccaggaaagaattttttaacagcacatatcagcactactttatcagtcttctatataacacctcactgaagcataaatgtccatcaaacagggaagaaacgctctcattatattgaatgatcagagaatgatctttgtaaccactcaagtattttaagtggctgcaaatgacatgtttggtatccccttgtccactcctgatacctgacccagatgagaaggactcattagtgcagtggatagagcctggggacatctgggagatggagtcagggcctagatttgagttctggctctgccactcacttggctgaatagctgtgtgatttggaacaagtgccttaacatttctgaatctcgatttcctcatcgataaaatgggggcttaaaatagaaccgccatcacgggggtgctttgtaaactgtgacttgctcctgaaatgcagggatcatcatccgcattgcctcacttgtgaccttgcttgctggctttctttgtccctagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgtatagattgactgaatttctttttgtgacgaattcagttcttcccattttgtcactttggtcatgttccatagacagtggcagtgccccagcccgagccgggcagtctactcatcaccttttatatcctatttagtcattcacttgttaattcagtggagcacctcctctatgccaggggacatggccctcaagttggttgcagtctaccagaggagacatctacataaatacttgtggccgggcacagtggtctgtgatcccagctgaggcatgggggtggctgaggtgggaggatcacttgaggccaggagttcaagaccagccttggcaacatagcaagaccctgtctcaatcaatcagtcatttttattaaaaaaaaaaaaatttcttttagccagactaagatctaagacaaatctttttttttgcatttcttttttctttttttgagacggggtctcgctctgtcacccaggctggagtgcaatggcgcgatctcggctcactgcaacctccacctcccggttcaagctattctcctgcctcagcctcctgagtagctgagattacaggcatgtgccacaacacccgactgatttttgtattgttagtaaagacggggtttcaccgtgttggtcaggttggtctcgaactcctgaccttgtgatacgcctgcctcagcttcccaaagtgttgggattacaggtgtgagccaccgcacctggcatttattttattttaatagttttgggggaacaagtggtttttggttatgtggataataagtttttttaatgatgatttctgagattttggtgcacccatcaccggagcagtgtacactgtacccaattggtagtcttttatccctaccccctcccacccaaatttttaaaagacaaaaaacaaaaaaaccaaataacttgcattgttgtgcgataatggatgtgtttaggcatcacccctcaggaggaggtgatcacctctgcctgtgtgggagccacatggggtcagcgaaaactacttaagatggatgcctaagctgggttttgaaggctgagtaggagttatctggaaatagggaatgtcctttaaggcagagagaacacccatgtgcaaatctatggaggcaagaaagtatggtcatatttagagaattgcaggttgaggtggggtgaatagtgggaaatgtagctagagatgtatacaggagccagggcagggaaagtctcccgctttgcagaaattttagacattacacttctgtatgatcctggaaaacacacagagaggagtcatcagaattgcattttagaaggataggcaatgaaaaagtgcctcttccttcttatagggtgagagaaaaaccctgaactaaggcggcggcggcagcagcagccacggcaaggatggagaggacagggcacaagtaaagagggatgcagtcatcagcatttagtaatttattgattgtgaaggaggacagagaaataactcccagatcttttggatttggacaggttctgatggctgactaggaatgtccaagtccctgctaatttcccaaacctatgccccacacggtagggtgggggagttcctatcccactgctcttcaaatgctgtgtgtcctggatgaaatactacccccatttatttatatttttattcttcatgttgggccactgtgaaggaagagaagaaaggcaaactgattggttccgtgaacctgtattcggtaagtacctgccattgtgtcagctgatatggagccggtggcagtggatctgtgaagggaagtatgtgctcttgagaatttaattttttttttttttcagacagaatttcgctcttgttgcccaggctggagtgcaatggcgcgatctcggctcatcgcaacctccgtctcccgggttcaagcgattctcttgtctcagcctcctgagtagctgggactacaggcatgtgccaccacgcctggctaattttatatttttagtagagatggggtttcatcatgttggtcaggctggtctcaaactcccgacctcagatgatccacccacctcggcctcccaaagtgctgggattacaggcgtgagccaccgtgcctggcagagaatttaagttttatgagtacctgctggtcctttggaactgtgctgctatatggtctgacaatgtatattttgtgagaaacacatgagtcctgctctctggtttttaaggagaaaacagagagtaatactatttataggctagcctatgctgcggcaacaaacccccaaatctcagaaactgagcactacaaaagcttattttttgcttacacaaagtcctctgggccgggtgcagtggctcaactctctaatcccagcactttggaaggctgaggggggagggaggggcagatagcttgaggtcaggagttcgagaccagcctggccaacatggtgaaaccctatctctactaaaaatacaaaaattagctaggcatggtggcacacgcctgttgtcccagctacttgggaagctgaggcaggagaatagcttgaacccgggaggtggaggttgcagtgagccaagatcgcaccactgcacttcagcctgggcaacagagcaagactccatctcaaaaaataaaaataaacgtgtgacctccaggttgcttatggggggtgggagggagtacatttttcaggatgggccgggaagtggcttactcacttttgctcctatctgccaactgcaaggaaggtcaagtcaagaaatgtagtcttcctgtgtaccctggaaaaggaagtgaagtagtgaataattatgtctcagccatactagcaaatcggctaagtatctggactaataactaatgtaatctcattcattgagagctgttagtactggacaacacatggtcaaacctaatggaatgatatttgtagccagtctttagcttccaaggctcattgttacttaagtgatttcagtgagcctgacagccaggcgtctagagatggttcagtcaactatgaatttatcttgaaaggtggctattaactcagactgagagttaaaatctgccctgccattcatcacagatgcacagacagataaaaccagctgcacagttaacaggatatagtacctctatcaagaacacactgcaatttttttttctttttttggcaacataaagtgtcaaaactccctgagtgactactgttttaaaaaaattcactgagaaatttcgttctccaaaatcataggctgacaaagtttgctgtttgcaattgtatttgtgagaattaaggcttatagtcagtcttgcttggaggagctgagtcactctgacagagaagcagccttgatttccaggccaggtattgtgcttcagagcaggggcttctgaacacaacagtccacatttaccttgactttgtactttccagggaaactgatcccctgggtccacttggtagtccagctgatcttaatccgcctttcacacaggtctgtgtttctttgagcctaactctaatttttcacctaacttccacccttccccataattctatgaccagttttttcttcggtaagacacttcaccattcctctggtgtgcagtctcccttgttgcagtgagttgataagcctaactctgtgagactataggtttcccttgctggtctcaggctgactggactagggcagtctcaaaccttgttttagcctctacacttatttgtgattacaaattccattaatttgatttttgcttctcaaagtaaatattacatatatatttttttctttttttttgagatggagtctcgctctgtcaccaaggctcaagtgcagtggcgcgatctcggctcactgcaacctccgcctcctgggttcaagcgattctcctgcctcagcctcctgagtagctgggactacaggcgcgtgccaccacacctagctaattttttgtattattagtagagacggggtttcaccgtgttagccaagatggtctcgatctcctgacctcattatctgccccaaatcggccttccaaagtgctgggattacaggtgtgagccaccatgcctggcctgaataaactatttttaaattgcaaaaagtaatactatatatgaatggctgataagcacatgaaaagatgcttaccattagtagtcattcaggaaatacaatcaaaaccacaatgagataatacttctcacccacaaggatggtgataactatagtcaaaaagaataacaaatttagccagtggctcacacctgtaatctcatctacttgggagactgagatgggaagatcacttgagcccaggagttctatgctgcagtcagctatgattgctccactggactctagcctgggtaacaaagcaaaaaaaaaaaaaaaaaattcatgatatggagaaattaaaccctcatatattgctggtgggaatgtaaaatgatacaaccactttagaagacagtctggcaatcccacaaaaggttaaacatagttatgatatgacccagcaattccactcctaggtatataactaaaagaagtgaaaacataggtccacacagcaatgtgtacatgaatgttcacagcctcattattcatcatagaaggtggaaacaaccacatgtccattgcctgatgaacagataaataaaacgtggtatattcatacaatggaatattatttggcaatagaaatgaaatactgatacatgctacaacatgcaagaatcctgaaaacatcatgctaagtgaaagaagccagttaccaaaggccacatagtgtgtgggcccattcatattaaatgtccagaagaggcaaacccacagagacagaagtaaattggtgattgcctaggcctgtgggaattggggggaaatagggaatgattgctaatgggtacaggacttcttttggggatgatgaaaatgtaaaatcaattgtgcacagctctgaatattctataacacattgtacactttgaattggtgatctgtgtgatctgtgaaatatgtcaaaacttaattttttaaaaaatgagaactgtgttgggcataggaagtacagtcctactctcagagaatttagtattacggtagaaacagatataaacattttgatatttttttaaaaggtaagtgctaaggtgcaagcatgtatgaagggctatgggcacccaccgcacctggctaatttttgtatttttagtagagacggggtttcaccatgttgaccaggctggtcttgaactcctgacctcaagtgatctgccagcctcggcctcccaaagtgctaggattacaggcgtgagccaccgcacccagccccatggaggttcttatataataaaaaataaaaaatctatgcttttgtgctttgcatccattatcccatttagtcctcacaaggccattctatggtaaggaaactgaaacaggaaagtaaaggaacttgcccaaggatacactagaaaatggaacaaccagggtttgaagccacccagtctaactgcagagggcacaaacttggacttcacactgtcctgcttctctctctctctctctctcttttttttttttttttttgagttggattctcgctctgtcgcacaggctggagtgcagtggcgcgatctcggctcactgcaacctcctcttcccgggttcaagcgattctcctgcctcatccttctgagtagctggcattacaggcgcgcgccaccacggccggctaatttttttgtatttttagtagagacggggtttcaccatgttggtcagactggtctggcactcctgacctagcgatccgtctgcctcagcctcccaaagtgctgggattacaggcgtgagccaccgcgcccggctgtcctgcttctctacctgatatgtcatgccctttggacttaatctcaccagcatgggagtcactacaaagcttttcagcagctgccgctttgtttctctccatcttctaacggattcggttttctctttcgagacagcagagagaaaatgaagaggggagtttagctccaaagggcttgtctgatcattctccctctcccaaaggcctgtgactcatctgagtctgtcccaaaccatctcttgcatctaggggcttaagtgcactgtggctatttacataaaactttattactttaaagctctaagggctcattttgtgtttctaactttcctatgttgataaagcaaatattagatccttatttataaatagggaagacgttcagagagattaaacatttgggcaattcacttctctggcagcagtttctttcccagtacaatgaggcaacaacaaaatatcattctggacttgctcagatttaggcagcaatttggaagcaaagtcagtttcataactcagatgtgtctccactaaaacattatgagaaacaaagtccggcgctctctaggcaaccgtgagggcttgagcactaactagatctgctcaagggcaagagaggagcgagtaccgtgcagccacggaacggactttgcgggcagtggggacgtgtttttggagcgaacccggtaaaggaagtgtgctacgccatcaagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaaggtgagaccctgacggtcacccagcactggctgccgctgccctctcagtgcccgcagcctcgcttgcctctcggaattgggcccacctagatctccggcccttcactttgttttccttccccagtacccaccattgcccacctcataaatcctcaaaacacctaccctacgttggaggttctcactcacttttccagacgctgagcatctggccagtttgtcagagagggagctgctcttaagaagataagccggtaaggtagaagtgacttcatcctaatctagctgggtacttaatagaaacaagccctaagagtcagggcagatgtgtgtctctcctgaagagacaaatcaacccctctgaagtcgcctcaagtaccttattggttgtggcaggggcactgagtaaagctattacttaagtgcttaggccttagcttaggccttagtttgcttcattaatgtttccccaagacacatttccttggaaggtagatttgcagccatgtcttttctcccttaggtcgccacactgaaaaggctttttttctgtttagggccagacatctgtaggagcaaaggaaaagtcctgtagaaagcatggactttggactgggcgcagtggcacagcctgtaatcccaggccagaggcaggcagatcacttgaggtcaggagttcaggactagcctggccaacatggggaaaccctgtgtctactaaaaataacaaaaaaaaaaaaaaaaaaaaaacagctgggcatggtggtgcatgcctgtaatgctggctactcgggaggctgaagcaggagaattgcttgaacccaggagttgaaggctgcagtaagcgagattgctctactgtactccatccagcctgggtgacagagcaagactccatctcaaaaaaaaaaaaaaaaaaagagagagaaactgtggactttggagtcaggaagactggtttctgtcactgactaaccttgaacaagtagcttaacttgagtttctctgaaacaaggataatacccaccttgaggtagtttatggtttatggcacatcataggcattcagttaatgttaatttaccccctcagctcatgcctggtatttgtttgcttccttttcttcaaaattcttgatattaagttcaagcaacttttatttatttatttatttatttattttgagacagagtctcactctgtcacccagggtagagtgcagtggcgtgatcttggcccattgcaacctccacctcccaggctcaagtgattctcctgctttagcctccggagtagctgggactacaagtgtgcaccaccatgcctggctaaatttttttgtatttttaatagagacagggtttcaccatgttggccaggctggtctcgaactcctgacctcaaatgatctacccacctccacctcccaaagtgctgggattgcaggtatcagccactgcatcccaatgaagttcaaccaacttgtgtttattttgtgccaggcatgccattggtactagaaagatgatgagatacagcccctaccctcagatcacaatgtcatgtgaacatttcaataattatgcacaaagtgctgggcacggtggctcacacctgtaatctcaacactttgggaggctgaggccggcggatcacgaggtcagatcgagaccatcctggctaacacggtgaaaccccgtctctactaaaaatacaaaaaaattagccaggcgtggtggtggcgggcgcctatagtcccagctactcaggaggctgaggcaggagaatggcgtgaacccagaaggcggcgcttgcagtgagccgagattacaccactgcactccagcctgggcaacagaggaaaactctgtctcaaaaaataataataaaaataaaataaaataaaaataattattatgcacaaagtagtagagtaagagcagtaatgagtccaggaagtgttgttaccatctataacccttcttcatctgacacaaagtagagatcgctgaaacctagcagaatgaaaaccatccctaaagacaatgaattagaaagttctggccaggcacggtgcctcatgcctgtaaccccagcactttggaaggccaaggtgagtggatcacttgaggtcaggagttcgagaccaacctggccaacgtggtgaaacctcatctctactaaaaatacaaaaattagctgggcatggtggcagacacctgtaatcccagctacttaggaggctgaggcaggagaatcccttgaacccgggagtgggaggttgcattgagccaagatgagccaagatcatgccactgcactccagcatggatgacagagtgagactctgtctcaaaaaaaaggtcttttctggccagacatggtggcccacacctgtaatcccggcactttgggaggccgagtcaggcagatcacttgagctcaggagtttgagaccagcctgggcgacatggtgaaaacctgaatctacaaaaaatacgaaaaaaattacctgggtgtggtggtgcacaccagtggtcccagctacttgggaggctgaggcaggaggatcgcttgaaccctggaggttgaggctacagtgagctaaaatcatgccactgcactccagcctgggtgacaaagtgagactttgtctcaaaaaaaaaaaaagtacttttccaaaatacttatccaggccaggggcagtggctcacacttgtaatcccagcactttcggaggccaaggtgtgtggatcacctgaggtcaggagttcgagaccagcctggccaacatggcgaaacctggtctctactaaaaatacaaaaattagccgggtgtggtggtgtgcacctgtaatcccagctactcaggaggctgaggcaggagaatcacttgaacccaggaggtggatgttgcagtgagccaagatcgtgccactgcactccagccagcaacagagtgagactccatctcaaaaaacaaaccaaaaaaacccgaaaatacttctccgtatcccactgaaacactagttaaggtattctaaggtaactgagagctaaatggtgatttgccactcctttggcttggtggggctggaaatcccttttattctcccatgttgtaatgagatgtctttgctcactcttttttttctttttctttaaatctcagaaggaggccccaaccctgagcacaacagcaacctggccaatatcttagaggtgtgtcgcagcaaacatatgcccaagtcaacgattgagacagcactgaaaatggaggtgtgtactgtttgacatgctttttattgatcacagcctctaccgggctcatgtctggatggccaacaaacacactgtaaattatcagaggggccaagtgcagtggctcacgactataatcccagcactttgggaggctaaggtgggtggatcacttgaggccaggagtttggagaccagcctggccagcatggtgaaactccatctctactaaaaatacaaaaattagctgggcgtggtggcatatgcttgtaatcccagctactggggaggctgaggtggaggatcgcttgaacccaggaggtagagattgcggtgagccgagattgcaccactgcactccagcctgggcgacagagcgagactctgtctcaaaaaaaaaaaaaaaaattatcagagagaacggtagcaatgtagttgacgccctcagcctagagtcttctgagagctcaccgtccttggtcattggttctaggagcacaactgggagtaggatgcataggcagtatgcagggccatacagtcaagaccgggactgctcagccaagttgtagggagatgaggtattatagaaagaaggggcagtgtgggagaaagcccttacgttaggtggaggaagtgtttgtttttcagatgtttatgccctaaaggagaaaagccagtagaaagggagaggatgggggtgatagagatggtgggaggggcaggtatatagagtccacgtaagggtacacctttctctggggcaggtagggaggctctgaggaagtaatagttatcttaatagctcaaaattattgagtgcttcctgcaggctaagcatggataaaaactctatgtgtgttatctcatcgaatcctcaaaaccaccgtaagtagaaactgaggcacaggaatgttaggtgagttgactcaagtcgcatagaaaatgacagacttgaaaccagatagtcagactttagagcctgtgctctaaccgttatgcttattgccttcatgtaggccatggtgcagagaaggtggtggagacagcaactattttccccacctagtggccctttttacctttgtgaaagaggaagggagaagttatgagttgagaattcctggaaagttgcaggacagggtgcttggagtggggaatattgaatacatggacaagggatgagtaggggcatggaaggtccagaagagattagtccctagagctctggattaattgtttcaattttgagaccatgctgttttcagcagctcttacgacaaggcctaggtgtgtgatatttcacagcagtactcagcagcccagggtagggaccttgagacttgaccggtgggtttcttacaggatgggggtgtaggaggatgagtctgagtgggattgggtagggactagatgtggcatttggttagggatggtaggaagcaaagctgagagatggctgatggattgttcagggaccggagaaacagactccttccaagttaggggtagtacttcctgttacctcaaaagttggttagagggtggggacaaaaataaagattgagagctcaggctccagcctagagagcccatcccatggagttagttttgcgatacttgtagttctgggctgacatgtgggaaggaattgggaaacaggaaaatgtgcttgtgttgtttattgcagaaatccaaggacacttatttgctgtatgagggtcgaggccctggtggctcttctctgctcatcgaggcattatctaacagtagccacaagtgccaagcagacattagacatatcctgaataagaatgggtaagtgtgcgtctgggaggagtggtaggggacagagcctttatgttccaattctctgcaaggcaagtactgttgatctctgctagtgtttcagggttttgttttttgtttttttgttttttgagacggagtctcactcttgtcgcccaggctggagtgcaatggcatgatcttggctcactgcaacctctgctttctgggttcaagtgattctcctgcctcagcctcctgagtagctgggattaaagatacccacagccatgcccagctaatttttgtatttttagtagaggtgacagggtttcatcatgttggccagactggtctcgaactcctgatctcaggtgatccacctgcctcagcctcccaaagtgctgggagccaccatgcctggccatgtttcaggttttaagcacacttgctccttagcagaatctaatgagttaattgactttcccttaatgtagtttctactagcaggatcccaaagacttgttcatcggatgtagaaggggatctttgtcctattatccccatctgtagccatataatgcctaagtcttaaaatgctccaccaggactggcatcttaatggcacaggaaattatcagctaagtctgcttcctcccaactgcaatcagggcagaaaatcgagcgtggggacattcttgggctgttcccttacccagcagcagctgcattttctccttgaggatgcgatctgctccatgtctgtgtgtacttcatagactgggtaagaaagagacagtgatagaatgatgagctttatggaggctgagcttctagaggcatccactcatgccagcctgtttccttccctgtcagaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaagtaagcatgaaaacatgggtgtttggtgggcttccgggaggaccctgatagatgccttatgcatgcctcttggtttcttccttcatgtgccccagggtataggtgagacagttcacatattgtacaaacatttattaagtgaatactgaataggaccgactctagtgaggactatgagaaagaaagagtcaaaacattgaaaacgatgtccctgccagtgaagagctcaaacccagtgatccattccagtactgacattcaggactttgcaaggtcctgtgtggctttgtctcattacctcctggctcctcacctcctgactttcctttatccctagtttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcattgctgttgtatggctcttgagtcttcctgagtttgtgtccagctgttgggatcctctggactaactttcaagtccctaggcttagctctactactccaatcccaggattatttttttaattggccatagaaatgtagttgtatccaggcactccatggtctgatgctggtcttacagcctaaacctgtcattcattcatgcaactaatatttctggaacactagctatataccaagaactgtacttatctagagcataagctattcaactggtgtcctgtgttagatcctgctctagaaggtaggacctgaacacaggactgctctttactggagctgtcccagggcagtgtgagctgctgtgcaagcatctgttgctctctttgtgtgacttctgtgcccttctttcaccaaacagcttaaggttctagcccagtaggaaatcaagtgccagtgataagggacttggcagtggctcacacctataatcccatctactcgagaggctgaggcgggaggatcacttgagcccaggagtctaaggctacagtgagctatgattgcaccattgcattccagcttgggtgacagagtgagaactcttcttttttttttttttttttttttttttgaggcagagtctcactctgttgcccaggctggagagcagtggcacaatctcagctcattgcagccttgacctcctggactcaagcagtccttccacctcagcctcccaagtagctagaactacaggtgcatgccaccacgcccagctaatttatatatatttttgtagagatggggtttcactatgttgtccaggttggtgtcgagctcctgagctcaagtggtctgcacactcggcctcccaaagtgctgggattacaggcatgagccaccacgcccggctgagtctgtctcttttttttttgagacagagtcttgctctgtggcccaggctggagtgcagtagcatgatcttggctcactgcaacctccacctcccaggttcaagtgattctcctccttcagcctcccaagtagctgggattacaagcaggcaccaccatgcccggctaatttttttgtggagggggaggggagaaaattaaactttatttatttttaaaagcaaaccaccgggaaaatataacacagcctggaagcagcaaatggacaggctatattatcatttcaagtagtaagttgatgaaaatacaatgaggttgctatcaaaacaataacgtgccatgccggggcaggaacactgcaagttgcgaaagccccaggcaaaaatggtttttggtactggggtctgcctctcctttgctataagggagtcagctcatcctagcccaagttgcttactttttcttccttggatttcctgttgccagggtttgtctcaattgtgctttgttaattcagggggctaagtaggcagtgctaggtttaggctttcattccatccgttctataaaaaccaggtttttccaaatccagtacttcataactctgttataatcaagtagccaactgctcttcttttactgttcatttctagatactagtatatatcacaatcaaaacccccttctcttcaccgggaaagtgttactgcaagattgtcctgtcattttgctacacacagcctcggcccatcagccagtaattatgcttcccataattagtatgtcatcacctctcatgtttttgcatggtctccaggctgaaagatgcagcatgtaataattttaagaaatctacatctacatcttgatgaccagaaatggggatcctcaaggaaactttcaaagttcttatccaaactagtctccctcccaattccacatcttaaaatcaatttgtatcgccttgtataaattacacaaaaccaagaaaacaaagacccagaaaacttttttgcccttctaagcgggtgacctcatggattttgtttcacagcttacggaaaatggtgtggtgacacttctggtaaacaggatgttggcaacaaagagaaaatatctctcctcaaactccaccaactctaacctgccagcctgttggtacctgtgtaataagaagagtttagtgccttggagggctctggcttgttacaggggagatccttactggcaggacaagcactggccataggatatataagctctaaaactctcctgtaatatctctgacccaatttagcaccacttttttccatttcattttttaggactgaaacataaaagaaccagtgtccagaggcaagtgacatatgtcttacacttgtggccatccttcatttcttcataaactttgcttaaaagactaaaattcccaattccttataaaaaatatattcttgccctcagccccagtggccactggcaaagactgttatttcccaatggataagagagcctccttcatcttcttggccatagttgggatgaggtgcgtgtggtcatccacacacttggtcacacaaccgtccagctgctgcttcacctgaagctccttactcccagtatccattgaatctttggctttgttgttgcaatgcatggcgcaccgggccaggtggtgccggaacttctccaactcactggtgagcaaagcccgggcttgagccagaggcacatggcagtgctttgatgtactggtgcacctactgcatggaggcctggctgtcctcacaacagctggtgctgcaccggaacatgagaccctgcatcttccagatgttctctctctccagactcttcaccatggagtccaccacctcctgcacccacagctgctgcagctctgccatggcgtccccataccgccctgcaccgtgccaccccggctaatttttgtatctttagtagagaccaggtttggccatgttggccaggctggtctcgaactcctgaccttaggtgatccgtccatcttggcctcccaaagtgctgggattacaggcatgagccatggcgcccagcctctgtctttcaaaaaaaaaaaaagggacttactagggcctgctttgcctgggtccctatgcatcctgggattggtcagagtgaaccaatgagaagactgagctgctctcaagaagggctaccacaagctggttttgaaagcttcttggttctgagaacaaccagccctagatccttttcatctctgatgccaaatgatgtggcactgagaactgaagaggaaacgtgaacagaaagaagagtgagggctgaataagaagcctcgccagtgggaaatagggcccttggtaccttttgctcctaatagtcacatctgtgtttagaagggccaggaactcccacctcctgcgtcagagcctgtcaagcatgtcaggcctagagtggctttctgatccctgttatacacctatttataagttatctaagctaattctgagctcagagtaattttcctgaaggagcttcaggtaaataaggatgacaaagaactaaaaccaaatttactgtaaatgataacttcagcttctaagaaaagaattactgactccacactgatgtcaatagctggagagcaagggctacgaggaagaaaaccagtgaaataatccatggtcatgccacttgcccaaatatctgaattgcttatcattaaaaaagagcaaatttacgtttatatgtggcttcataatttgtaagatacgtttacatgttatttatttgattttcccaacaaacctataaaacactttggccaagtattttatgcacaaatgatctcataccaagcaggaaagaacaggtcttacactgatagaccttggtgtttataaaatagctctgttttggaaattaatttggaggaatcttatttataatctgagaaatctgtactaagggagtctgctcttaaagggaacatggctagtcatgtgaatagatctctaatgtagcatatagaatctttattaatatggattgttgcataaccaattatcttacatcaagacatgcttactgtaaggcacagtaaaggctcctgtgatgatggctctgcactgacccctagtggtgccctgcagtctctctcctgcagttaataggaaaggcagaaatgaacccttcttgaatttgttctgctgtctctagatctggaaaagagaccctgagctattcaaataaagatggtcacggccgggtgcggtggctcccgcttgtaatcccagcactttgggaagccgaggcgggtggattacctgaggtcaggaattcgagactagcctggccaacatggtgaaaccccgtctctactaaaaatacaaaaattagccaggcatggtggcaggcgcctgtagtcccagctactcaggaggctgaggcaggagaatcacttgaacccgggaggtggaggttgcagtgagccgagatcacaccattgcactccagcctggggcacaagagcgagactccgtctcaaaaaaaaaacattaaagatggttacatccatatgccaaggtattatgttgccactaaaaattattttttaaagaatcttttgtcagagaaaatgtttagaatataacattaagtgggaaaaaagatacaaaactacatgtatagtgtggtccaaattttgaaatagatatgtatatatttatttaacatattatatatatgaactttttaaaaaagactagaaggaaatgtactaaaatatcaaaacaggttatctcagggtagtgatgttattactgagctttatattctgtaatcatgttttccttttttctttctttcttttcttttcttaagagatggtgtcttcccggccgggcgcggtggctcacgcctgtaatcccagcactttgggaggccgatgtgtgtggatcataaggtcaggagttcgagaccagcctggccaatgtggtgaaaccccgtctctactaaaaatataaaaattggctgggcgtggtggcgggcgcctgtaatcccagctacttgggaagctgaggcaggagagtcatttgaacccaggaggcggaagttgcagtgagccaagatcgcaccactgcactccagcctgggcgacagagcaagactccgtctcaccgaaaaaagaaaaaaaagagagagagagagatggggtcttcctgtgtaaggctggttttgaattcctggctcctagggatcctcttgcctcagcctcccaaagtgctgggattataggtgtgagccactgtgcccagcccccatgttttacttttatcaggtgacataattaaaaaaaaaccaaaagctagtctcacagcatctgagagtctgggagtcagatgcatgttaaagtcagaggaatgaggtccagtgctggcttggcttgctttgccttatctttggttattgtcttagcaacataaaattattcaaggtcttgaagccaccttgggcttaccttcaagtgtccttttagtgggacagaagtatctgtgataggctctgttcacagtcttgactgttataagaagcactcttgtgcgtagccacctcccctctgctagaggccctggctgaatccaagaggaacagcaaaggctgtgcctccaaccaactgtggaaattcagccatgtggttgagttacttttttttctctgaaacttatagcagtcaataaattttcaaactcgaagagcccccaattcccagacttatttgaatccccaaagacacttctggagacattctcttcacagaaaataagtctggcaaaagggaatgcgatgatagatccacaatactctttttcttttccttttcctttcctttctttctttcttttcttttcttttttttgtgtgtgtgtgtgtgtaacagggtctttgtcagccaagctggagtgcagtggcacaaccatcgctcactgcagcctcaacctctcaggctcaagcaatccttctgcttcagcctccttgcatgccaccatgcccggttattttatgttttgaagagatggggtattgctatgttgacagggctggtcttgaactcctgggctcaagtgatcctcccatcttggcctcctgaagtgctgggattacaggtatgagccatcagcctggtgccacactactcttaactgaaattattctatgtccagccagtgaacaggatagcatttttacttctttgttctttttattttttgtgtatgcccaaaaggtaacatttattgtctttaaaaaggcaaatcttacataaataaataacaacaacaacaacaacaaaattcccatttaattctacctcctaagatacaaccaccattaacgatttatattttttcactctttggagccagtctgctagggaccaaattctagctctgccaacagctagcaaccttggacaagaacttaacctctttgtacatgcttctttacctgtaaaatgggggtaatgatagtaccgattacatgcggctgttttgagaattaagttaatatatgttaagcacttgaaacagcacctggcaatagttaagtgttcaataaatgttggcctttttctaagtgtgaatgagcattttttttttcattaaaaaatttttttggccaggcatggtggctaatgcctgcaatcctagcactttgggaggccgaggcaggtggattgcctgagctcaggagttcaagaccaccctagggaaaacatggtgaaacacaacatctactaaaatacaaaaattagctgggctgggtggtgcttgcctgtaatcccagctactcgggaggctgaggcaggagaattgcttgaacccaggaggcagaggttgcagtgagattgcaccactgcactccagcctgggccacagagcaagactctgtctcaaaaaaaaaaaaatttttttttaattgatatgggatcttgccatgttgcccaggccagtcttgaactcctgggctcaagtgatcctcccagcttgacctcccaaaatgctgggattataggtgtgagccaccttgcctggccagcttcttttttttttttttttaaatagacatggagtctcagtatgttggacaggcatatcagggtcttgatacgtagttttgaactcatggcctgaagcaattctgcctcagcctcccaaagtgttgagattacaggcataagccaccacacctggcctgaatgagcattttttaaaactgaaaagtgatcatgctatatactttgctttaaccttttttttttcacttcacaatacatcctggttaccttttagtattagtatggagaagtctcttcattctttttaatagctacataacttttttggtattaacgtgtcataatttaaccagtctcctatcaatgggcatttggattgtctgttttaaaaaagatgctagggccgggcatggtggctcacacttgtaatcccagcacttcaagaggctgaggcgggcagatagcttgagccgaaagagttcaagaccagcctgggcaacatggcaaaaccctgtctctacaaaacatacaaaagttagcagggcatggtggtgtgcacctgtagtcccagctacttgagaggctggggtggaaagattgagcccaggaggtcaaggcttcagtgagctatgattacaccacttcactccagcctgggtgatggagtaagactctgtcttcaaaaataaaatgaaaataaaaagtcaggtgtggtgccatgagcctgtagtatcagctactgaggagactgagacaggaggatcccttgaacctgggaggttgagcttgtggtaagctatgactgtgccactgtactccagtctggaggacagcaagaccttgtctcaaaaaagaattttcggctgggtacagtggctcatgcctgtaatcccagcactttgggcggccaaggtgagcggatcatgaggtcaggagattgagaccatccttgctaacacggtgaaatcccgtctctactaaaaatacaaaaagttagccaagcatggtggcaggcgcctgtagtcccagctacttgggaggctgaggcaggagaatggtgtgaacccgggaggcagagcttgcagtgagccgagatcacgccactgcactccagcctgggtgacagagcgagactccgtctcaaaaaaaaaaaaaaaaagaagataaaatactgcatatacctaaaagggaacattatggaaattacattcagttactaacatctccatttgaggttcacttactcatttgacaaatatttgttttttaatgtgctatgaaagatgagaggcatgctgatttgaaagcagcttctgtctttatgcttaatttggttgttttgttttgctttgttttgctttgttttgttttgtttgagggtctggccctgtcatctaggctggagtgcagtgataggatcatagctcactgtagccttacctcctgagctcaagcagttctccaacctcagcttcttgagtagctaggactacaggcacacgccaccatacctggataattttaaattttttttgtagagacgaggtctaactatgtttcccagactggtctcaaactcctggcgtcaagcaatcctccctcattagcctcctaaaatgttaggattatagacatatgagccaccacacctggcctttttatacatacttggttaaagacaattattagcaggacacatgctttgatgaagaaagtacccagtgctctgacagcatgtctgagggccttaacccggacttggagttgtctgtctgagaaggcttcctggagaatgctgtataggcttagctcttccctgaaagaatggaggtgggggctgggcgtggtggctcatgcctgtaatcccagcactttgggaggccgaggcggcagatcacgaggtcaggagatcgagaccatcctggctaacgcggtgaaaccccgtctctactaaaaaaaaaatacaaaaaattagccaggcgtggtggcgggcacctgtagtcccagctactcgggaggctgaggcaggagaatggcatgaacccggcaggcggagcttgcgtcactgcactccagcctgggcgagagagcaagactccgtctcaaaaaaaaaaaaaaaaaaaaaaaaaaagaatggaggtggaagcagaagcgaagaggatttcatgcagagaacatagcacacgcagaggtatagaagcaagagaaattcacatttgaggaattgctggtggttctatgtggctggggcatagaatttgaataatggggttaactattatagttaaggtggaaatagaaggacgtgtggctgaagaagaaggtatgggttgggtcctgaaggaccttcttaactacattcacatatatgacttatcctaagggtgatgggaaactttttagggagggtatggcagaatcaggtgtccatttcagaaagatcaatctgtgatgtgaatatatgttgagaggctgttacgcttaagtcatgcaggtaagagattttggtggtttgagctagggtggtaaaatgggatgggagagggatggacagattggagacttgttcaagactggctgtgggggaaagaaatggagagaaagagctatctgatcattcgaaggtatccaacttgggaaactggagagggacagagaaaatacagaactatgggggaaaatggtttcagtttggacccaaaattggaggttcctgtgggacacccatgtctgtggagttcagaagaaagacatccctgagctagagacacagttgagattctggaatcctcagcgcatatggtaactgcagtatgggaatgtttgagatggctggttgagacaccgacagtgcaaatgaagccacaaagaaggcagttgtaagaaaggtagaaggtaaatcagaaggttgttttcagctaaagactcaggtagatgtactgcggttctccatgtgtgaggcactattctaagtgctggtgatagagcagtaagcaggacaaaattcctgctcctgcataccttatgtttgtggtagttggagtagagcaaacaaataaatatataattttagccactgagaaaaaaaaacaaggaaaaaatatacaaatacagaatgatggaagggaggggtcattttggatggggtgataagaaatgacttaaaagcagacgtttgagcagagacttgaataaactgcagaaatgagaacatcttggcttggtagtttcaaagaatggaaagaaggccagagtagctagaggacagtgatggagggacaggatggaggggccagctcctattgggcttggcaggtcatgacaaagaattggggttttattctgagtgtgatgggagggaagccattggagggctgacagtgggcagggggtagggtggcgtgatctgaattacattttacagggatcactctggttgctattggggaatcatttgttgggctgccacagaggaaacaatggaggccagataggagtctggggcagtcattcaggagagtaggtggtggcttggataaggggggtgggatgagaagtggttggattcaggtgtgtgtgtgtgtgtgtgtgtgtgtgtgtgtgtgtgtgtatttttattgtattttttttggagacagggtttcactctattgctcaggctggagtgcagtggcacaatctcggctcactgcaacctccgccttctaggttcaagcgattctcctgcctcagcctccaagtagctaggattacaggccaccacacctggctaatttttatatttttaatagagatggggtttcaccatattggccaagctggtttcgaactcctgacctcaggtgatccacctgccctggcctcccaaagcgctgggattacaggtgtgagccactgcgtccgacctgattcagatacattttgaagtgggagctgaaaagatttgctgcatgtttggatatatgggtgtcagggagagagaataatcaaggaacactcctaggtttgtacagagggtctctgacttactatggttcggcttataccttttttttttttttttttttttgagatggagttttgcttttgttgcccaggctggagtgcaatggcatgatcttggctcactgcaacctctgtctcccggattcaagcaattgtcctgcctcagcctcccaagtagctgggattacaggtgtgcgctaccacgcccagctaattttttatttttagtagagatagggttttaccatgttggtcaggctggtctcgaactcctgacctcaagtgatccacccgcctcagcctcccaaagtgctgggattacaggtgtgagccactgtgccccggcctcagcttatgatttttggcgttatgatggttcaaaagcaacacacaattcagtagaaactgtgctttgagtacaaccattctgtttttcattttcagtacagtatttggtaaattacatgagctattcaaaactttcttataaaataggctttgtgttagataattttgtccaactgtaggctaacttaagtgttcgagcacgcttaagataggcttggctaagctatgatgttcagtaggtcaggtgtattaaatgcattttctacttaacgattgttcatctgatggtttatctggacatggccccatggtaagtcgagcagcatctgtgctttagcaattgggaaaacagaaaggagcatggcagctcacacctgtaattccagcaatttgggaagttgaggtgggaggattgcttgagcccaggagtttgagaccagtttgggcaaaatggtgggacacccccaactctacagaaaattttttttacaaaggctctactctacctgacaaaatcttattccttagtatttaatttctcttcttagggagaatttaaatttaattaagtaatttaaattaaaattttttcctggcaggggtggataatgaaaaaaaggttgagaaacactggcctagtgcaagaacatggcctttgggagtcacacaggcttggtatgaatcctggctccactacttggacacagtgcttaacctctctaagcttcactttcatcatttaaatgcccacagtattagcataataaccttagagttattggaaaaattaaatgcaatgacgtgcctgttatattgataaatactaattttctttcccctttatccccgctttcaagaatagagattattatagttaaggaactccagtaaactgggtagagaccaaatcaagtgggaatatggcaggcttaagcttgttggaagaaaaagaaaacaggacaagggggctgattaaatatacggagatgagtgtaaagaaataagggaggctgcttgcagtggctcacgcctgtaatcccagcactttgggaggccgaggctggcggatcacctgaggtctggagttcgagaccagcctggacaacatggcgaaaccccgtctctactaaaaattcaaaaattagccgggcgtggtggcgcacgcctgttaatcccagctacttgagaggctgaagcaggagaattgcttgaacacgggagacggaggttgcagtgagccgagatcgcgccactgcactccagcctggacgacagtgtgagactccatctcgaaaaataaaaaagaaaaagaaaagaaataggggagagcccaaggtaattcttaagggatttgacactcaaggcaaagccaccactaaatgttcttagtggacagtggacaatgacatctgaggaagattattctggagcctgacatattacactggaacagaggccggagaaaggagcccacattaattgtggtggacttggaatctgaagatctgagtgtataaaatgttgaacaatgaaaaggttggggaaattaattatggtgcctttaattttgaaacatcatgcaatcagtacaattgttttggaaggatatttggtggcacgggaaaacagaataaaatgtaagcatactacaaaacaatacaaagccatttttgtcaaacgcctatctaggtaggaaatagattatctctggggtgggatcttttctttttcatagttttctgcatttttcaattttcctacaaaaagctcgtgttgcttttataagaaaaaagttattttctgaaagaacctctggcggaactcagatttccagggacccacatgccagcactatcccagcctcgggtgtctgaggtacctagaccagagggtgtggccctggaggtgtgagacagggaaagctgggctgggccggccgcccctgcccggggcaagagcagcgtcgggaccggaggaccagtcgggggatggggccgcagaggtggccgcgcgccgggaagtgctcaggccagaccctccccactcgttacacgccctgtgctgggcacggggaggagcaggacgccaccctctggaaccacccagatcgctggggcctccgagaacccggagggcggaaggcctgagggccccctgcagccgcctactcctcaccccagccctaaagtagccggcggggaactgcgccagcccgcgcgcccgccgagccttcggtgactgacgggaggtgggaatgtgggcggagcctcacgccggagctgtgattggaacaaccaacacctcccaatctctcccaagagagggagacagcaccagagagggatgcgcagaggcgggggcttagaggcctctacgtgattggctaacagcgcagggagccgggcgctgtcccgatgattggcaggcgctagacagccctcggaaaccgccttggcttcgcccattggcatcctgtgagagtaggcgggattggttcatcgtgtggtgctgatgattagctggccgctgagagttagggtgttgggagagagttggagggggacggcgggggctgccgacttccttcttgttattggctggtgaggtgggtgggggtggtgcgacggcccagcggctgcctgggattggtgggggccggcgtgagtgacagacaggggggcgagctgcgcgaccagcggtttgtttttcggagcgttcctgaggtggagaacggtggccggacggagagactgcgggtctgagggactggcgggcgggcgggccgagcggcgccgccgaggccgggctgggccgagcccaggagcgcccgggatgtagcgggccaccctgccgatgccacagcgcccggccgcgggcggagccggagccggagcctggggaggcggcgggggcccagagcgcagcccgcgccccccgcgcggagccaggcccgctgccgtccccgccgcccgggcccccggcatgcagccccggctgcggaggtgacactcacggaccttagccaccgccgccgccatcgccaccatgggtaagtgtcgccaccgccccggcctgtgcccgcgctgcttcgcgacgccccgccccaggctgagggaggaggaccctgggccaccgcctgacaggcatggacagcccgcccggcccggggctgcggaccgccggccggccggccgcccgccccgctcgcgcgccgcggcccgggcgggggttctggctccgcggggcggcccggccggcagagcccgctcggcagccctccttctgggcggcgcggcgggcgcatcccggggaagcggcggcgggaccgagggcccgtgctccgcggggcagcctggtccgaacgagccggaccgcgagcccgagggcgggggagcaagagcgcagtgtggggcccgggctggaggctgccgcaggcccagctgctgttgtgtcttttccttgatttgcttttttttcctgcctgtgtcatttccttccctttgctcacacaggccggcctgtgagagttcccggggcttgctctccagccctgtgcgcgccccagcgcaggggggagggcgtgcggggctcggctaggaggcgattaaactggagctgtgatcaagcgcgcggttgacaaatgcgtgctgcacgcagattgctgggggtcaggagttggtcggatgctgccagttagaattcacatcctactttttgaaaaatcccgttgcaggggtttaatccattatttttttcttgcggtatccctgaaattatgtaacttttgaaagaaacatttgctacacaaaagaatttctctgaaatcacttcctttttgtcagtatttacaatttctactgtgaagatgtaatctaaggaaagcttttaatgtcttccgcacgtagcatttgagttgaattatattccatatcctttttggtagtttagcaaatgactactggactagactaagaaataacattttaaacgttctttacttctcctgcccagacaggtgttgtgatactgttgtcacaagttttgcaaaatatttggtattgccctaaataataataaaagggtaaacttcagtgagaggatcgtttgcaaaacgttccgttgcttctgtgaagtgccccatgtgaagagggagccttaatgtttgccttgccctatagcaaggtcaagtcctttttgtaggaggttaactgtacgctatgtcaaattcgccagatattgttttgtgacccatctctacaccctggctttgaatgaattgccttgttctagttcatgctgtccctcatacagtatgagaagggtttgttcatttgctgggcttactgtttccttctcatgctttccttcagaagtgcgtgctcttctgagggaaggtctgctgtgagagtggacataaaaggaacccagtaaggcctggtatttaaatatataattgaagaaatgtttattgaatttttttatagatgagacacagaattcttgtctaccccaggattcaaacatttatcttgtattatagattttgaataaatcttcgaattgatttatgagcctgtattgtgatagtctttcttacaagtcttttttcttgtcctgtgggggcagctgttagtcccaaaggagagtgtgaaatacttaagggtatgtagaccatccacttcctactttgttgactgctacaccagttagagtgcccacatgtgttgactacatctcattatctaacatgaaaatagatatgaacctgttttcacatttcaagacattttcaaaaagtttataagtgtgtgagtatatggagaccaatgatggggaggaaggaaactatataggctgggtctagagccccaaagaaaaaagggccaggacctcaggatcttctcatttgtccccacatcagttgtcctcctgtcagttttacgtgaagacacatgtaaaaggaacatgcaagaggaattaacttccctggtggctgcagtatattaggcaagctagtttaagaaccactgccctagctttcttcactttcccccatacaattctctccatcttttttgtgaggggaaagtagatgaccttgatacactgttagagctaatattgaattcttcttgacacctggctgttcaatttgctttgtatagagctcattgaggatatgtatacacagatacattcacacacagtctctctcttaaatactagtttccattttggtgatgaaaatttgaatttccagtttagttagtttgcttttagttgctgtagttctaaataaactcaaaggattgataagagagaaacatagacttcttagtattttagttatacttgttaaactccagcctcatgaagaaaggactaaaacttgagtctctgccctgcaggttctttggttaagtaacagtcacattttcctgagctgttctaagcccaagactgaagcctgtttgacaacttgggttaataaaaacatgtcagattttatattgtctgttagccccaatgaatttctagtggaaattatttatctctgtaaataataggaaatttttttttttgctttgatactatgtggctataaaaaattgggattgactggttgttttttcttggtcactccagaattcatttccagatttagtaatcatagtggcaaatgctgttcataatacctgagattgtttatgtggtctttttataaacgcagtctgaaactttatatatcactgaaaaatatgtaacaacttggaaatgctacaggaaactatagtgaatggagtacaggattacagatgatctggttctggtttgaagtcagaattattgtgacttacagacaccttgtctagggttccaaggctgttaggagctccctgttagaatagtctcaattcagtttggctagaatctgaccacctatgtagactctgaatagttagcagctgttttgattgaaatttgaatcacagtttaataaatcaacatggctatgtcattactagatttctgatatttttaaaaatgacagttggattttaaaactgaattttaggttgggcatggtggcttacacctataatcccagcactttgggaagctgagactggtagatcgcttgagcccaggagttcgagagcagcctgggcaacatggtgaaaccctgtctctactaaaaacacacaaacttagctgggcgtagtggcatgcccctatagtcccagttacccaggagaccgaggtgggaagatcatctgagcctgggaggttgaggctgcagtgaaccatgatcgtgtcactgcactccagcccaggcaacaagagtgagagaccctgtctctaaaacaaaaaacaaacaaaaaatagctgaattttaggcatctgtaaaaagtaagtatctgtccaactgagcattacttaggggaatacacagaggataagatgaggtttttctggttctatggaagctgttaatttattctttgcccatttgttgaatgcctcctatgtgccaggcatagtattaagccctgtgcctgtgttatcctgtcctcaagaagttacagttaggtaaggtgaagcagaaacatgtaaacaattaagtgcaaaagtgtgtaaagatatacaggagagagatcaattctgtcgttttggtattgacacatgtaattctatagtctccagtcctttgggttaatttcactaaacgttaaaatgtagtggtgatatatattgattcttatgaggaataaatggcctactttataatatgtgttttaagaatttgaaccatcaattaatattgaatgcctattatatcttagaacagaaaaacgccagcatttgactttgagatttagcaaaggttcaaccatttcttgaaggataaaagtttcttatgaattgagggtctggccttattgcatatactcattgtaaaatgatgtttgcctgggcatggacagggtggaggcagtggaagtatgtggaatgtcatgaagagaaagtaaaatctgactcagggacactgaagcacagactctcctgagtgggcagtgcgatcagacgatctggtggagctgggtagaacattgtcaagatgaagaaataacatcattagttaaatgaaacaaaacaaagattaaaacattactttggggattgtatctatggaaaagagagagagtgtgtggcatagtaaacagacaccatacgggataacaatgtttattagagaatgtggtgcttctggcaacttttctgggttgttagccaagggaactcacaaatgggaagtgccttaagaccctgctttgagatacaagtaatagctcagtctggaagagtggcttcctgctggagctaaagagaggagtatgttgcctggcagcctccataccacaggttggggtaccaggagaagaaaaactacatgccactggggaattacttaaaactgcctaagagcttctactttttaagcctgaactctaatccttgtttgatagatccttttctagttccatgaatactcctccttttcctagattcttaacctcttaatctctaaaattaacctctttctccttatgcttcttcctggtagcttctaagtgtgtcagaccactcccactctcaggaaatcttttcaaagttataagcacactattacgctacctcaacttgttcacgtgtaaagttcacaaatactttttttttttttttggggtggagttttgccctgtcacctaggcttgagtgcagtggcacgatctcagttcactgcaacctctgcctcccgggttcaagcaattctcctacctcagcctcccgagtagctgggattacaggcaccggccaccatgcctggctaattttgtatttttagtagagacagggtttcaccatgttggccaggctagtcttgaactcctgactgcagctgatccaccctcctcggcctcccaaagtgctaggattacaggcatgagccatcgtgcctggccatgactaattttttgtattttttgtagagatggggttttgccatgttgcccaagctggtctcaaactcctgggatcaagtgatatgcccgccttggcttcccagaatgttggacttacaggtgtgagccaatgcgcccggcctgtcactcttattttcttcaatcctttttttttttttctgagacagagtctctactctgtcgcccaggctggaatgtgttggcatagtcttggctcactgcaacctctgcctcccaggttcaagctattcccatgcctcagcctccacagtagttgggattacaggtgtgcaccaccacgcccagctaatttttgtatttttagtagtgatgaggtttcaccatgttgaccaggctggtcttgaactcctgacctcaggtgatctgcctgcctcggcctcccaaagtgctgagattacaggtgtgagccaccacgcccagccagcttgcttttcttaaagaatctttagtctgttaacaattatgtaaaatcatccatataacctcttatataaccatataagctactcatatttaaaaatatttatttttatacatttgtatttatatactctggtttatatattgtctaattctgtctttttttttttttttgagacggagtttcgctcttgttgcccaggctggagtgcaatggcaccatcttggctcaccgcaacctccgcctcccagcttgaagcagttctcctgcctcagcctcccgtgtagatgggattacaggcatgtgccaccacgcccagctaattttgtagttttagtagagacggggtttctccatgttggtcaggctgttctcgaacccctaacctcaggtgatccacctgccttagcctcccaaagtgctgggattacaggcgtgagcccctgggccctgccaattctatcttttttttcatacaactttgtatttgtgtgttgtttatctttttatccctagagtttgaacaccttgaaatatcttttaaaactttctaatgtgtaatacaagataagtattcagtaaattgttgttaatgatttataaaagttcagtaataaaattaagtattagggtagattaaatggcctccagtctttttccattgaccttttctcattgatgataataatagccagcatttttttagcattactgtgttaggtaccataagaaataattcgtaggttttctgttgcttttaactcccacagcagctttgtgaaatgatgctttatctccattttacagatgaggaaattgaggtttggagagaataaatgatttgctcagggcctccttaccaaatttttctgactctgaagttcatattcctaactgcttcagtctaagaaagttgttatttgttgtttttttttttgagatggagtctcgccctgtcgccatgctggagttcagtagcgctatctcagctcacaccaacctccgcctcctgtgttcaggcaattctcctgcctcagcctcccaagtagctgggattacaggcgcacaccaccacgcgcagttaatttttttgtatttttagtagagacggggtttcaccatgttggccaggctggtttcgaactcctgacctcaagtgatccacgcatcttggcctcccaaagtgctagaattacaggcgtgagcctctgcgcccagcctgttatttgtttttaaaagttttgtttgtttttaaagaatgccacattggaggagtgctgataattcagttagtctcagtccataccacagagataactggcttgtggcagccaagtgtgcatagtgatgttgctttttagaaggaaaaaaaacaaaaacaaaacctcaatccaggaagaaatgcctaaaagagccacttgatttacttcctgtctttatacatgtcctctgaagtatcagttgaagaacctgtctacctctaggaatgtattttactttgacacaaaattagattctataaccctgattcacttgtgtcagttgtcccagatttcagatgacagtgccaaacttttccactagtgtgttctcagctctggaactactaaacaagtttgttcattaagtaatgccaggaattggttagcttcctggaaacagaatttgtcaacctgataaaccagctcttataatagcgtcatcttatacagaattagaaatgatttcttcagtcatacttgtggatctgacttgaaaagtggtgtgtgtatgtgtgtgcctgtatgtgtattcacatccatctttgttcaatatctgagttgaaagaactgaaaattctcaatacttagggtggttaatgttgttactgataactccttgcattccgcttttaggagtattgttggatgctcctcagaaaacacttaaacctagtcataatcctccttgtattgatcccaatttattattacagttggcccaattttatatatatttaataatatctaagccatttaatatataaacctatacatattatatataagccaatcttcctagcttagatgttatgctctagtttttaaagtttggttgtgaggataaaaatcaaaacaaaaaaccaagttccctttttgtttttgggacagggtctcactgtcgcccaggctgaagtacagtggcatgatcatggctcactgcagcctcaacctcctgggctcaagtgatccttccacctaagcctctcaagtagctgagcctacagcgtgcaccaccatgcccagctaattttttgtattttttgtagaatgtagttttgccatgttgcccagtctggtctcgaactcctgggctcaagcaatccacctgcctcagcctcccaaagtgctgggattacaggcatgagccaccctgtccagccaggttcccttctttaaagaagctatagggaaattgtagaaggtataaaataattgatgggatatatatgtgttaatttgacagatgtctttttgtagatacccactttctcctcattcattatcccctttactgcatgctttctatattacagctatgtcactctcatacatacttttgtatatgttttgaagtggaatcatatgggaagttatgctcctggtggttttcctgcaagttttaaatctaattttactttcctgaacaagcaaaaacctctttataggcaactttgtccttttctgtacctcgtcagagggcatatagggcaccagagcagatttcgtctaggaagaggggagaggcaaataaggtgaggggccaggcacggtggcttatgtctgtaatcccagcattttgggaggctaaggagggaggatcgcttgagctcaggtgtttgaaatcagcctgggcaacatggtgaaaccctcgctcaataaaaaatacaaaaattagcagggcatggtggtgtgcacctgtagtcccagctactctggaggctgaggtggaggattgtttgagcctgggggtggaggaggctgcagtgagctgtgattgcaccactgcactctagcctgggcaacagagtgaaaccctgtttcagtcagtcagtcaatcagttaatcagtagtgggagaagagacttgagcagttttacttcctacatttcatgctgttcgtttctttccacagggtattagaatatttccaagggacagtgataaagggtagaagataggcactctctttgggtggaatcttttgtatttgcttcttttaaggtgtgccccaagtccccaaatggctcagttgtcaccaaagcaagtgtaacaactcatccctcatgttcccttcacgatcaacagatttattcattttcaatctccaaatgctatttgaatgggcaaagatctcttaaaggacctgggaaaaatttgtacaacatggaattggactggtttgtgttctgggttttggccagttgttttcaatgtatgagaactctagtactccatgctatttcaagaaaaggggattaaaagtaatgccagtaaggtggagacaatgcattgcttggtcagcttagggaggaaaaacaatagaactaccctttgacttccccatgggaagtagtaggcctataaacttgtaaagagttgtgggggttgctggtggtggcggcattcaaatgctaggcttgtaaaacaacttctgttcaaagcagttacctgaggcccttatttggtaccttttaaagtgtgctctcctccttatgatgctttaagaataagtctgggactgacactgtgccataatcctctctctatggattcatcttttcattcagtaccatattacattgtactgtgttcttcacttcaatttttcatctatttttcctggttaagtttctctggcactggaccaactgccctgtttgagcgtgtcccttccctgcaatgaattggtaaatattgctgcaggaaatctgattggagggctattaagaaaccattaaaggccaggcatggtggcccacacctgtatgtaatcttagcactttgggaggccgaggcaggaggatcactggagtccaggagttggagaccagcctgggcaacatggggagaccccgtctctacaaaaaataaaaaaatcatccaggcatggtggtgcatgcctgtgttcccagctactcaggaggctgatgtgggaaggtcacttgagccccagagttggaggctgcagtgagctatgatcacgccactgcactccagcctgagtgacagagcaagaccttgtctcgaagaaaaaaaagaatccattaaaattcaaattgccatagtctgaccttttgggctgcatctgattatagttacagggtctgtcattttacctgggcagaactccctgagtattagttatacagtttgtgaaagagctttgctggtctgtatttaagtgtcttagtccatgtgctctctttcattgcagacgaacaggaggcattgaactcaatcatgaacgatctggtggccctccagatgaaccgacgtcaccggatgcctggatatgagaccatgaagaacaaagacacaggtcactcaaataggcaggtgtgtgtgaccctggcagagctaagtgagatttgttggggaggggttttcaaatgggaaatatacgaaaagccaaggagactacattaccagggttgaatgcttttgaccccttcctttcacagtctgttaaatgggaagtaatacataccaaccaggtatggttaaatggtaagtgatattgggaggccgaggcaggcggatcacctgaagtcagtagtttgagaccagcctggccaacatggtgaaaccctgtccctactaaaaaacacaaaattagccaggtgtggtggtccatgcctgtagtcccagctactcaggaagctgagacaggagaatcgcttgaacctggaaggcaaaggctgcagtgagccgagatagcaccactgcactccagcctgggcaagacagagtgaaactctgtctcaaaaaaaaaaaaaaagttatatatgccatgcagttatggatctatgatttggagtcttaaagccttgtgtaagcatttcatctgttatggggacagtattcatattcgtttttcccctttactgatatttggcaaatatttaattcagattcatgatccctaagtcagaaggtttttagctaccttacagtatatagtcaggaaaaactaattaatttggtattagcttatgtaaaatataattaagaaggtaaatttattaattaaaatgtcacctagtatattctgaaggcaataatgagtgattttgttattactgtttacagttattttaccttattaaccttattgatagtgcctgttttattgagagttgtatgcttctttaggaaaacattgcctattttccttaacatttaaacttgtgtgtcattgacaatcttcttctcacctgtagtgccacttacctgtttcctgggtactttgttctgcagagaggagtgaatgatggggagctttcctacctagtgggtatccagtgctgtgtcagctagctatattgggcatgtttgatgaaaatttgtgtatgacattctcccttttggttctgtttgttatcagctaacctcctttcttctcatttgcaccttgtttaccaattcttcagaattggttcctagagatagtataaggccctaaaacttttcctgtctgtggtctgctagatagagccttccagagtatttcctgcctttaggaatcctagggaccccaagggaagaggagtccttttgtttcatgttaaaacagaaggattagtttaaaaagctgcttttgttgttgttaccttatagtactggaggtataaacagataagggcccattcttacactattttcatatgttattcagtctgactgtgtgagttctcccttgctataactcatttgtattcaaagccacttttcgaaggagcattttaccagaagtgagtcccctcccccttgcttgagcctaatgacctcactttccttcctgtcttcctatgtagtgtgtgcttgctaacattgctccagttagctgatctttctccagactggactattagcatgaatatcagttagtgggtgaaaaggggaagctttcttgaattggaaggcccaaaaggacgaggctgggaaaaggaggggcggaatggtcactgatggttccttgaaggaggattcctttttaggactccttctgcttagagcctaaaagccatgatgagggaagtcttgatcttttgctgtgcctgctgctgcgctggtagagtgaagtcagtggttatgaaggcagaagcctaaaaaggattgactgttaggaagtaatcttaacaagaggtactagatctttggatccatgatttacttcaatgttgtcaaacttatgttgcacgaaggatacaaattattaacctcagtttttttgtttttaaagaaaaaacacaacagcagcagctcagcccttctgaacagccccacagtaacaacaagctcatgtgcaggggccagtgagaaaaagaaatttttggtaaggatccagattacctgttaaagccaaaatgtacttttaaatctgctactcatgctgcaacagcagaattcacttcccagacaagttgttttagtggatttgtaaaaagcattggttacccgtgacctgtgttcagtgcttctagtcaccatttctcacaacagtattattcataaacagcctctatcagtgctgtccaataaaccttctgtgatgacagaaatgttttatatctctgctgtccaatgtggttttgtagccactagctacatgtggctgttgagcaactaaggaactaaattttaaattttatatcattttaattaatttagacagccacatgtggctagtggctattgtattggacagcatgactttatgcactatgtaagggactgttgatttattgggcaagaaattatgtatatgcttggagatgtgtagatattcattggtatgttcattccttacacacgtcatgagtttctgtacattgtgataagctaataatgggaatcctacctaagatttctgttttaggaagaatgtgaagatgtggaactagaacagctgtttagaaattgaagctcaaagttttatgttaatatgggcaaaaggggaaataaaatgctaagatagcttttcctcttaatgaagtcaaggttatagaatggcctgtcctgggaagtgtagcagatgttttgcttctgaccaagagggatattcttcagcaaaattctgaaagcagaaaaagacaaagtctcagcaaatgcatttctaggaaagatagggtaagaggtagtgcggggaagatgttggggagaggtatttatagcctagtataatgaaaggagcctggtgatattaataatcatttaacatcggattttataattcacagagttacacatttattattattattgtagtttttgttagcctaggcctgagatagaatgaaacagttttcttcattaccagttcttctgccagaaagtccatgcttaggaagagagaggaatgaaagatcaaaacctaatttaaatggtgaagagttgccaaatttggttaagaaatgtctaattggattacagattcaaattacagagtcccagttgaaagaagctaagcattttggctagctggaaaggttgtttattcaagggtggaatggggctggcagaggcaaacagcctttcactatgagaatggcagtgctggctacaaggcagagtcgagactggcacagcttcatggagctcaagcttggcccagcaaggaaagccagaggagctgtgggttcattaacaggattgtttgggtgccgaggcctggaagaactgaaaaatctaatttaatatctctgcttagcaagacttgagacatccttttccctaagtaaacaagcttggtaagtaattgaaaaagagaatggatttgagaacaaataggcagctatggaagtacatgggcagtgagctattaacaattttctaggaggtagattctgtattctctgtattctaggagtacagagaatactgtacactaggagcatttgctgtattctcccttttgtatattgggtctctggaagcctacagcgtggttagagctgactgaatattcttagatgtgtggcacatcctacgtgtggctgggtcctatggatagttttgcaggccatgatgtgcagtgtccctttagcagtcattaactcacagtgagttatcaatgggtgttagttctctgtgggtctgacaacttagtatagtgaaaagagtgctggcctgtggctgaacatgctggagaagagcttgcctggccacagggacacagccacgcagatccagcatgtgtctcccatgtgccaagtggagcccccagccaagaaggcagccacactagcagagggtgacaaggacaatgacattgacctgtttgtcagcgacaatgaggaggaagacaaggaggcagcccggctgtgggagaagtggctgaggtggtatgtggagaagaaggccaagaagactgcgttggtggtcaagtcctccatcccgctggacatcaagccttgggacaatgagaccaatatagcccaattggaggcctgtatgcgcttcatccagctggacgggctggtctaggggggcctccaagctggtgcccatgggctacggtatccggaagctgcagattcagtgtgtggtgggggacgacaaggtggggacaaactttctggaagaggagattaccaagtttgagagcgtgtgtagagtgtcgatgttgcagctttcaacaaggtctgaagccttagagtgtgtgtgcgtgcatgcgcacgtgtgcaagtgtgtgaggccctgccactattaaaaactgagaccaaccaaaaaaaaaaaaaaaaaaagagtactggcctaggagtcatagagttgttactcatctattaatgtaggattttataatttatagagtgctttcaacaacagttaacatcaatgctataagcatgtgtataaggtttacacagcttttacacaaaggtattgagtagaggcaggaagtaaatccaagccttctgattcctagtcaccgtaattttaccatgtataagtcatataacctttctgaagtgagtttttccatctgaaatatagacttaatactcactgtgtctacctcttaagattgttgtaagatcatagacagaatgtgaaatattttgtacattgtaaaacaaatgtacaaatgtgaagttgcagtggttatgtcacttcttatgttctggcactgcaggtgtgagctttggggaaagcttctaactacaactgtccatagtgttgtggaactgaaaggattaaggtttttctctctttatgggattatcattactgtttatctgatgatctttgcaaatttctgaagctagcctaatttctgaaaatcccagtggaggaagaaatggaatccttatttccatggattcctgtttcccttgaatcttatcaaaatggtaggtagatacttgaacagagtctgggctctggatctaaccctccagatgttcatgagtgggtgcttcagaacagaaaagctgctttcttcatgataggcacaagcagggcagggccttggctatcatttctagaggaagagaattccaggatctgttcccccagcagggtcagtgattgagcagactgtcttttgctttcagtgtgaaagacctggctcttcaggacctcccttctctttcaagggttgttgataagatgggctggccagtttgaaaataagatataaaacaacacacaagcctggcattatattttgtaagaagattgctttataatcgtctcttccactgatctcctacaactttccagagtcatgcttaaaaataaaattttaatttttgttgtatttttttttcctttcattcacttactctctttggcaaaataaggactgcaattccagaaatgtggggaggcatcaaaggtatgtagcaaatgcagggagagaaatcagtacagaatcagagcgaggataagaagaatgatgggtaactgaggcctttttcaggtcaagttagttcataaacctttggttaataaatcctgatttttctggattcttgaaagctttttgggctacatgttcagctgttgagtccagactttgagaaggtcatttctgctttagtgttattgtcagttattcctgttgctcctgctgagtccctgaatctgtagctcaacccgacagcccgcactgtctctctcctgagcgtggctgtcactactgctctcaccggattgcctgtggtggggaggggacatgaagctgcttagacctgaatttctgtactagaacttttttctcagtagctgacacctccattcagtttaacatgtgcctatggtcacgcttctcagacacacaaaagaaatgtatgtcggtcaggagtggtggctcatgcctgtaaccccaacactttgggaggccgaggcaggcggatcacctggcctggccaacgtggtgaaaccctgtctgtacaaaaatacaaaaattagctgggcatgatgataggtgcttgtaatcccagctacttgggaggctgaggtgggagaatcgcttgtacttgggaggcggaggttgtagtgagccgagatcactgcactccagcctgggcgacagagcaagactccatctcagaaaaaaaagaaaaaagaaaggtatgtcatattccctgtaccccaggaatcatgcagtcttactgggaagtgaggactacatgaaaaaaagaaagtatgatatgactatgcctcactgtgtggtacagagagtaagtgctatagaaggccaggaaaatgaaagatgagcctgggccagaggagctatggagtcatttcaggtggaagggcacttgaactaggctgtgaaggaagtataaacagttaggtagaacggaggaagggtggcactccaggtcaggaaacagaatgattaaaggcctaggggaagaagcaaacatggcttgtatcaggaaacaaggtgagctttgatctggctttaaaggggggtccctgtggggaacaaacagtgtgagatgatcaggtaaactgaatgagcctaaatcccagagggctttgagtgatagcagagaatttagactttattccatagataatgggtatcactgattaccttatgaacaaagaaggaacatggtgaaaaaggtgattgagatggttggaactgtagaggaacgcagagtgggttggaaatggggagctgaaatgtatcctcactctgattctgtactgatttctctccctgcatttgctacatacctttgatgcctccccacatttctggaattgcagtccttattttgccaaagagagtaagtgaatgaaaggaaaaaaaaatacaacaaaaattaaaattttatttttaagcatgactctggaaagttgtaggagatcagtggaagagatgattataaagcaaccttcttacaaaatataatgccaggcttgtgtgttgctttatatcttattttcagctttatacatttataaatgtataaagatataatgctttatatcttattgactctgggatcaaggggaaagggtctcactgaaggtgatgtcagggagaatgggaagcagagtcttataccggaggtctttgagaggagaattgaaatttgctccctggctgtgaggaggaaaaggaaggaaagaatcaagcattactcagagatgtaactgtgtagctgggagcacagcagtaccaatgttagaaatagtgacactgagccaggcatggtgacatgcgcctgtagtccaagctgcttgggaggctgaggcaggaggatcacttgaacccaggagctcaaatctgtagcgcacagtgattgtgcctgtgaatagctactgcactccagcctgggcaacatagcgagaccccatctctgaaaagaaagtaatagttgagaagggagactagtttaggagagtagttgatatagacacatatggctagattgagtttgagattacagtgggaaaaaacctcaagagtgtgtgaggtatgtgtatgtgtgtacgttgatttttgcaggtccataatctgttatctgcagttctgagatccaaacagtactacaaactaaaggggtatttttagtttttagtttctatttattattttttaatttgtagcagactcatttggcaaccagacctgtcctgaatagacacagggcaatttatggtctttctttattctacttattgtgaatattcatacttttcattgcaaaaattaggatagcttcgataaaaagcatgtactctgttaacaaatagactccaaatctcagtgatttaacacagtattcccagtacaaggagggggagaacagtgttgcccagagttacttaggaacctggattgagggagactcctctgtcctaggacatgtgcctgccagggaagagagtatagaacttgattctgttcctagctcttggtcagaactagggacaaaccccccaaactaacttttaagaggtccaggaaatacttgagcattctgcctctaccacagtagtactgtctcagacaccccccactccactgcctggggaggcatcacatgatttatagaacatctaccatactacccctctaaatccaaaacatgcattctgaaacacttttggccccaagaattttggctaaaggataatagacctgtattaccatttaccaaccacttgtatatcaggtactgttctaatcactttacccaattatatgatttaattcttttgataattccgtaaattggatactatcattctcactttacagatgaggaaactaagttataggttaagtatgaggctgcagtgccattactttttttttttttttcctgagatggagtcttgttctgtcacccaggctggagtgcagtggcgtgatctcggcttgctgcaacctccacttcctgggttcaagcaattctcctgcctcagcctcccgaatagctgggattacaggtgcccgccaccacacccggctaatttttgtatgtttagtagagacggggtttcaccatgttggccaggctggtctcgaactcctgacctcgtgatctgccctccttgacctcccaaagtgctgggattacaaggccaccacgcccagcctagtgcagttaggtttaatggcaaaaactgcaattacttttgcaccaacctaagttcgaggttacacagctaggaagttgtagagccaagatttgaagcaggcagttggactccagtgctacattcttaacaactacatattggcctcagatacgtggcaagcagatgagccttgcttcagtgattggggctacatatagagattgaggaatcatctatttagaggcccactgagaagttgtatgcagagcaggagaaagccagaagtcagaagtcgcaaggttgaggaatggtcatgtgtttggggaggggtgggagagggcatgaacaagaggaaccagcaaagaagcagaagtggtcagagtggtagcaggttccctgtgctgggatagagtcacagaagttggaaatagagttggccacccaccagtgtgaaatgcctcagagaggacaagaagaatggctggccggaaggcattgaatcaaattatctttatctgaacttcccttatctatggcttattatggtcaacctgatgggtgaaattcagatttagggactcagaagatttgggcatatcatgtggttcatggaagcttgtaaggctgtcatggcatcaaagaagcatctttgtttacactgctttttagtcacaggcttggttagtcttaagtagcagtgatttgtggtttggaacaaaagtttaattccctttctgaataaattcatgtagagcagtgcttaggttatggctcgttatgaaataaatttagttccttcatttccataaaggcactgaggagattccttcattagtatatctaaatataatgttgtcccagggctggggcagtggctcacacctgtagtccaagcactttgggaggccaaggcgggtggatcacttgaggtcaagagttcaagaccaacctggccaggggtgaaaccttgtctctactaaaaatacaaaaatcattcaggcatggtggtgcatgcctgtaatcccagctacttgggaggctgaggcaggagaatcacttgaacccaggagacagaggctgcagtgagccgagatcgcgccactgcactccagcctgggcaacagagtgagactctgtctcaaaaaataaaaaaataaataaaatgttgtcccagtttaagaatgaaagctgttatgtgtgtgtgtgtttttaacctcgtttttttgttttgttttgttttgtttcaatatatttttgagacagaatccttgttctatcacccaggctggagtccagtggcgtgatcatggctcactgcaacctcaagccccccgggctcaagcaatcctcttgcctcagctttccaagtagctaagactacaggcgtgtgccaccacaaccagctaatttttgtattttttgtagagatggcgttttgccatgtcgcccagactgatctcaaactcctgggctcaagcaatcctcaaacctcggcttcccaaagtgttggggttagaagcgtgagctaccacacctggcctaaaacttctaaaaatgaaaaaaaaaaaaaattaaacaaaaacaaaaacctgaggaaatatgtgagtaaactatggactttagttgatatatcaatattgattaattaattgtaacaaaaagaaatataccatactaatgtaagatattaataataggggaaactggctgggtgtggtggctcatgcctgtaatcccagcactttgggaggctgaggtggacagattgcttgagcccaggagtttgagactagctgggcaacatggcaagaccccatctctacaaaaagttacaaattagcccagtgtggcgacatgtgcctgtttgtagtcccagctacatgggaggctgaggtaggagaatcaatcacctgtgcccgggaagtcaaggctgcagtgagccgtgatcgtaccactgcactccagcttgggtggcaggagtaagaccctgtctcaataataacaataataataataggggaaactgtacaaaggggagaaggatatatcagaactctgctctgtatgctcagtttttctgtaaatgtaaaactcttctaaaaataaaatttattaattaaaataatagagctacagcaaggtatgctgggctgtaggcaggaacaggtaaaaggatgtataaccctcccacaggggcagacaggactacaaacttcatagagcacttgggatactccagatccagttgaggaaatagtgtgggaagctggagaccacacatcagagcatggcaactctgctttagaggactcttgtcatggtaactgtttagaatttcaggggaacgagaaaaagaagatagtgaaaaactgctctcagtgcctgtgtgacacttaagttgtagcatagcatggtagttaagagtcaggcttccagggttcaaatcctacctcttcctttacaagcgatatgacctgaccttgggggaacttacttaatcttattgtaactcagttattttctgtaaaatagggataataatggtacttgttttgaggatcagtttaattaatatatgtaaacatgcttagaacaatgcttggtttgtggtaaatgctcaataaacgttagctattatcattattattaatggataaagtggtccatgtgttatcttacaggataagaaggctatatcagggctgtatattttttgagacagggtctcactctgtcacccagactggagtgcaacagcattgtctcagctcactgcaacctctgcctcctaggttcaagcgattctcctgcctcagcctcccgagtagctgggattacaggtgtgcgccattactcacggcacactttttgtattttaagtagagatgaggtttcaccatgttggccaggctggtctcaaactcctgacctccagtgatctgcccgcctcggcctcccaaggggctgggattacagttgtgagccactgtgcctctggcctttaattgccattttaaatgaataaagtaaattttctcagttttaattttgaatatggtaaataccaatagatataatccacataagcaaaagctctttggggtctttaataatttttacagtgtaaattagaaccactcttgtaattcattgaactggaagagaagtctagtcccttaataccttgggaaaagggagtcctttaggcatctacccttcctttcaaactcactcccttttctgttgtctgtttgctatgtgttcctcatcttcaaatactcttaagtcctctttcttccaagccacagcctattaatttgtcttcttcaaaataatttttcttcatcgactatgacttcattctctcctttatctctattatttgctggtttcctgcccatcttacctttcttttcctctacacctgttcttctgtaatatctctctcctttccctgtcattttttaaactccctcaagttgtttgtttgcccttttgcaatatctcttcctctttaatttgttctttgtcattttaacatttctacttcctcttatttctcatatttatacttctgttcttcaattcattcaaccacttaacaaatattattaagcacaaatattatatgccatttcctttgcctggcactggggatatagaaacatgatagacctcgggaggccgaggcaagagaatcgtttgaacccgggagacggaggttgcggtgagccgatattgtgctactgcactccaacctgggtgacagagtgacactccgtctcaaaaaaaaaaagaaacatgatagacctgatctctgctctcctgcagtttacaggctactcatgatggtcattttggaaaaggctgggaacagtgtataagatcctactttacccccagtggggtagctttgggagggttttgggaaatcaatgatagtggtaccagtggcagcagcagcaaaaaccaaatattgcatgtctattatgtgtcaggtattttacttacatttagttgttgtaagaactctgcaaggtatgtttaggcttactctacagatggaaaaactaagactcacagaggataagtaacttgcctgtggtcatatagctagaaagcatcagcagcaaaatttcttttttgtcttcagtcacatcagccaacaaggaaatgtatcctggtcaggaggtgatagagtgggagaaacttccagagccaattgtagaaatagggtgtgtatgaagctagaaacagcatgtcacagcatagcaactgagctgggcagccacctagggatcttaccctaagagctttgttgtccctgatgttagaactggaagttttaactcattggaaaggaatgcccatgcccatctgggaagagaagctggaccaggagccatcagggatgtatgcctaatgttgctaacgaactgcccaaggcttacttggcaatggcaggagtgacacattccagagaattctctaacctgtctatcattctttttggcagagtgacgtcagaatcaagttcgagcacaacggggagaggcggtaagtctgccttctgatgagtagctgtgttcatgtatgccaaagttctcagatagcattgagttcatggaagtcattcccctgtcctgatccctgtggggccactggctgggtaatagggtggattgggcataaagggaggaaagtttcacccttgtcttggcctactaattgaaccttgttcctatcttagcattggaagccatttcaactgctgatgttttactgttctgctctattctgctgctgtgaggtctgacattttattaggaagtgaggactctggccctactcagagtcatggctttcagacacactgacactgtgtcacctgtgggcattagagggagggcaggattctcctgtgatatggtgccattactattcccagtagagcagccctggctttgtccacatcaagggtcaggttggtgaattagaagtttcttcatgatgtctctaggtcatgggaagctgcaccaagtccatcagttgtaaaagactttagctcctttgaggacatagaaagagggagtttttcggtctgtgttctgaatcttacctcattagggaagtgaaagtagtgttacaaaactcttctgtccttttctccattgtcagtattttcattattgttattttttgtgggaagccaaggtagaagttctcagtagaaaaaatgtgactgtacttaatttctgaagttatttaaggaaaacattcagaaagcatacagaactctggacatgggatatttgggaccttgcatgtttgtgcatgtgcggcacatgtacacataaatgtgcctttcggtgttttttccactctttgcctttctttcccattgatatactaccccctgccaccctcagctttcctttgctttgagcatttggacaggtgaagagcatacccattagtatgaggtcttcctactttaagagtctcaccacaggaccttagtacctctaaacattcttgattctggtagttctctacagttggtacctttcagcctactttgcagctggctccagaggagacctgtggctactattctccctttaaaatacacattcacaagcctacaaggttgtcagaggcaacccggtggaagcattgtggaaagtgtggtctgcagagccagggtccttctgctcctatgtgagttccaggcctggagggaggaaggtctgagctctgtccccagctgctcttcctgtgtcctgccattagcagagaagttaaattgtcacttcactgttgctacttttcacattttccaacctgagttttaaagggatggccaaactcagagcagcagagttttcaatcaaaagcacaattgtgttggagcccaattacgcagttaggctctcctgaattccctgttcccaaagtggtatgcagttacagtgagcaggcttacactgagaaagtgtatgtgtttggtttcagagaagctgccagattgaaaccacaaatatttaaggtggtcaggcaggaatggccttctgaagccctgagcagcagaacgttgcttatcaaggttttgaaaatggtgcattctctttttacggagctgttttcaggagccatggcatttcagtgtttgtgtactatatgtggaattgaggactttataaagttggtgcagggaagccaacagagttagtactctgtgccacacagctctagtttcgtgtatttcacgtcaggattttgtagagaatgtcattatgggcattttaaactttttacctggaatatgggtagtatttatctaaatgtaggcccttatagaattagaattcacaggaaagaggaaagaagtcatgacttttcccacttatccatgacaggtattcattctggtgggctgactttccctttactttgagaatatggggaccagacccctgactgtcctcccttttggccccaggagggctggggagaaggattgtagattaagatctccttccctttggaaatgttaatgacacactgatgggggtggttgcatgggtgttagacctctctttgaagcactggcctaaaaatgcctgttattcaataggatggcagcagcttagatcttacccaatctggaagtcctggcctctgatcttgaccagactttcaagctgcttttgtgggttttgaatggctcattgctaggccaaatgcagaagaatttatctctgatcatgatcctttttcaatagtgtgctagggacatctgagtggacttctggtattttatccagaaaggctggacccttttgcactgttgctgaggccttgaagaaggaggggtatgatttgctattaggcattaatagaaagctatcctctcaaaaggcttcagaaacacctctatctagagaatccatctagatagcacctaacagtatcactgcttgggacagttgatttggaagaaaaaaatataagaattacagtctgggccgggtgtggtggctcacgcctgtaatcccagcactttgggaggctgaggcgggcagataaaaaggtcaggagttcgagaccaatatggtgaaaccccgtctctactaaaaatacaaaaattagccgggcgtggtggccggcgtctgtagtcccagctactcgggaggctaaggcaggagaatcgcttgaacctgggaggtggaagttgcagtgagccgagttcgagccactgcactccagcctgggggacagagcgagactccatcacacacacacagaaaaaagaattacagtctcaatgggtttcctagtggagatgaaactaatttggttagcagtataatttccaaaaatgaaaggtggtgatggacaaaggaaaaaaacaggaaggaattaccttcttgagatgttaggctttgcgtgaaggatagattatggtttatattaatagtctatcaatgttgccctgtagaactttctgctataatggaaatgttctatatctgtgctgtccagtacacatatggctgctgtacatgtggctaatgagcacttgaaatgtggttggtgagacagaggaacctttttcttttaagacagggtctctgggccaggtacagaggctcacgcctgtaatcccagcactttgggaggctgaggcaggaagattacctgaggtcaggagttccagaccagcctggccaacatggtgaaaccctgtctctactaaaaatataaaaattagctgggtgtggtggtgcacacctgtagtcccagctactcgggaggctgaggcaggagaatggcatgaacctgggaggtggagcttgcagtgagccgagatcgtgccacttcagcctaggcgacagagcgagactccatctcaaaaaaaaaaaaaaaaagtagacaggatctctgttgctcaggctggagtacagtggtgtgatcgtggagcctccacctcccaggctcaagcagtcctcctgcctcaacctcccaggtgcctgggacaacaggcacactgccatagccaggtaatttttgtagagacagggtttgccattttgcccaggctggtttcaaactcctggactcaagctatccacctgccttggccttccagagttctgggattataggtgtgagccactgtacctgttcaggaaccaattttcagtttaatcaatttaaatttaaatagtcatatgtggctaatggctgccatattgaatagtgcagatgcagttctagatgatgaaggcttttatgcttctcactgatttgagccaacctgttacagaagaacattaaagaaattatctggtcagattttattaaaacccaatggtttagatccctctctcttgtggcttattgcttcttcctctggttacaccacttcccactctgggggagcagggaagatgagaaagaaccacacacttcttcctctcagcatggaagaggacaagaactgcgcaggcccatggctgaatactgcttgctccaacacacactagtctgattttatcctgcttaggtgtactaagagatgaaggttgttttaataggcatttctccagtcacattgggcatcttttcatgtgttttattagccacttacaattcttctgtgaattgtctaatcttttgccttttctattagattgtcttttattgattttttacaagtattttctcaaagtttgatatttgtttaactttgttgatggcttattttgcaatcagaagtttatttatttatttttttgagacagagtctcttgctctgttgcccaggctggagtgcagtggtgtgatctcagctcactgcaacctctgcctcctgggttcaagtgattctcctgcttcagcctcccaagtagctgggattgcagggcatgtgccaccacacccaggtaatttttaaatttttagtagagatggggttttcccatgttggccaggctagtcttgaactccggacctcaggtgatccacccaccgcagcctcccaaagcgctgggattacaggcatgagccatcttgcctggcttgtcttctgtattttatgttatggttaggaagaccttctctctctctgtctcttatagagagagagagagagagagagagagagagagagagagttttttttttttttagacagggtctcattctgttgcctaggctggagtatagtggcatgatcacagctcactacagccctgatctcctgggctcaagtgatcctcccacctcagcctcccaagtagcttagactataagcatgtactatcacacctggctaattttttaaaaaaatgtttagtaggcaggagggctcactatcttgcccaggctgatcttgagctcctagcctcaagcgagcctcctaccttggcctcccaaagtgcttggcccccaagatttttttttaattctgtattttcttatataaatttgagagtatgtgtgtgtatgagtttctttcttatattcttttcttcagttatctctgattatttttagtcatttctgttctagagtattgggttgaacccatataaaattgccacttttatatatcaaaaatggtcggccatcagtagtctcatatagttcaacctaatacattcattcaaactttttattggccaagcatggtggcttacacctataataccagcactttggaaggccgacgtgggaggattgccagagttcagaggtttgagatcagcctgggcaacttattgaggcccatccctacaaaaaataaaaaattagtcggtgcatgccagtagtcccagctacttgggaagctgaggcaggaggattgcgtgagccccagaggttgaagctgcagtgagccgttatcattgccactgcactccagcctaggtgacagaacgagactctgttttgaaacaaacaaacaaaaaaaccccacaactttttattatggaaatttcaagcacacacaaaagtagacagagtattaaactgaactcccatggacctgtcacccagcttcaacattactaacattttcccagtcttgttttatcaattcccacttttaaattttgctgaagtatttaataacaaatcagattttacacctctttggatgactccttactctaccttatatttgtagaaattgttctttgaactgacctaatgagtctctccagaaaatcttcaatgtcaatactagttacatgcacagatatgtcactggttaagaaaactgatcaggcatatcactaactcaagggggaattcctgtgactctgtagtagaaaatcttaattctgaggaaaatcagtatggagattcttatggcatctcaaagatgaacgatggaaaagacctttcaagtcctagagttgagtcccttaggagttgaggccatgttttcaggactgctactccagtctgtacgttttctaccttatttcctaaataatttttttctttcaacttttatttaagttctggggtacatgtgtaggatgtgcaggtttgttacatagttaaacatgtgccatggtggtttgctgcacagattaatccatcacctatatattaagcccagtatgcattagctattcttcctgatactctctcttccccaagtcccaacagccccagtgtgtattgttccccctccatgtgtctgtgtgttctcatcgttggaacatagtttttaaatctagtggcctcttctgtcattggcagaagagtctaagctgaagtggtagatgaatggttgggattgagcaatagttgtgggtactgttgtcaaacctgatagatgctcagagggtgaaaggtaacggtagagaagaggaaaaaaggaaacaatcgggaaaaggcaaattgagtgaaagaaaacagaatcctatgttgagaagaaaggaagaatatactcagaccattgctttttaaaccctacgttttaagtatacaattaaccaacctttctttctgtttcttttcagaattatagcgttcagccggcctgtgaaatatgaagatgtggagcacaaggtgacaacagtatttggacaacctcttgatctacattacatgaacaatgaggtgagaaggcagatggatggggcagggacaagaggggcagatgcctaccttttttctctctgtttaccagagcctttaaagtttgttcctctaatatcatctgcaggttttcattttctagacccccttttcttaattccaacaactgtgggatctctgttttttactacatgggagattactcagccatctcagccatctccattccccctactcattcagtgcagatagctctaatattccatggtggaatcaggtatggtaccagggctagggcttatactgtctcctttacattttgtaggagtatcttatttttttccccccagcacagccttaacaagaagcagagggtttagcaggggctagggaggtgtgaaaaaccagtgagtaggtcatctattacagtcataaatgcaggattcttctcttagagtttcttctgattggagcttatttgtttcaaatgttagcacctgctccaataagttctttaactcctcctcctcctcactccaccccaacggtccttatttacttctactttgaatatcacccaggaaggaattcttttgaatgtcagtttctgggctgctttcccagctccaagaagaatattacagactacaatcagcttaggctggtgctttgcagtgtatttatgctgagtaaagaatgtgtacctcgaggaaattgagttaggggtgcaagacaagaaagctgggcaacatcatgaccctttgagaaccagatcatcactgtgtagttttattttatttgatgaggagttaaaatttttcttttagtaaagacttttctgaatcatttagtactcttttctttttcagttaatatttccattaagaattcctgatgtttctttattctaaagccaaatataaatcattgttattattttagttcatacatgtcttaacatactctactaatgttaatgatcaggagttgactaacttacatttgattaatttaaaatccctcaattccgttcttttgtttgccctttaaaccctgcactgtcaagatctaagaatcccaaatgaaaaatctactgagattttatttatttatctctttgtaattatagttttattgagattaaaaaatttatcatctaaaagtataccattcagtggtttttagtatgctgatagagttgtgcaaccaacaccgctatctaattccagaacattttctttttttttctgagacagagtcttgctctgtcgcccatgctggagtgcagtggtgcaaacacggctcactgcagccttgacctcctgcgctcaagcgattcccccacctcagccacccaagtagctgggactacaggcacacaccatcacacccagctaatttttttgtattttttatggaggcagggtttcaccatgttgcccaggctggtctcaaattcctgagctcaagcgatctgcctgcctcagcctcccaaagtgctgggattacaggcatgagccaccgcacttggcctccagaacatttttatcactccaaagagaaacctgtacctattagcagttattcccctttctctcctcttctcagctcttggtaagcacttatctttctgtctctttggatttacctattctgaacatttcgtgtagtgcaatcatacagtacgtgaccttttttgtctggcttctttgactaagcgtatgttttcaacggtcatctgtgcatgttgtcagtatgtcattctattttatggctgaataataaatattccatttatggatataccacattttgtgtatctgttcatctattgatagacatttgggttgttttcattttttggtgattaaatagtgctgctatgagcatttgtttacaagtgtttaaatgaacatatgttttcaattctgtaaggtatatacctaggcgtggaattgctgggtcataagataactctaactttttgaggaactgcccagattttctataatggttgcacaattttacagtcccactagcaacttatgagtgtattagtctattctcactctgctgtaaaaaactgcccgagactgggtaatttataaaagaaataggtggctaggtgcagtgactcacgcctgttaatcccagcactttgggaggctgaggcgggcagatcacgaggtcaggagttcgagaccagcctggccaacatggtgaaacgccgtctctgctgctgatataaaaattagctgggcatggtggtgcacacctgtagtcccagctactcaggagcctgaggcagaagaattacttgaacccgagaggcggaggttgcaatgagccgagattgcagctcatttgagacagagttgagactctgtctcaaaaaacgattaaaaaaaattattttattttatttttaaataaacaaataaaggaaagaggtttaattgactcacagttcagcatggctggggaggcctagcaaacttaacaatcatgatggaagggaaagcaaacacatccttcacatggcgacaggagagagaagggccaagcaaatgagaaaaagcctcctataaaaccatcagatctcgtgagaactcactcactatcaggagaacagcagcatgggataaccacccccgtgattcagttacctcccactgggtccctgccacaacacatggggattattggaactacaaatcaatatgggatttggatggggacacagccaaaccatatcagtgagggctgcagtttctccaccatccttaccaacatttgttattttcttcttttaatagccatcctagtaggtgtaaagtgatatgtcactgtgagttttgtttttgtttttggtttgagacagggtttcactttgttgcgcaggccagagtgcagtgtgcaatcatggctcactgcagccttgacatcctgggttcaagtgatccccccacctcagtttccccagtaactgggacaataagcacatgccaccacactgagctaattaaaaataaatttttgtagagatgggggtctcactattttgcccaggctggtcttaaactcctggcctcaagtgagcctcccgccacagcctcctaggattacaggtgtgagccactatccccagcctacttggttttttttatttaactcccttcccaaccattcttatttattcccactttgaatgtcacacaggaagaaattcttttgcaatataatatgatttgcagaacattctcccattccataagtagttttgagattttattttaaatatgtactgtttttggcgaggcgcgatggttcatgcctgtaatgccagcactttgggaggctgaggcaggcagatctcttgagctcaggagttcaagaccagcctggacaacatggtgaaaccccatctctacaaaaagtacaaaaattagtcgggtgtggtgcctcatgcctgtaatcccagctacttgagaggctgaggcaggaggatcactttagcccaggaggcggaggttgctgtgagccgagattgtgccactgcactccagcctgggcaacagagggagatgctgtctcaaaaaaaaaaatcttgtattataaattgggaactgtgtaagttaattggacttttgcttgattttgtgtttaccatacgtgtataaaatctgaccaggcgtggtggctcactcctgtaatcccaccagtttggtaggctgaggtgggcagattacttgaggtcaggagttcaagaccaacctgaccaatatggcaaaacccagtctctactaaaaaaaaaaaaaaattagtggggagtggtggtgtgcacctgtaatcccggctactctggaggctaaggcaggagaatcacttgaacccaggaggtggacattgcagcaagttgtgattgtgccactgcactccagcctgggcgacagagtaagactctgtctccaaaaaataagaagaataagaataagatctgacatttgctaggtcctaagcaaggcatacgtttgcatcttatgaatctcttaataccaagtattcataacatgctctgctttttgcagtgagtgagacttatttgtaccctcagggaccttctatttaatatttcactggaacgtatgagtgtattagtctgttctcacgctgctgtaaaaaactgcccaagactgggtaatttataaaggaaagaggtttaattgactcacagttcagcatggctggggaggcctcaggaaacttacaatcatgacggaagggaaagcaaacacatccttcatatggcgacaggagagagaagtgccaagcaaagggggaaaagctccgtgagaatggaggaggtagttttcaggttctagtcactgactttgcccttaaacagaaagataattaaaccgtgctatgcagtctaaatttgtgtttttatttgtataacaattttcatcctctgaccatccctccaccccttctcttccttttctgcttgttctattaatgtcagcacaattggcagtagagtgggacatgatcctacttaatttggaaaagaatatgggggctgtaactgtttgcaacttgatattttgaagtaaattagtgtttttggagaggcagctcttctcagaaagtatctcacaactgggtactgaggtatgctacagcatggatgaactaaaaaacattaagtgaaagaagctagatgaaaaagattgaatctttatgaattgaattgaatatgtatgaattgtatgagtctaaatggaatgaaatgtccagaaaaggcaaatcaatagagatagaaagtagagtagtggttgcctggggctggaggtgggaaggaggagtgactataaatgggcacaagagatcctgttggagttctggaaatgttttaaaattggattatgatgatggttgcacaactatgtaaaggtactacaaatttttggattgtacatttagagaaaaaaatctgtatggtttcaactagatctcttaagaccccatagtatccagtgagattgttttcctccaaatgtatttttattttttgtttattttatttctgcaaagtgaaacattgagataaacttctgttttatattattttccttttctatgtcttgtatcacagctctccatcctgctgaaaaaccaagatgatcttgataaagcaattgacattttagatagaagctcaagcatgaaaagccttaggatattgctgttgtcccaggacagaaaccatgtaagtagcccttgtcatggtctggcagctgaagacaaagcttgctttccttcaggaacttgtctcgcctccttgacagacattttcgttcctcagccactgccaaattgagagcataagcacagcacagcccacttgtcagtggccagtgaacattctgcatttgatttcaccgaaaagccagattgtcagtgttaacattgcatctaaaggttatttgacttttggtgagggaggaaggaaaatactttatgataaagaataaaattcttgtgctctaaatttatgttttttcaattagattttgaccccaacaagagaaatttgattcgtttggcagtgccgattaggaaagactgtcaaagatttgagactgtcatgctttataaacccaactcccacaacaccttgcctttcccttggaacacttgtaggaaacaaacttttccttttgttcagtggaaaaagccatgggttgggggcctcttataacttatcagctgttgctttacccaatggcaggcagtctgtagggtgtcagaagtggggaattatcccttatgcacagtttcctctcctgaaggattcctggaggcccgcatttcacaagaatgcttgcaatctgtatctgtcttccaattactgattcttctaccagttttcttcagatgcatgtttctgaaggtttcttggcaccatttccttttcttatgcttgacaggctttccttttctttatgtggacagccaacatggcagcataagtgtgggtgtagtgactaggacaaagtttaggtggaatgctgctcatgctgaccatttcttttctttttttttttttttttgagacagagttttgctcttgttgcccaggctggaatgcaatggtgtgatcttagctcactgcagcctccgcctcctggcttcaaatgattctcctgcttcagcctctcgagtagctgggattataggtgcccgccaccatgcctggctaatttttgtattttttagtagagacaaggtttcaccatgttcgtcaggctggtctcaaattcctgacctcaggtgatccacccgcctcggactcccaaagtgttgggattacaggcgtgagccactgtgcccggccattttttaatttttttagtagagatggggtctcactgtgttgcccaggctggtcttgaattcctgagctcaaatgatccacccactttagccttgcaaagtgctgggattacaagtgtgagccactacacccagcctgtggtgaacatttttctatgttgtaattataatttgtaaggatacatgtttctcttgagtcgatataccataatttaattaaataaccatttttgctactgttgggacacagaaactgctcctgttttttgcatttataaatatttacatttaagagtaacaatggtaatgtttggtgatgaaatctttcctccagaacttcctcacctagactttaggcttcttaataaatggaagaattatgatccaaaattgctctgtgctcaggaatcctcacctctagaacagtgttcctctaactatatgtgatgaaatatcagttttgttcttttgatttcaaatctgtcatggacttttttttttttttttttttttttggagatggagtctcactctgtcgcccaggccggagtgcagtggcgtgatctcggctcactgcaacctccacctcccgggttcaagcaattcttctgcctcagcctcccgagaagctgggattacaggtgcacgacaccacgccccgctaatttttgtatttttagtagagaaggggtttcaccatgttggccagactggtcttgaactcctgaccttgtgatccgcccgccttggcctcccaaagtactgggacaggcatgagccactgtgcccggccgtaccagttctttttttaaatacaaaaactgagaagtgaaatggaaaaataaactagaggtatataaattataaggctacagttttcattagtagattcaataaacataaaatcactctgccaaattgctctaaagtttttcaaagggccctctccatttctttacttacttggtggaagagcaggacgagcagtataccagtgtgtggactggcaccagcccagatatcataccttaagtacactgctccaggatactatatcacctggtcttcatcacctccgctgatactgtcagtcactttgtttctccactttgaatttcctgcatttgtagcagttgcctcaccgccttttgttaccacctattcctttatttccctttttttttgagatgggatcttactctgtcacccaagctggagtgcagtggcgcagtgacagctcaccacagcctcaacctcccagactcaagttatcttcctcccatctcagcctcacaagtaactgggactacaggcgtgtgcccccatgcttggcttttctttttttttttttaattgtttgtagagacagggtcttgccatgttgcccaagctggtctcaaactcctgggctcaagcaatccttctgtctcagcctcgcaaagtgctgggattacaggtttgagccaccatacctggctgtttctcttcttgttcctgttttgaattgtgctatctctttcttctctttggattcttcttcttcttcttcttcttcttttctttttttttttatttgagatggagtttcactcttgttgcccaggctggagtgcaggggtgtgatcttggctcaccgcaacctctggcttccaggttcaagtgattctcctgcctcagcctccccagtagctggggttacaggcatgcaccaccacaaccgcctaattttgtatttttttttagtagagacggagtttctccatgttggtcaggctggtcttgaactcccgacctcaggtgatccgcctgtctcggcctcccaaagtgctgggattacaggcatgagccactgcaccccgccttggattcttctgatccctatatggcagcttctaattttccttctgtcttcattcctcacaaggtacatagtcttacctctcccacctcactttggccaaggccatgtctgagaggcctcaatattattcttgagaactcctgagttttggtaatcacagaactatctctttttttttattttgaggcacagtttcactctgtcacccaggtacgatctcagctcattgcaacctccgcctcccagattcaagtgattctcctgcctcagcctcctgagtagctgggattacaggtgcatgccaccatgcccggctaagttttgtatttttggtagagatggggtttcgcactgttggcgaggctagtctcaaactcctgacctcaagtgatccgcacgcctcagcttctcaaagtgctgagattacaggtgtgagccaccggatctggccagtctctttgtctgaaaagcctctctctagccttggtctctaccatcattttaagatacttcattgtctccttctgtagtttttgctgtcctaagcctctgctttggaccaccaacttttagcttatgcatctaacttttacatttgtctttcagctcttgaccttcttaggactttctagtctcagatcttccactgtcataaagtaatatcaagctgaaccttcttttgtaacttgtatttgtatacgataaaaactaaacacctagccactttgttttgttacctcatattcgcgttgacaaaaataagcttctaatcttctcacctaaatattgtaagttaaaaatatcaaggataatttaaaaggtaattcttttcagtccttgtaaaatagtgggacaggtgcaggaagataaaacaaacctgattgggcagaatagcttcttctggcccctgttaaaaataaacactgggccgggcgcggtggctcacgcctgtaatcccagcactttgggaggccgaggcaggcggatcacaaggtcaggagatggagaccatcctggctaacacgtgaaaccccatctctactaaaaaatacaaaaaattagctgggcgtggtggcaggtgcctgtagtcccagctactcgggaggctgaggcaggagaatgacatgaacccaggaggcggagcttgcagtgagccaggattgcgccattgcactccagcctgagccacagagcgagactccatctcatctcaataataataacattgggctgggcatggtggctcacacctgtaatctcagcactttgggaggctgaggcaggcagattacttgagcctaggagtttgagaccagcctgagcaacatggcgaaaccctgtctctattgaaaaaaaaaaaaaaaaaacgaaaattagccaggtgtggtgcgtgcctgtggtcttagctacttgagtggctgaggtgggagaatcacctgaggccgggaggttgaggccgcagtgagccaagattgcaacactgcactccagcctgggtgacagagtaagaccctgtctcgaataatagtaataataacaacacctagcacataaaaagtgtttttatctttcacttgatttttacaactctgagggtaccagggcaggcgtctattatctccagtctacatctggggaaactgagacttagggtgactgctcaggtgaggcagtgtgtagtgacagagctggtctgaaatccagatgttctgacttgtagtctagtgcctgtcagtcaccatccagaagagggaatttttttttttttttttttttttttgggatggagtctcactctgtcacccaggttggagtgcagtggcgcaatctcagctcaccgcagcctccatctcccgggttcaagcgattctcctgcctcagcctccctagtagctgggattacaggcgtgcgccactacgcccggttaatttttgtatttttagtggagatggggttgggcggggggcggtcctcaccatgttggccgggctggtctcgaactcttaaacttcaaatgatctgaccgccttggcctcccaaagtgctgggattacagttgtgagccaccacgcccggccccagaagagggttcttagaattattgtagtccttgggaaacctcacccaggtgcctccacggttggaaatcattagaagccaagcagaaagtataatactgtccatgaggagaacttgtgagatgttgtatcattctgttccctgcagctttgaagacaactgagctagcaaatgtccagaagacaaaattttcaaggagttggagtcactttcatatatgaacagtgtaaaagtttacaatgcttggccaggcgtggtggctcatgcctgtaatcccagcactttgggaggctgaggtaggtggatcccttgaggtcaggaatttgataccggcctgaccaacatggtgaaaccctgtctctactgaaaatacaaaattagctgagcgtggtggcgcatgcccgcaatcccagatactcgggaggctgaggcaggagaattgcttgaacctgggaggcggaggttgcagtgagccgagattgtgccattgcactccagcctgggcgatgagcgaaactccgtctcaaaaaaaaaaaaaaagtttagaactctttagttaggaaagacagcctaagcatatataatcagagtctttaaagcgtttaagagcatggataatgaagacacggatttattcacctaatctcaatttggatgaactccttgaatattgagcattatcttagaacaaaaaagaaataatttgtataacaagtgataaaccagcctgggtaacatagcaagacccccatctctacaaaagttttaaaatcagtcgtggtggcaaatgcctgcaattccacctacctgggaggctgaggcgggaggatcacttgagccaaggaattccaggctgcgatgagctatgattgcaccactgcactcattgagcaagaccctgtctcaaaaacaaaaaagatgatatatgtggcatctattattctgaaattgtgtagcttcaaagcagattttaaaaagggctttaggccgggcgcggtggctcacgcctgtaatcccagcactttgggaggccgaggcgggcggatcacgaggtcaggagatcgagaccatcctggctaacacggtgaaaccccatctctactaaaaatacaaaaaaaaaaaatagccgggcgtggtagcgggcgcctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagggctttaataaattcatggatggtaaagctgtaaatttaattaaatcacctcagatgctttcacagctatcataactatcatggtcttccatgcaaatatctcttggtaccaccattaaaacagaggactggacaggatgctcttggtgatccagtgtgccatttcttaccttacattcccatgtaacaaactaaagcaacccctctccctgcttcacctcttccctgcatcgttgaatccacttgccagattttttattgagataatttgtgggtggacttttgtaacttatttttctactgatctcctatcttccagtcactgaaatcttgatgcacatggtttcctggtaatttttcatattgtttgtgttagccacagctaacttctacccagagtcctttagtgaggtgttcatggaatgatcaaacaccatcttctatttgttgtctttagaatgttctgctagctacacagttcatacctatgggctctcctgtcactctgcgacagtccccttatattctcaggcatagtcccaccttcctccttcctctttttcccacttctgagtcttattcaaggtgtcctaaacccttgaagcaacctcatttttatttaccataccattcccttttgcccccttaaattgaggttttcaaaatttggctgaatattacaaaatgtcagtgcttggactctgtgtccagaggttctgttgatctgaggtgtcaaaatctccacaggcagctgggcatggtcgctcacccctgtaatcccagcactttggaaggccaaggcaggcagatcacctgaggtcaggagttcaagaccagcctgaccaacatggagaaaccccatctctactaaaaatgcaaaaaattagctgggcgtggtggcacatgcctgtaatcccagctactcgggaggccgaccaggctggagtacagtggtgcgatctcggctcactgcaagctccgcctcccaggttcatgcccttcttctgcctcagcctcctgagtagctgggactacaggtgcctgccaccacgcccagctaattttttgtatttttattagagacggggttccactgtgctagccaggatggtcttgatctcctgacctcatgatccgcccgcctcagcctcccaaagtgctgggattataggcatgagccactcccggcctagcttttagattttttaattgagggtttagatagtatgtcctttggtacacatttcaaattcatgttgccatgattttttgaattcccactatgtgtaaggccctgcattcaggcaggtggcagggtgctcatcatgcacctcctctttgtgagtgcaagactatgaccctcccttgcccttcacttgcctgcctccccagtatgtggctttgactgttgtttcctttttgacccttagcagagagctattgcacatcggaggcttcagcaagaacattcacttcccccttggttctgacttcccgttagagcaagacagtttttcaagacaacctgcatgtgataaagtctggcatggggactacaggaggttgcttggcagctgaactctcccctgagagcaggaaacctttttcctggaggacaggatatagagtttgtttagatcggactttttttgttagggggaggtagaggagatagaggagcaagtagaaactttgaaccaacttgtttgtaaatcctgagctctcaccccgactctcaccagtgccctgcttatttgtaatagcatcctgacatcacttgattacctccagggtttagttttaagctttctcagtgcaaaggcccccctttgttgcttagttttctctggcggctggactgggcccagtggaaagagtgggtgggtgctgggaggattgctgaccctcctctcaggcccttgacctctgtctggcacaatggtacttatgatagcttttcccaattgaacatgatcctgagatgatttgtgtgtaaaccctggaatcttcttaattttcagggagtgattattgttgggaaaaagaagcaaattgagctacttttaaacatacatatataagctgggcatggtagcatgtacctatagtctcagctaacccggaggctgaggtgggaggatcccttgagcccaggagtttgagtccagcctgggcaacatagcaagactctgtatcaatcaatcagtcaataagataaatacatatatagcaaccagaattttgttggggagggaagttgccatcattcactctccatcctgacttcctcctctgcagaaataattttctgctactcttcctaaactctctggagaattttatgagagggtatttacagctctcttttctgttttgcagattattacaggaatgcctgttattcctccatgtctggatcatcacctgttaaactggggcactaggtctcagcgctcatacatcattgaagctataaaactacattgagcgaatagtggtttgctgagacaaatagaagagtgagatttgggggaaagctgggtagctcatgtattaaaagcatgaaggtggctgagcctgcagggagtccttaggaaaagggtgagaagaccttgataggcctgactgtgtaaagatgtagcttggcctttttcctcttcttttacagaacagttcctctccccactctggggtgtccagacaggtgcggatcaaggcttcccagtccgcaggggatataaatactatctaccagccccccgagcccagaagcaggcacctctctgtcagtgagtatttcaacccttttttctccccctctattttatctgcccacattttaaaaaagcaacaagtatttgttaattaaataatcatcaaatatttattaactattactctgtgtagagtaatcctttatgcctttattttatttagagaggaagggcaaagaaataactgggatggtatcctgactctcaaggaacttaaaatataatgatatagtagtgtgattaaattccttttaaacatccctgaaaaagtgattgcctcagacatctgcttgaagacttccagctgtgtttacactcacttttgaccattcttgtgaagaatagagacttgtaaagttaggaatcgggtctaagtttgaattttgaccttaaacctcttgcttatgattcctgagaagtctttatacttcagggaagatagtgaccaatgaaacttttgagagagtcaagctaagttgtctggaaggaaaggagactattgacatagtacagtcatttctctgtgtttgtaggggattggttccaggacccctgtggatgccaaggtctgtggatgctcaagtccctgaaataaaatagtgtagtatttgcatataacctacccacatcctccttcatagtttaaatcatctccgggttatttataatatgatgtaaatactatgtaaatagttcttatgctatatttttatttgtatttttttgctattgttattttttataattttccatatattctcaatctgtggttggttgaatccacagatgcagaacctggagatatggagggccaactatatatacaaccctctgctaactagtcagaaagctctgtggctgctaccagtccttcccaggacaggaatctaaatcaggcctgtgcattattacttgttaacccaggattcctgtggattccacttttgggagtctggggagaaagcccccatttcttgaattgtggaacttgtatcaaaagggaaatctggtcttatcaaacatcgtgttgagcctgctgccttaatgttgtggagacccctgctgctgctagaaagccagctttgcccttatccatataggtagaattgcttcaaattgaagtgtcctctgaagatcctgagctgagcttgagagatctaagcactgatcctgttgctgagtttgtctgtttgcaatatgcctcctgagggagttacaggaaaaatatgtttctgaggtactgactttgccttactgagtaacttctggaatccaggcaagtactggtagtaagtattgccaggctgaaagtctgtatatgaatttcagatttctgtagataattggggaatgtgttggttgaggatggagagctagtaccctagcaaggagagcctagccacagcgtctctggccctggaatctgtgtgcctcagagcctgggaagctctgccagtttggcctcttttccgtagtccttgtagagattgaggggatggaggtgggcagcatggtcccttgtaatcagtaaggattgatggggcagtaactgggtctcttgcccccaagcaagagcctatgatatgtgcatggaggcaggggctaaatacttagccactggaccctttctccatgttaccgggagctatatatggaaatgattttcctggctgagaatgctgaggagtgagatttctgtgaagtagttcctgtttatctggaaaatgggcaacacggcctcttagcatacctagatcctggcttccttcattcagcaaagcattaagtaccagctgttgggctgagatgaatgctgcagtgaagcatttgaaagagcaagggtggctggagcagattccgcctgggagagaggggctttcacagaaaaggtaacatcagagctgacactccaaggaagatttactgagcatcaagtagagagagatatctcaggcatagtaaggagcacctgccaggcatgatcacaaaagaacttggtgggttgaagaaccccaggggctttgcactgtgtgtagggtaaggtagatgtggcaagagaatgggctgagcctgtgagcgtttccatagagccaagaaatgggagagatgatttctaactggaatgatctggaaaatgcattctgaggggagctgttccagctggaccttgaaagattgtggaggatttccacaggggacaaggggagagaggagagggcttttagactatgtctgtggagagctcgctattcttcaggtccaggctggctgatacatttggaggaggaatagagaggccaagaaaggatgcctgggtgttttctaagggactctcagctgcactcagactcttttggtaggcagtggaagccactgaaaatgtttgccccttatacccatcaccattataatatttattatgttgtctttttttttttttctcgagacagagtctcactgtcacccaggctggaatgcattgatgccatctcggctcactgcaacccctgcttcatgcgctcaagcaattcttctgcctcagcctgttacaggtgcacaccaccactccctgctaatttttgtgtttttagtagagacgggatttcgccatgttggccaggctggtatgactcctgacctcagatgaccacctgcctcggcctcccaaagtgttgggattacaggcgtgagccaccacgcctcaacctatcatgttgtcttatctttcttccatcatactacgtttttgttcattcattcaaaagataattactggctgggcatggtggcttatgcctataatcccagcactttaggaggccgagttgggtggattgcttgagcctcaggagtttgagactagcctgggcaacatggcaaaaccccgtctctacaaaaaatacaaaaattagccaagtgtggtggtgcaagcttgtagtcccaggtacttgggaagctgaggtgggaggatcacttgagcctgggaggcagaggtttcagtgagccatgaatgtgccatggtactccagcctgggcaacagatcaagaccctgtctcaaaaaaaaaaaaagtaattaccaaagtatctactatgtgccagaaatatgggaagcaaaaaagacacaggccctgtccctgtggcctttacaatccatggaaagacagacatttacttcttatgatgtgattaatgtataattacaaactgtgactgaaaggtgtgtggtgctgcaggtgggctataactaagaaatgggctgggcatggtggctcacgcctgtaaccccagcacttggtgaggccgaggtgagtggattgcttgaggccaggagtttgagaccagcctgaccaacacagtaaaaccccgtcactaataaaaatgcaaaaattagctgggcatgatggtgagtgcctctagtcccagctactcagggggctgaggcaggaggatcacttgaacctgagagatcgaggctgcagtgagtggagattgcaccactgtactccagcctgggtgacagagtgagtgagactctgtctcaaaaaaaaaaaaaaaaaaaaaagaaagaaagaaagaaatggtgggctataactaagggatgggacctgatcctgatcttggggccaggaaagccttaggcatgaatgggatttgggaattaggcaaaagggatgcaaggaagagggttccaggcaggggatgttacaagagcagagacttgatggcaagaggaagtgtggtatgtcagaaatggaaagaagtccagatagctggagagctgggagcaaggggaaggggagggcaggatgaagctggggagggaggcagagccttgtggaccctggttaagattctgatcattgcatggaaagtagtgaaaagctactttagagtttttaagtgaagaggagtgggtgatgttacatattcgtatttgtattttgaaaagattgatctggctacagtgtggataacagattggagggggcaagaatgcatgcaagggaactgcattaggctaatgcagtggtccaggtaaagaaaactgggcttggagtaggctgatgaagtggagagaggaaggagcaggtgaacttgtgacatttagaggtaaaactgacagaacatggcgttttggtggttctcaaagtgtgttctggggatcctggggagtcccttggatcctttgaccctgtgagttcaaaattattttcttttttttttttttgtgacggagtcttgctctgtcaccaggccgaagtgcagtggtgtgatctcggctcactgcaacctccgcctcccgggttcaaacgattctcttgcctcagcctcccaagtagctgggactacaggcatgcgccaccacacccagctaaattttgtatttttagtagagacggggtttcaccacgttggccaggatggtctcgatctcttgaccttgtgatccacctgcctcagcctcccaaagtgctgggattacaggagtgagccaccacgcctggccctcaaaattattttcataatcatgctaagacatgacactcaattctctcacaagggtacaatggaggtttccagaggtcaggtgcctgaggtgatgtcatcaccgtaatggcttaatggcatgtgtgcttgtatatgattgtattcttaaaatttcttttttcctccactggtttctcctgagaaaatgtttttaaaatttctgagttttaattgcaaatacagtaaatatcagttgatatatcctacataaatgaaagctaagtggcctcagttttaaggtacagaggggttctaagaccaaaaggcttaagaattactatagtattggattgaatttgcaggtgttttcaggaggctaaggtgggaggatggcttgattccaggagtttgagcttagcctagacaacataatgagacccaatatcatttaaaaaaaaaaaaatgaggccaggtttggtggctcacatctgtaatcccatcactttgggaggccgagatgggtggatcacctgagattaggagtttgaaaccaacctgaccaacatggtgaaaccccgtctctatgaaaaatacaaaaattagttgggtgtggtggcatgcgcctgtaatcccatctactagggaggctgaggcaggagaattgtttgaacccgggaggcggaggttgcagtgagccgagatggtgccattgcactccagcctgggcaacaagagcaaaactccatctcaaaaaaaaaaaaaaaaaaggaaggaagaaaaaataatttgcagatattgagagagagggaggtaaattactgctttgtggagatgaataaatggcatcgcctttcactaagacaggaatactggaagagagcctggttccaggtgctgggaaggggcagacttaatgttttagacatgttggtattgaagtgcctctgatacagccaacaggagatatcagagaggcagttagatatataggtctctagctcagaggggagaaaatcagggctagtgaaaaaatattggaaattgttatgttgaaaccatgcacccaggcgagagtgcctaagcagagactatagaatgagaagaaaagagggtccatgattgagccttaggaacccaacacttagtggccagttagaagaggatgagcctgtgaaggacacagaaaaggagtaaccagagaagtaggaaaggaaattaggagtgtggggagaaggcattacacagaaccagccaggttggtaaggacagaccaagggtaagagacagaaacctgttattttcattcacagatgtttgagtgcttgctgtgtgctggtacagacaagactttctggaagggaaacagagacagaagtcaaggtatagcatgagagacttggaaaagtcctagcagtagaaatggggtccaagaagtccttggttagtaagccttagcaattcagccttccactgggttcctctgttgcctccttgccatcatcgtttacatacatgtgaatatttagtgagtctgcagcaagcaggctactcagttcacactggaacatttgcattgatggggaagcgcagggtagcccaatcaaattccagacatgtatatttgaaattcttctttattttggattgaaaatcagctttctctcactttacccactgattctagtgctgctcccttgagcaacagataaacacagataaaatctttcatatgacagtttttcaaacatgtgaagccaggtatcatgtttaccctttgttgtttccatcataatatgcataccttgaattccaggtttttttcaggccatttagtctgttaaactagttcatgctaaacaaaacagaaacaaacaaaaaaaaccctactaagtaatgagttaatccaaaggaattaatctctctgtggggagatcactaggcagataggtggaatttccttacctgaagacatcctctctcataccttggcctacggaaattctacctacctttgaagctcaagcactatttttccatgatacattgggtggtgcccttaagccatgtaaccaagcctcaactaaaggacttgtcggcggggtgcagtggctcatgcctataatcttaacactttgggaggccaaggcgggcaaatcacctgaggatgggagttcaagaccagcctgtccaacatggtgaaaccctgtctgtactaaaaatacaaaaattagccaggtatgatggcaggtgcctgtaattcgagctactcggctgctgaggcaggagaattgcttgaacctgggaagcagaggttgcattgagccaagatcgtgtcactgcactctagcctggacagactcttggtctgtctcaaaaaaataaaaaataaataaaaattatccaggtgtggtcgtgcgcatctgtaatcccagctacttgggaggctgaggtgggacaatcacttgaacccgggaggcggaggttgcagtgagctgagatcgtgccactgcgctccagcttaggcaacagagtgagactctgtctcaaaaaaaaaaaaaaaggacttgtccctgctacattctgactcctgtatggtctaagttcatcttgttaagtgcctttgcctcagttctcactctgtctttctccttatcttgccactttgtcccatagtgaggcaagccatactccaacgcctgagtggaggcaatcaggtttttctggagtttggtagtgaaatggtggacctgccagttgcagtggtgcgtacctgtaatcccagcactttgggaggccaaggtgggtggattgcttgagcccaggagttcgaaaccagcccaggcaacatggcaaaaccccatctctctgtcacccaggctggagtgcagtggtgccatcatggctcactgcagcctcaaccaccgatcctcgcctcagcctcccaaatagctgggaccacaggtgcttgccaccatacctggctaatttgttttttgtagagatgagttctcactatgttgcccagcctggtcttgaattcctggtctcaagcaatccttctacacctcagcttcccaaagtgctgagattataggtatgagccaccatgcccagcccaggatgttcttaggctagagatatgaggaagtgtatgaagggagggataaagacagctgaaaaggaggggttaaaggtgatgaagaggagaccatgggggagctgactcctgctggagatgaatcgagtccaggtagagggtttataatacttttgcaaggaagagaggagccctctctgcctctgagagacatggagggaaaattcaggcagaggacaagaaagaatgttgaaaggatgagggtagattatagcgacaactgggcagtaaacagagagcagtgctcaggaccagcttccagtcctagtaccgatttgaaagggtagaagccaggactgtagaggtagtgaccatacacttggaaacaaaatggttagcttctttcatcttcaaaggttttttttccctccttgctataagttctatgatgctacatgagatcagaaactttgatggtggtagcagctccaaaataaaatgggaattttgaaagttgaaacatagaagatgttcttagggtcttatggaaattctacccactactgtgttctacagagtgtggtccactgtgagcatattggtaaatattagttaagattttctattgagaaagaaaaaaagtttgatttctctccccatctcatctgtccctgaagagagaaaagagtttaggaaatagttagtggccaaaaaagctatctctttatacttgcagtgacctgcacattaacactgacccaaagccctagaactccctgcggagacaacttcctgactgcatcagcttcctgattagggttctgctatgagaagggctagaatctgagagcctgtcgttcagctttaagtcagagtacaaagcaaaagaacctaccatatccgagggtgagagtgtatctttgactctgcttctttgggttaaggaggctggtagagagctagcacgcactgggtggaatgaggatagctggcagcttaaaccccgcttttctccttctgtgtaaaataccttcatgggaaactgtgggcctctctctgaacagtggaactgctactgtgctcctttgcttcagctggtggcacaggtggcgcagtgaggctagagcaagttcaggctggaataccagggaaaggtgtcccaagaaagcctgtgacccctgcctatgcagccttctgagacctacggaatgagctgttttgcatagctctgtgctttgggctgtctggctcattgctatcactgctggtaaatacgtagttttatggtccagtatcctatcctgtttagctccctgtctcacttgctctcaactgttgtgtatctcattggctcccaatttctgaaatgaagattaaaaacaaaactgaaaatgccctggagcagttctgccaactcctggtttttccattcggttcctctgatagccactggtttggggagacttccttttcctgctccagcctgtgggcctgtgcacaatagccgctggcacatagcccatcagataacaaggctggctctctgcaggcacagtgtggattggaaaaagtgaaagtttctggctggaaataaaagctcagaaaacctttgctatttttccccccagaccctcctgggtctgtagtgctggcctcctgtgagctagtcccatcccacctgtaaaaccaggggagagttcagtgcagctgatgaaggaggggacaggtgtcagggggaccatggatattttatcccagggaagtctcaccccagacactccatgtaacagattgagggcatttcatcctgcctaggcatagtttggaccagtgtctgaggtttcataaataagagtttttctttctctccaatcagtcccttacaagagacatttttatttgttctaggtaaaatgtataatacagctccagagtgtgttggtcagagttcagttgtgcagaggagaacccactgtagctagtttcaggaagaagaggttccataaaccagaggtgcacattgtggattatggaatcaatgagggaagaaagagaagcagcctctaggttaagacacaccacagagcgtcctccctcttctgtaatcaggaagccaccggtccagaagtccagtgcccctcaggtctggtccacacctgtcaacatcggcaaagctggagaccaggtgtggggcctctgctaacactgtggcagaaaaaccaaaggcttctgtgactgctcaggaacagcaggaagcctgttaatctcatagaagtgcatgtgattagctgaatctaaagaaagtcttagaaatacagcttttagccagttagcttctcaagtacaggaaggcacagtagaagggtggaatccatcttacgcctaccccatatatctgccacatagagtgaagggtacaaatgggattctacggagttcctactgtgagatggggttatgcggatatgtacctgtgccagcacatttataacttccgaaagaaattatgaggtagatagttctccccatttttgcagttgaggaaattgaggtgagagcttagatcatttagctaatgagtggcaaagcctgatctgaacccacgtatatctaatttcaaagcttagtcttttctccgtgcacctcacttacctccttagagttgcttctgctgctgacaaatgttgctgacatgtggattgaattgccatagaacttgtggactaccaagatgtcatccaaagctaaaagtaggaagcaggcagtaggctaatttttataagcaaagggttaaatagtgctctctctgtgttttgtgacatgataagacttaggaaaaccatcctttttttacagttgcactggaattttgtgttacagtagcaagggaaacagccaggtacatgggtctgtgaggtctgggtcactggaaagtggagtagttcccttggtccagatttcccctaaacctccatcttgtctttgcctacaaaccctctgttggccaagcggcattttgtattcctggcctctgactcccaaatgaccatggagaaaacaactctgaatttgagctgcatgaaacatgccactgtggatgtggctcacacctgtaatccctgcactttgggaggctgaagcaggaggatcccttgagcccaaggagtttggggctacagtgagctatgaacacgccactgcactccaaagaaagaaagatacatggcactgtgcttcccctgtgctgccaggaagtccccacgttagcctccctcccacacctggcaggctgtcatatttccttgtggatgggatctccatcctccatagggattactcatgggggacagatggcctggccagttcaaggagaagttatgtcttgtgccactgtgttgagcagcatgcctgccctttttggaaataaattatggtccccaaattgccttggctgaactgtatgagagtcacaaagcctgttttctcgcttcggccccaccataaagtcactttatggctttggggcttgggtttccctctgcgcaatgtggatgatgataatgcaccaccactgcaggggtgtagtaagggttaaatgagaggtgacaatatttttttaagaaaaaaaaattgccttgactgattttattgctctgttagttcatggtacaatatccctaaatttacactcagagtaactttagtttctgttaggacttagaaaataggacaaattctcttccatgggctgtttgagaccattgcaaaggcatggctcagataccactttatctcagaattggtggcctctaccctgtgagtgagatgttgagacaggaaatccagcaaaattctatgcctgttttcagagcaattttgtttctggcctttgctctggagtcaggtggggaggccagattactgaggaccccatgttagctttcctgccagagagacatccttggagggaggctggggtgatgtgtccaagaagagattggaagtattctccaataccagttcagtggtgaattctcaaaatgtattcagcacaaccacatgaaccatatgttctgaacaactgacttaatatagaagaattaaagagtcagtttcaactgggtgcagtggctgacgcctgtaatcccagcactttgggaggctgagacaggcagatcacctgaagacaagagttcaagaccagcctggccaacatggtgaaaccctgtctctactaaaaatataagaattagctgggtatggtgacggccacctgtaatcccagctattcaggaggctgaggcagaaaattgcttgaacccaggaggcggaggttgccttgagccaagattgtaccactgcactccagcctgggcaacagagcaagactccgtctcaaaaaaaagagtcagtgtcagtttcttaaaggtcattgaaaaacaatagtttaagcttcttagaaaatgtctttcaaaaagcaaccctctggccaggcatgggggcccatgcctttaatcccagcactttgggaggccaaggcttgagaccagcctaggcaacatagcgagaccctgttcctaaaagtgcacacacacacacagagcaagcctccccgccattctttttttccattaagtatttttcttccttctgagggtctttgaaatagtgggagtctctctggctcagggagtttgttgagctccatcagtctgtcaggcccaccctcttttccgggatgttctaagaccctggactgggctcttgagcaccctctgctgtagatgcttagtccctggtgcactacctctacttccaggtacaggctgagtgctcctggctccacatgagctttgttgttttgtctatgagacagggtcgcactctatcacctatgctggagtgcagtggtccaaacacggctcactgcggcctcaacctcccaggctcaagcagtcctcctgtctcagtcttccaagtagctgggtccacaagtgtgcgcctggctaatttttaaaatattttttgtagagatggggtctcaccatgttgcccatgctggtctcaaactcctggcctcaagcatttctcctgcctctcgaagtgtcgggataataggtgtgagccactgcacctggccacacatgagtttttgagcaataggaaatatatatacatatatgtataaacatgtatacacacacacatacataaaactaaaactgtgtatctcagattttccatctaaaactggtctggactagggatctatcatcaagaaaggagagaagccaggcatggtggcacctgcctgtagctgaagggggaggattgcctgagcccaggagctcaagactagcctgggcaacagagtgagaccctgtctctgaaacaaaacaaaacaacaaaacagaatagaatgagtcaggtacttccctaggtctccagctaccaaacttggtctctcttgcttccttagccatttccacagagcatcttgcctgcagttccatttcagaaaacctagtgctacagcccctgaactagactggagaaaccagccagcaaggaaagtaacctgcattgttgagggatggtactactctattcctggtgtctgggaattgctgggtcgtgggagagaggtaaggggtggtagataagggaatggagggctcttgtgtctctggttttctaaacaacaggataaatttgttcccttcagaacaggaaaagggttcaggataagagtcttacgtttaagttttgaagctacaagaaatatttgtgtgggtatagttaaagctttttttaaaccttctgaaaattggctcttctggtttggtgagcttaggaaggaaaaaagatgcaaacttttggcctcatttttgtcttctctgatcatggaaagcaacacagccagtcagaaaaagctcttgggctaggaggaaggaggacctgatttctcggactcaaaatcccttatggcagaaaaacattgctcagtgacttacaaagtgtgtcatttgtaagactgcacacctctgtcattcactaacattaggatgataaaccatttcatcttacaagctgatgtggtgaaagtacctgttaattggttttatagtctcttatctgtaaaacataaataattgtttttgggtgttttgggttttttttttttttaagatttaagttccttgagtctccgtctcctcctctgttaagtaaagcaaatgcttacctctcaggattgttgaaaggattaagtgaagtaacaaatgtaaaaataccttgtggaatgattgccacttagcagccactcaaaaaatatttgccaaacctctgttgtagagatgttgaaaatcaaatgaggttaattactgtgaatgtgtaacaaaaagtaaagcaccacataaatgcaagataatatcattactcagaccaacctgagcaacatagtgagaccctgtctcaatttaaaaaaaaaaaaaaaaaaggtaatatcattactcataagccaggaagtgtgggagtgggtaggaatggagaagcctgccttttgatcctggccagaccatcacgaaggcctttttacctgatacaagtagagaacaaataaggggagacactggctgggggaacagggcaacagagagagatgcacaggtatattcagttacctttccctggtccccaccctcaaaatactgcttggacccaaaactaaagaggactaagctgatgtattgagctgatgggaggaaatggcattagtgctctagaggaagagagaaggtgacattatgaaggagtaattatatataagaatttttttaaaagctagtctgattgccagctaaaatggtctcctaggggttattctggtttctgttttgtgtcaaggtttttttggtcggatatgccgtagtgcctgctccatctctggagtttgtttcctattaggaagggactttgtttgcctgagggagctggcacatgctggacgttggtgccatgacccatctgagtcacattcctgacctctagggcctaatagttggccccatgcctgctcctcttgggccacacaccctgggctctgttgttgaaagcctcctttatgtgctctaggctcccagaaccctggccgaagctcacctccccctggctatgttcctgagcggcagcagcacattgcccggcaggggtcctacaccagcatcaacagtgagggggagttcatcccagagaccagcgagcagtgcgtgagtataggggggctgggatatgcctgtggcctgtatcagcagaccaagctcataacaaggggttcttagtagtcacagtgcagaactgagggacatgaaccccatttgaaagctcttttataaaccaggcctgcccaaatatggattgtccctttttaagggccaaataacaatttctgccaaagatgggatctaaaggatctaaactacatagtttccttgttgttgggtgaggatttaacagatttttcttcatcgtggtcctctcattgttcctacaggcaggcaccaccacgcccagctcatttcagtagtgttttaacatacgactggttctaaagtgacaggttatgtttttcattggatatattttagttttgctgtttcttgatgaaaggtaaggagtaaaccatatcaaaattacactgtaggattggttaggctgatcatttatgatggtagacagttgtattagttatctattgctccataacaaattaccacaaacctagaggcttaaaacaatatacatttatcattttccagtttccctgggtgaggagtccaggcatgactcaaatgggtcctctgctgagggtcacacaagactgcgatcaaggtgtcagccaggctgcctgcctttcttgagtttgaggctcttttctaagctcagatggttgttgccagaattcagtttttttgtggctgtaggactgtggttcctcttttcttctgaatgtcacccaagggcttctctgagttcccttcctagaggccacctgcagttccttgccatggggccctctcacaacatggcagcttcttcaaagccagcaggagaatcttttgctccaatctgcaaagatggagtcataaaacatcacataatcataggaatgaatattctatcctctttgccatagtctattggctagactcacgtcacaggttctacttgcactaaagggaaaggcagttcattgggactaattggaagagggagcaatcaccttagggtgtgtctaccacagtggctcagccattttagtggctagcttttaaattggtggcttacttgatgcaaatggcaatttggcttagtgaactcaccaagcatgagatctctagcttcattctggtcttttcaataaacttgctttgatgtaaaagaaaaggctgctcttacactttctgggcttggcctgagaaggggaaatttcttaaggggaaaatgtccaacagaagggcctgtgctgtcacatgggagatcttataaaaagctgattcttgtaacttttctttcattattcaaactatgtaggctatgagaagccctttgtactcttcttccttctatactcctgccttccagataaattcatgtttggagtagtgacctggagtgccattagctgcagatttcctttttgggcattttactgaccatcctttctggtttctctaaccagggcacttctggacatcagctgttctaggggtgacttgggtgtaaaatcccagagattgcagatgagcttgattgccctcagtctatgtccctcgccatggtcctatactctgcccccttcacttttttactttgcctgcatggccctggaaggcctgggaggatttgactcccagtgaggacagacttttagaaagaggccaaggaaggcagtggttggggattgccaaggtcctcccccagcgcctgcctctttagctgaagagaattgctcctggtaacaggccatttgagatcaatctgcttaacaggaacgaacactgcatagtatgtaataaaagaatattccagtgtgactttactgaaaagtgaaaatatgataagttttgttttttctttaatcaggtttaagcaataattgcatctatttactaatttttagaatgagcaaagcatgattcatgttaattttttggcctaatttttccaacaaaaattatgtcagtccggtcgcagtggctcatagctgtaatcccagcactttgggaggccaaggcaggaggattgcttgaggtcaggagttcaagaccagcctgggcaacatagcaaaaccctgtctctacaaaaaaaaaaaatttaattagctgggcatagtggcacacctgcctgtagtcccagctactcgggaggctgaggtgggaggatcacttgagcccaggctgcagtgaattgcactccagcttaggtgacagaatgagaccctgtctcgaacaacagcaccaacaacaaaatgctagcacaatgtaacgtccttcactccctgcttgacttctaaccataaagaacgtcattttttacaagagcgttcacaggactcagcagttttccccaaggcctcttgtgaatctttggtattcttcctccaccacacctgccatgttatttatttgtccattttgtctttttctgttaactagtctaaatttgccaaatatgcatctgatggatttaaagcaattctctccgatgttggtttcatccactttggctatcctatatccttagcaacatttgcagttttactttgcaattaatttgccttgattggcagattttaaaaaatcatgtgtgacaacatgacttaaagcatttgaaattatgggtggggatggaccctggtattaaatgggaaaaaatatttgagttggaaactaattttatggaggtcgttagtgaattttcataattctgatactttgtttccctatgtaattttttaaaattaattaaaaaaatatttaaacagaaacaagatctcactatgttgcccaggctggtcttgaactcctgagtgcaagtgatccttccctctcggctcccaaagtgctaggattacaggcatgagccaccaagtctggcccctatgtaatgtttaatgttggagctcggataatgaatattctgaaattgaagaccccaccccaacttttgtgcagagaaaatgaaagggaggaccttcaggacattgattggagaaaaagggattccaaaggccttttgttgctgcatttgaccaggggccagagaaatattttattatatttagatatctattacctctgcattggaccaggaactgggacatttttgttctggtatcagctgtgcactaactagttttatgactttagacaagtctcctaacctttctaggcctgtagtgctcatctgtgaaatgaggcaatccttgtctttgtaaattataaattatggagtgtaaacagaagcattaaggtcccacccgaactcactggaaggctcagcagggtagtaccatctccagcgccaggctccagtgttaatgagccaagaacatgccaacaagaaaagcagagcctctgctttgctctcctgccagagctccttgggatgccagccaagcatttttctccctcctggaaacttgcctttcaaactaagggggaggatggtacctttctaactattcttcccattgcatggggagaaaaaggacactttcatgttttgacaaaaaggcccatttgctggcccttgccataaagcctgggtcactggggggaattggggctgggggtgtggcttcattgtttgacttgccttacagatgctggatcccctgagcagtgcagaaaattccttgtctggaagctgccaatccttggacaggtcagcagacaggtatgggactgtgggtggtttggagggtaatgcataggcatttttggaattgatgggttgaggaagaagagttagctctggaggcccagggttaaaacatcatgcttctaggaaaagccttctccttaatttccccaacaccacgagaatgttatgatggcataattaaatgaatgtaataatagctcataaaatagcagctcatttattaagtacttgctttgttgttctaagtgctttacatgttttgactttccatataatatatgccgctctcgtacttttggcctcactgctgtgatctgaactgagaaggagtggactgtcagtgttttagggggagaactgaattctcatccattgctttaccatcattttttattccaagtgtttttggtggagtaagaaactgaaacccaaaaacagaatatccagaatgcctagtgtaccatgccacctgcttggtgtatatcttcttcttacactttgggaggaaacaagtggtgtcctttacataccaaatcgcaagggtatgtttggagaggccttggcattgatcttgccactccctcgcctctgcctcattatgcccaagaacacttttgatcacgtctgtctgggcttaggactgtggtcagaggctatggaaaaggtttggggatttttttactttgtgtaactgattaattgttcatttgggtagtgatattatgactatggctaaatttgcattgtcttgcctaatagacctgagcactgatgagcactgtcttccctttagatatcatagaatacagtcatggttacttggtttccaatgtgtagccttgtttggggcttgctttccaaccaggggagtaagaaggcacaggcaagagtgccagggcttgctgtcatagactgagggctctgccaagacagggattgactctggctttggattatctcctaagctttggaggggaaaggggagagaagaggactacagaaggtctagtagttgggaaatgagggggcagcccccttgtgccactgccttgagagtttcaaacctgtggcccccgcaaaaggccaataagcactcttgtgtaagggaaagggccattcaggtgggtgctgggaaagatagctaaatttacccgcctctctattcttgggttttttcctctgtgcctgcagtactttgttttcttctcattgtgaatgacctggacttatttccttgaggtccagcctgacttgggctcagggctttcatcttcccttcacgggatctgggaaagggcatgagatctggagccagacaaacctagatccagtcccagctccaccaaatattagttgaatggcttcagacaagtcttttaacctctctattcctgaatttccccatctccaaaatgggatggtgatgattaaggtgaaagaaagatgcctggtttagcagcaagaacatagactttgggttcatagacctggatttaaagtctggccttgaggcaccgtggctcacgcctgtaatcccagcactttgggaagctgaggcacgcggatcacctgaggtcaggagtttgagaccagcctgaccagcatagcgaaaccccgtctctactaaaaatgaaaaaaaaaaaaaagccaggcgcggtggctcctgcctgtaatcccagccctttgggaggctgaggtgggtggatcatgaggtcaggagttcgagaccagcctggccaacatagtgaaaccctgtctctactaaaaaatacaaaaaaaaaaaaaatagctgggcgtggtggcaggcgccgtaatcccagctccttgggaggctgaggcaggagaattgcttgaacccaggaggcggaggttgtagtgaacccagatcgccccattgcactccagtctgggcaacagtgtgagattccgtctcaaaaagaaaaaaaaaaaaagcaaaaaaaattagctgggcatggtggcacatgcctgtagtcccagctacttgggaggctgaggcaggagaatagcttgaacccaggaggtggaggttgcagtgagccaagatcatgccactgcactccagcctgggcgacagagcgagactccatcttaaaaaaaaaaaagtctggggctgggcgcggtggctcatgcctgtagtcccagcattttgggaggccgaggcgggtggatcacaaggtcaagagatcgagaccatcttggccagtggcgcgtgcctgtagtcccagctactcgggaggctgaggcaggagaatcgcttgaacccgcgaggtagaggttgcggtgagctgagatgctacagcactccagcccggcagcagagcgagactccatctcaaaaaaaaaaaaagtctggccctgtcttcctagctttatctttgagcatatacataggactgtgtgtgcctaatctgtaggggtgtctgtgaagacagaaacagcctagctgctcatcaagtggatctgctattatgctatttttattatatggtgtatttgctacctcacagcgttctgaggattaaatgagaaaaacctcactttagaaaataggtaagaaagcagcagcctatcaacgatgatgctgtggctgtttttattactgccctgggcaaaggattctcttggagctctttgcctgttacagaggtgggaagaaaggccaaggagggagagggctgtgcagccaggctggagttgggtcagatgggggagatttaccactcagggtgctgtcaaatttgggtcacagactagtgaagggagggtggagaaagcaggagctgggctcagaaaagggctatttcccgcaaaatctgcttcccccacctaatgctgtggcaggggttagaaagggagactgcctggacgccctgcttggttgctgtggaagtgtgcgggagtctgttttttctttttgttttctccagcccatccttccggaaatcacgaatgtcccgtgcccagagcttccctgacaacagacaggaatactcaggtgagttccacagagcctgggtgggtaatgcagggtgtctgggtggggcctcaggtggctctgcttcgacttttctgagtcagtagctctccttgggcttgctgctttgaggtctcaggtgccttggggacttgggggcttaagtggctcacattgacctacccagaagccagtgattcccctgtcttactcagatcgggaaactcagctttatgacaaaggggtcaaaggtggaacctacccccggcgctaccacgtgtctgtgcaccacaaggactacagtgatggtgagttcttcttcacctgctccctgctggctgcctcaagaaaggacaagttgccatggggagggtgggttcgtccatgcagtgcctgtattttccttcattcctgaggatttgtggcccagacttgaggcatgggagacaggaaaaaaacaaaaacaaaaacagggaagatagtatttgtagaccagatgctgccactgggaactctgaccttgtttgaagccagtggtgtgctccaggggcaccatctctcccatgtcctcttctgccccacagcagcaggtggcctgggccctgtagaggggtaaggagtaggatacaaggaaatcagtgccttcgggtgtggcttggccttgcaagcaattgggagcctgttggccagccatacaccttccctttggccagatctccctgaaccagactacttcctaatttctgcttttgtcctgattcttggagtgcttgggacagcagcctctgtggaatgagtcaggtgggagtgcggacgggatgggctggagctggtattatctatcacttctggctgagacctggtttgtatattccgccttgtagcccggggtgtctcagacctggtttgtacgttccgcctcgtagcctggggtgtgacttgctctcctctggcccttgcaccctttcaggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtgtgaggagctgtccctggctaggaggagactgcccaggtggtctcagacaagctacgggggcaaacagctgggcccctgggacccttaggctcagcaggtggtggctttggcccaaatgcaccacatgggataagccttggagtgtctgaagcctggctccactattgtgtgacaagcctcttctcctctctgatctttagtttttccatgtttaaactagggaagagcacacccttcatccctgccatattaagatatttaggggctttggaaggaaatgcatttgatcaatgcagaagagcatttaaccatgacttcagccaatcctctgcttcttaggactctgacttcaggtccgagtgactagggcactgggcttgctccagattgtggtggagatgctctactaagagatgatgggtgctgggtgagggggagcctgagccagagaccctgttcctggagaatgaatgggatattcataaataatgtacacaaagtaactctttccttctgctctcctgtagctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggtacacttaacccgtggtctgacttcagttccctcctttcaacaaaaatgcctgtcttaccacacagagtagttgcctgagatgctgtaggttgcttcctctgtcattcttcccaaactccctttctgtccatcctggtcccagccacagggtgaaaggactgtggtctgaagagcaccaagcacctggaggggagggattgggtgtaaggaactaagctgatgccaaagtaccaagtaacccaaactgagaggtgatgacctgtgacacagaggggactccctcccctagacaagtatctctccccagctctcagcccaggaaggagctgtggggctccttcacttggtccagctctagaggaggaatcatatggcctgtctttgcagttcagctttcaacgtcgcttatacttcaagttctgtggacaaacagcagttaccttaactaagcacccacggccccttctcccacctccctgcctccttccacccatgggagtgccaccatcccaaggcctgcccagcattgtggccaagagctagacagttaagagagtcccccttttctccaactgcagttcccaaggcagatccctgtgaggccactaactagggcaagctgagctgaacccaggcgggcagaactagggccctgagagctgaggcgaccactgacccctcccctaggaggtgagtgctctggagtgcgagatccagttgctaaagaacttgcagcatgagcgcatcgtgcagtactatggctgtctgcgggaccgcgctgagaagaccctgaccatcttcatggagtacatgccaggggtacgtgccccttgaatgcatgtgagacacacacaaaagagggcctgacctgggggctggggcctgcaggaggggggtcaccttggataggagtttgaacacctgaggctccagaggcccagaggagcaaagtgaggtgatggtgggacttggagtcaggagggccctgcctcaggttgcagtgggagtatgagatgacagctgtcctaggtccagcactcccctgaggcatgcagggctggcccactgtccagtaaatgcagccttcatctggagcagagaggcctccctgctcctggatttgggtggcgctctgcttgagaaggacttggggtactctcttttccaaactgcctgacagctcctggcaaaatgccctgcccagccagataggaattgaacaaatcactcctttgctgccatgctgggggctggaatgggcttgcccctccaccagccctcccctgaggggactcctctgacttcttgtggcctccagggctcggtgaaagaccagttgaaggcttacggtgctctgacagagagcgtgacccgaaagtacacgcggcagatcctggagggcatgtcctacctgcacagcaacatgattgttcaccgggacattaagggtgagcagggccaggatacatggagtccccaggacctgggttcaagtctaccattgagtgcctgcaggggccaatcacttaaccattctgaactttctgaaaagtgggaccccagttgtttccctgaggaactggtgagattggttgagcaatatgagagaatattgccaagttccctctacatgtgggccttggagatggtcattttgtgcggtagatctgagactcccctttgctaaatcctttgccctttgcagttcatgtctaattcagtggtagccctgccctctccagcagctctcagtgacccgggggtggggaggatgggagaaaatgcaagagggtccagggttgcagcctctgccctttcatgcctcaggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggtgagcactgggacatgcagaacccattcttccacccaggccatagtggccccccattagaaacacaccctggggactttgtggtgtggcaggagggagtgtgcccagggcccaggctgcagtgtgtgcaagggtattattgggtgcagtagcacacacaccacatgggtggtgctcaaagcacactccattagagctgggaacttaggccatggaaaacatccctcatgtttgctaaatctcttaaggaagcaggatccactctgaaggcctgaaggcctggaccagtctctcaacaggagcaggcttctgtcccttctcctagcactcaagacagtttgcacttgctcgacataaccttgtgtctatcctctgaaatggcccctaagtcaggagagcttctccccttggaaagctattgtggtgggctgaataatggcccccccaaagatgtccactgcctaatccctggatctgtaaatgtgattgtatatagcaaagggcctttgcagataggattaggttaagggttttgagatggatggattatcctggattaagggtccttacagaagggtctcaagaggtcagagtggctaataggaggtgagacaatgaaagcaagaggttggagtaatacaaggaggggaccatgagccacgaaatgcaggtggcctctagaacccaggaaaggcaaggaaacaggttctcccctcagagcctctgacaggaaccagccctgccgccaccttgactttagccctgtgagactgattttagacctctgaccttcagaactgtaagatgatacatttgtgttgttttcctgcctctaagtttgtggtcatttgttaagagcagctatgggtagctaatacagttattgtagagttctttctgtcaagtctaagtgattctctttttccttatttcaagaagtacccaggtgtgtggtgagtgtaggtccatgaagcccacgtggacagacatccaagctgaggtatccctcagcttggcctgtcctgcacctcagcttgctgtgagaaaggcgcctctttctgcagtggtgggcaggacagctgggagtccagggctggctgaggggtgacacggggttctctctttccaggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactgagctctcacggccacacagctgccggtcgccctttgctgcatggcagggggctgctgctgggctcagtgaagttgctgcttctcccaggcaaggctgtggaccatggagtggcagcccagccagcgtcggtctgtgccccttccgccactggggctcagagccggggtggggtggctgcagcctcaggactgggagcccccagcctgtcagatccaggagctccagtgtcctgagctcagcgtggaggggtaggggctgggaacagtgtgcaaggcagccgtgggccccaccctcggggatgtgtcctgacactgcaattggcaccgaagcccagagggtctgggggcacaagactgacgccagggtatgaagagtgttattttcattcaaagtgttattttgtttttccttccaatgtctggagaccaccagggcatctctgggctggatgagctcccacaagcctgagggaaaggccagcactcgctagcagtggcaggcagaggcccaggctgccgtcccctagagtcccaggttggctctgccagtcctgtcctttaccaaagatgaatgaagcaaatgtcatgctgccttattcagggaaggaggagcctgtcctgcctgtggccatgaccctgcctctcccaggcaggggcccgcgatgtggaactgctgccactgaggggggatccagttttgtcaatgcagttgtctctgttttacaagttggagtcactcttatgctgtacccagtttctaaactggagactgtgtgtgccctctgggctctgagtacccctgctttgggcttgggcctaggctgcattgaaaagagctgaaggttgtggcctttgcgctcctggcccagcctttgttccccactggagcagaaggggagatggacgacacggtcggggcatctggcctggccagtgccctgatcccagagagcccgaggaggtgtctcaggctgcctgagtcgtgacctgctaggccagagcccactccatctggtagaagggaaagcccatatgctaccaccagctgtgtccaaaaccgccagctctgttcttcctcagccagcctcgcccatccccttgaggtctcagcccctttcccttgtagctcctcccctggagggggaatggcagcaggggttggggaaacagcatctccaagcagcttagagttggccatatttacctcagcctgggcgctggtcctttcttccggcccctcccctccaaaatgtgcctattgctagagctcctccctctcaacacccagtttccttgggagttgtcattaaaggaaaaaaaaaaaaaaaaaagccagtgcccagggatgggcatctccagggagctggggattagtgccaggcagccctgccagccatgcctacatccccatgggcacagaacaagccaaagccttcgttgtatgttgacgatgcacttttatgaatgtagtttctatcgctgtttttagccttttcacatcatgtaatgtgaggccttgtacttgttaatttatatctcagatcatatttgatggtttttatatatatcaattctagactgttacaggtgacggacgcctcaagagagagaagagaaaatgaaagcagctggttttgcagaagtgtgtgtcgcatgcgccagttgggcctggaccctcctgtgtccatccctgttcccccaggggctctatcagcccctgtaccccacactgccctctgaagacaacacaggctcctgcttccacctcggcccttgcccagggtggggcctggccctcatcttgaccaaagctgctgtgtggcagctcggcctctctacgaccccatcttggtggctgcacactcttcctggcccgcacccccatccccagtccctgttccccaagaggatacagagcacggtgctggctgactcaactgtgcgtcccaggttcagggtcttacagagctccaccccctggggtcttacctcactgggaatgtgttttgaaaatgaatttgaagacaagccaacaaaccctgcactccaaaaaagcaaaacagaccctaatttttttgtgccaaaaactgtggacatgctggctcagcatcctcaggaccaagttgttgcttaatttattgttttttaataactaatccagataaaaagttgtggggcttcagggtgacctgggcccaaaggttctgaagggcagttcctggcagccccaggcttgctgtgggaaggggccgtgccgtcactttctcatcattccatggggtgtgtctgcctgggccaactctgcatggagaggccagggctggggacagtccgcactctgccaccctcctgccccttccacccaccccagctctatgtctgtgtctgaattgtggatcgtgcagccatggttattgtggaactgtggaacctgcagccatagttatttgactatatcttgaccgagggcttgcagtgcaaagccaggccagtgttgcgcattacttacaataaaagggatcatttatatcagaggggtcctgtggcagtgctttcagttgtggggggtggaggtaggtttttgcttagcaggggccaggtatggtgcctggcaacgagcctgggcctttcaagcagaagagaacttgactccaagtagaggggtcctggggtgatctggctgataccattgtcagtccagaggtgtctgcccctttcctccagttgcccctccaggagctccactggggtggtcccaacagggctgatttaccagggtggcactgctggccctcacaacctgaacgtcaccagtggctgagttcccggagctttcatgatatttggtagggtcttcctggcccagaggacttccttcagtcccatctttgcagggcaggggtcaggtgtctccaagagccacctctccagtacccccttgtggtcatctgctactgttgcttaaccgaaccaagatgatccttgccatctgagacctctggtgcaggaagttggcctgccctgagaggctctgaggcgctcacttcacacttgggaggatccaggccggggcaccatctctgctgagtattcgctctgctccctcgaggagcagtgcctgcctcagcatagtgacttatgtgacactggagcctgtggcccagctccctgccctgttccacggggaggccacttaggaactcaggcagttgtatggtgtggtggcagcaaaccctccaggagtctctgttctcatcgatcccatgtctggagacatcaggaagttgaatctggagcaggacaacccagacttctgcctgtgtcccaccggggcgccctcaggtcctcccaacttgcctggtttgctctgctgtgaactcatccctcattgtccctgggttttcagagaagcagaggtagtttctctttggatttcctgagacagtagctgtgactgcacctccgcagagcttgaaaaggcaaggggatgatgacagcagcgaggggtaatgatgaggggggacaatccaggggtcactaaaaccttgggcagcacttgctgggtctgctggttaccgccattcttcgctaacttacttccaggtcaaagggctgggaagaagggagggagctagacagctggaaccagccagggaacgcggcagcttgcaccccaggcactgaagtgcagcgaggacaggcgccatcacccactggcagcctggccctcccgctctcaggcctcttcacaatggggtgcatatggtaagttggtgggtctgaaccaacccagaactgaggggtgaggtggagtttcagttccaaaaccactgtgggtgtgacagcatgaagccctcgctgtgaagaggagccctcccatttctcaatggtgtgtcagggaactgacacccacttctagctccctgcccccatcagggccgaggtagtcggggctggccctgtccccccatgcccgccccatggtgagtctgcacccttcctgtgacagatcccccagcaggccacacaatagagaatctggatctattgaaacatgtttaaaacggggttggtcacaacaggatgggcacaaatgggagcgggggaggggagtggggccgcaccagcccctgccagtgcctgaggctgcagcctggcgagtgcttttgcttctgcttctccacgctggtggttcgagatggtcccaagccccactggggcaggccctgccttgccctgcagaggcagggtggctccacttccccatctcctcccccatgggctgcaggggcatttatgatgcccaacaggtggcactgtcgcgctccttcctccctgtctccgtggctcagaaacaggttaagggtagaggtagatggggagacgtgggggccacacagtctccggtggcagtgagggagcttgggaccctgaggggggcatgctgactccttgctggagaaaaggcacctagataggggagctgggcttgggggcctcccagggggtcctggggtgaggtggggagggaggctgaacgaagcaggaagcagggtggtgggcagaccccaatcctggtttccaaaccctcaccggctgcgggagaaggaagaaggaaggagtcctggagcagagccctgccctggtcccctacgcctgagcaagcctcatccccttcccacctggcccccacgcaagcccagctcgacctccttcccaccttccccctgccggctccaggccttccgcagagggggtggaaggttacagaggcctcaggccgtcttggtgccggggtccacctccttgtgggcccagagctccttgtgctgcttgcggccaaacccctcgtcgtagttgcctttgctcttaaacagctgctggaagtggggtttgcagtagaactccccgtgcagcgcggcgtagctgcccaggctgcagaagccaaacaacggcgtcaggtcaggtcaggtcggggctgggttggcaggcgaggcgggggcgggcagggcaggggcgcacctgagcttggtgtgacagtgcttgcagcagaagcaagagttgtggaaaatgagcttgtcggccaccagccgctccatggggtacacggtcttctggcaggcggcgcaggtctccttcacctgggcccgcaggctgaaggactgtgcgggaagctcagccaggtgctgccccagtgctcatcccgctccctcacacccctcctcccgcacacccggccccaggcccctaccttggagcgctgcaccgtgctgctgccgccgcctttggcgtcctgagggagaggggcggtcagggcaggggcagctccgggaggccctggatcagggctgcagccatcagcccaaggcccaggggcgcgccgcagggcacaaagggggccggcaaactctgatgcctctccccttcaccccaggccaggctcctgtccggggggccctcccacccagccgggcacttacatgagagggggtggcctgggcggctcctgcagcctggaacatggctcgttggaggtggaagcctcgggtggagaagcggcacccgctgggttctgcaaggggaagtcagtcgggagggccccgccagcccggccccagcctgcagggtggggggtgttgacaggcaggggctggggggattgcggttgggactttccctaagtcatttcctgttgctcttggtcttgccacttccgcccctcacccacctcccccacccctgctccccaggggccggggtcccgagtggcaccgtccctcggaagaacaaagttagcgggagcggaggggccgggggctcccgcgcagccgccgtgtgcgtcccgcgggctgggaccgcttggggtgaggggaggtcggggccggcggggccgcgatgagaagccgctgccccgacctgaccccggccctcgctgccctgcgccgcgcccgggcgtccaggcctaggctgcgcagcccctggacagcgcccgaggtccccgcccgccccgcccctcggcccccgacctggccccgcgaggaccggaccccagaccccgacgccgcgagccccgccagcgggtctcggctccgcccagccgggggccggccctgaaacgaggactcgagcctgtgcgccccgggcgagagcggctcgcagactcgccgggaccccacgggcggccctcaccccacacccctcggcgcctctcccggttccggagccggacgcggcccctccccccgcggctctcaccaggcccggcctgggccgcggggcgggatcggtctccgggggcgcacgggtacgaggagggcgcgggcgcgagctgctgccgctaccagtggtccccgagccaccgccgccgccaccgccttatcgctgcaccgcccccgccggcccccgccccgcgcccgcccattggctccgccgcgcccggagccgccttcggggccccggcgccgccgccgacccccctccgcgctttgtcttcccctcgccgccgtccccgcctttgtctgtcccccgccccggctccgcgctcccggctccgcagcgccccgcgggcctcgcgctcgcaggcctcgggtaccggccgcgccgtctgcccatcccgacggcggcccggcgtggggaagcaacggtggcagggacaggatggaagggccgcgctccgcatcctactgggaggggacgagttcaggctgcggcggctgcggtcgcgggacactgggcgctcccggcctggctccgggataaccgggcggggcctgggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccccgcccctttgcggcccacgaggctggcggcggcgtccgggcacgcggtctccaggcccggccgcgaggctgcggggaggagcctgcacgagggcccggcagccccggcagcccccccagccctcggcgcctctgcaaccctgcgacgggctggggaggccggtatgcgtggttcccggagcacccgtcccccgaggctccacgtactcaagcgtttctggggcggaattctgtgggcagcaacgggggccccctctccaacaagcgcacctcatttctcacgtgggagccgcggcccagagagctgaggtgacagagcttgggccgcagagctgctccctccctgcagccgcacagcaggccggaggcacagccggcgagagacggccactcgctttggagcggcggcgaggccggcgccttcccgggcaccagggactgcgtggcttggccggaaatcaggctagaagcagctccgggaagcacagcccttagcccagcgccttcccacactgtggcaggaatagcactggcggcccacgcgcttgtcagggaacagaacagctctcgcccgacgcctggcaggggagcagggaggctgcagcttccccagcgaccagctgtttcccaggctggcggactccacggaccggctccgcgtctcctctccagccttctgttctctctagaggaagatctgcgttttgtctgcactgtgggccgactctctagtggggagcgtcagaccctctaaagtggctgcctctcgggaaagcttccacacctgtcatcagattctccaaaggggctgtttgatgcaagaaacgggaagccccgggggtactaggagcagggcttgctgccattgggcatggtgaggccccggcaccctgcccaggacgggcctgtgggctgagctgcagatgggcattgaggatgccccaacagcaaggtgcagaaggcatccagaagcaaaggaaactgatgaccagcgtcaaaaacaaacaaaaaaagggaacttggctcggcggtggctcacgcctgtagtcccagcactttgggaggcagagacaggtggatcacgaggtcagaagtccaagaccagcctggccaacatggtgaaatcccgtctctactaaaaatacaaaaattatccaggcgtggtggtgtgtgcctgtaatcctagctactcgggaggctgaggcagaagaatcgcttgaacccgggaggtggagcctacagtgagtcaacatgaagccagtgcacgccagcctgggcgacagactctgtgtttgtgtgtgtgtgggggggggagggcggggcgaggcgaagggaacttgaggtttaaagcagggggaggagggccggaaatgctccccgccgcccccgacactcactcgccccaggccccatcctagcccagggtcagtgtcattcccttcaccttagcctctcactgcccaaagaggcttacttttcttctttaaactgctgttaaaatttgggaggaaacggaaagcaagggcacctgatggttcagtgcagcttcaggttagaggggcatttgaggtgcctgagctgggggagggccttccccctgagggactgggagaagggtaagccatgtgccctggaagcactgcagggagcctcagatttgcaccccctggctcacactcgctggcgccagccagcatggcagggatgggcggggctggttcttaggtttcctgctctttgggtgctagcacccagggtaaggagacacccatgtccggttgcaagacaaacccttctacctcctttcctgccaaaggccaccagcatcctctgcctcaatctcaatctttggaactttttagctccaaagtggtttgatgaccacaggctaaaattcatagtcttaaaattttagatagttaagagacagatctgttacaggttttcaaataaactggtctatctagtgtaagaggtcactgctgagcttcagtgagcacccatgggcctgctcttggatggtgggacagctctcacctggggcagcacggccatccctgcaagcacacacaccaggaagcagcctgtagcccctgagctgacgcagacacaatgccattctccagcagcgtctctgaaaattttaatttgttctgacaacgaaactaacacagcataaggacttaagccctcaagctaggcaagacactgatggcccttggagaaagcaccagggcagctggcaggaggcgctaagatggattcttggtgggaaaggaatgaggcacacacataaaccgtgggaaagacttaggtgtcagggcccaagccagaagagggataaggatggactgttccagccttagtctgtgcttaaaaagacagaaatgcccttctctggaattatgagggagaggtctgagggaagggaggcaggcagcttactacttgccctttcactgacctatagcatctgaggcatctgagagcaaagttaaatagaatgaggctggtcgcaagcactgggaagaggtggcggtcctcgggtttaaggagccaaaccctgggcttggaattcagctcccagggccagagcagcatctctcttctgcggaggaggtcacctgagctcacaggactgggaatgtcggctttggaccctcctgatccctggttgttgagattcccttgtgtctcaaaagccttggagcagtgaagtgtctctccaggattttctttcccaatcagtcagcagtcaactttcctggaagaatgtcctttctacccaatctgcccaggagggcgggaatgtggccggccctcaggaagggcctctgggtggcctctgcatccctggctggagaatgcgcacagtttgcagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccaggacaccatggggcaaggaaccatggcctggtggcagacgggctgtcggagccaactccatgagaggaaggagcagtgtctttcaggggcttcggaagcggggtagtttctctcattcaaagggaggggagagaaagctaaagggattgtgagttgttagaaccagaactagaaccagaaccagaacgaaggggctacgatacctgcttgaagaaagagtggttcaggagggtgctggcactgggcctggagggaaaggggaggagagaccgcagcatcactgccgtgtccccagcttcccgaaatcctgccacttatgcctcagcctcgggtcccctctccctctccctcagctcatgggaagcagtggccagagctccccaggctggcctctgacacacccaggagctgatccctcctgtgtgtagctccagattcccctgcagaacctttgggaggtaagtcccttcacaccctggccttaccctcctgagcaccctctgctctcccgaagcccaggcccaggccagcagggatacctggcatccgggttgcgctgaaggcactgctccacaaagtggtggaagtggggggagaaggttcggtggtaggggtgggagggcgagtcaccgttggagggccggggggtgctggtggtcaggctgtcactcaggccagagttggccactgagcgcgaagggctcatggtcagctcctcagcggggatggtgctggtatccaacaggcagggcactgtgccgttcagtttctctagcagcatctggggaggacagaaccaggacctgggctgtagcgggtggggggggggggtggtccctggaaggcctgagagtctcttcacaaatacactgttcccaatatgcaaatgtgatcatttgaagagtggaaaaggtggaagtggagtaagtccaattttcccaaagaaacgctggtcactggcgtggcagctccgccctagccaggccaacgtgaaaggagaggggttgcacaaaagtacccgctttcgccatggctggaaagcagggctcacagtttccgctctccctttccaaggcatcaaattccttttaccgtagagtcttcaccctagagggaaggagcagtcagatgaacctgctttgaagcccagccgtctgccatgctcaggtggatccgatgaggtctgagaggcagtccctgcagtgccacagcctgggctgtcgctgcagcaggccacacgggagcaagatgcccaaggggaggccaggctgggtggctgttccaaagtaccccaactcaacacatataaaaccagccccacctgggactgctgtcctcgtggaagtcctcatgaccgcataagctgtccaagccagaaacctggaaattgctctagagctgcactaacgtgatagccactagccacttgtggctatttcgatttaaatgaggtttaaaattcagtcccacagtctcactggtcaccttctaaatgctcgacagccacacagtctcatggctcccacgctagacagtgcagccacagaagccctccttcgctgcagcaaattctagtggatggtgctgcttctaggcctggacttcttgttcctcctcagtcaccttttctttcctgagcatcctctgtcactgaattattttactgagatctcctagattcctcacatagacttccatacccacctaactgagctactggatctaatccatctgccggggtggtctttgtaaatgagccatcttatgctgtcactcctgtgcttagaatcctcagcactgctccacaggctttaggacaggaaccagtgctctaaagtggcatcaaagcccttcacaatgtacccttgcttccttctgtgcctgtcacctggcagtccccaagaagcactgcaccttggccatttataccatttacacctccttgctgttctccagatctgttttttctagactctgggtctctgcacatgctgctgtctgccgagaagagtgtcctagttcctcctccacacaggtgactgctgtctgccttccaactcaaggctgcctcctcccaggacttccctgggcccctgctctggggggctgcactctggccaccctccagctgcccctaccaccgggcaagcagcctgtgggttccggaagtggcttaattagagcctgcatcctgcccctcccagttccagaccacactccaagtagctgggacccaggtaatccttgcccaaatgaccccaaatccattttctggatttaatgaggcttgcataagcctcttccctgggtctgttttcccaagggtagactgtgccactgactgtgcacccttggatcctaggggtggccaaaggacaggcatctggagggtcatgaacagaagctgaacttacagaatgggggttccaaaggtgtcagctggaatgcggttaagaactgtgggaattctaaattagaaactgaccttccaggtatatttatccaagtaggaggacagaacatattttatgcatttataaaaactagttagcttaatgtatatgttttaaatagacatgtagcgtgtgggcctccatttgcacccctgctcccgggctcccctccccaagctggcctcccttaccaccaggtttgccacaggaagtaaacaaagagtgaggtcactatcccccactgggtgggacttcttgaaggaaaagacagggtctttcatcttagtattcctagtctgtgtcctgagtgtgagagctactcaacgaacatctgtggaaggcaagcaggcaagaaggaaaccgatgggcggcaggcttacctgggtggcaggcatatccttaaaggggacatggccgttggccagttcacaggctgtgattcccacactgtagatgtcagacttggcatcataaccctggagattctaagccagaaaaaaaaggccacagattaccccatttggtctttgttcttagaaaaagggtagaactaaagagaggaaaaggatggctgtccccacatcaggacctgctgctaatgactctccttgcctgtgctactgaagactaactggtattttaccacctgtaactggcgatgctctgtaaggagcaggaagtgccagccccatgcccctgcttagcacagggatccagagagcagcaaacatttccaaaatgctcactcttctcatagggtgccaagggtccctaaagggagctgaaatttcatccaatagaggttaggaccccctgggaggaaccacatccatctgcagtggacaggcgctgcccacgctgagggctccctccctccaggaacccctttaccccactgggaggttgagagcccccgactccaggcaatgcctgaaggctcccttgggaatcatgagttgggtaggggagctcctctgggcccacacacagacctgctggaggacctcggggctgagccacggcagaaccttgacactgtacttgggaaaatcgtggaccactcgctgccgctgcccatggcttatcatgctgaggttgctgcgcaaaccagacaggtagaccttcccatccacagagatcaggatgtggctggctttgacactcctggggaagcggggagggtgtcatgtcgagagcaggagcccctcctgctacaaatttttggtcttcacacactccacctggccagctctctcctgtgtgcgtgtgttatacacgtatatgtgtattttacatatacataaccatgtttttgttttcattgagataagagtctcactctgtcacccggctagagtgcagtggctcaatctaggctcactgcaacctctgcctcctgggttcaagcaattcctgtgcctcagccaaccaagtagctgggattacaggtgtgcaccaccacacccagctaatttttttttttcttttttttttgagacggagtcttgctctgtcgcacagactggagtgtagtggcgccatctcggctcactgcaagctccgcctcccgggttcacaccattctcctgcctcagcctcccgagtagctgggactacaggcacccgccaccacgcccggctaatttttttttttttgtatttttagtggagacagggtttcactgtgttagccaggatggtctcgatctcccgacctcgtgatccacccgtctcagcctcccaaagtgctaggattaccagtgtgaaccactgcgctgggcccgcccaactaatttttatatttttagtagagatggggttttgccatgttggccatgccagtcttgaactcctggctttaaatgatccgcctgctttggcctcccaaagtgctgggattacaggtgtgaatcaccgtgaccggcctataaccaggttttttgttcttgttgttgttgttgttgagacagagtctcactctgtcgcccaggctggagtgcagtggcgcaatctcagttcactgcaacctctgcctcccaggttcaagcaattctcctgcctcagtctcctgagcagctgggactacaggctcatgccaccacatccagccagtttttgtatttttagtagagacagggtttcaccatgttagccaggctggtcttgaactcctgacctcaagagatccaccccttggcctcccaaagtgctgccactgcatccagctataactatgttttaatgaaaaacttcaaatctacataaaatagcatgactccatttacatatcaccagattaaaagcttatttagctctgtcatccaggctggagtgcaatggcacgatctcagctcactgcagcctccacctcccaggttcaagtgattatcttgcctcagcctcctgagtagctgggattacaggcacctgccaccatgcccggctaatttttgtatgtttagtagagacagggttttgcgatgttggccaggctggtctcgaactcctgacctcaggtgatccacccaccttggcctcccagagtgctgggactgttcagtgctcttgtatgctctagaacacctcttgccctacctcctacgaatgcttttaatctgtacttcttatctgtaggactcttgtaaagtgtacctaggggtactgtgttccgcatcccattcttcctttttcactcagggctgtagtttccagacacatctgtattgctagctgtgtacctttcatcttttcttctaattgtcaccttggttctgggaagagatctaacacttttactcatccatccttctggggacagacactcacactacccctaaccaacacacgtgtgaatggtgacatccaaacatgtcccctgatgggtctgcacgagggtttctttagggtgtacatccagaagtggcattgatggttctggttctgtgaccctgactggcagcaccgggcatcttccaccacctggacaggaggctccccgtccttgccacactgggactcgtccagcctcccaaccgctgccagtctcatgtgtataaggtgacatcttgtttttcatttgcttttctctgattgcgagatttgagtggctcttcctatgatgggtttgtcttggggtttcctcttttgtaaacttcatatctttggcccatttttcttgctttgctgtccatttcttgttgatttgcaagatttccctgttactaatctcctgtggtgacaaagctaatatcatctgctctgtcacttgtttcttaacctttttcatggtatcttgtattggatagaaatcttcttgatctaatcaaattcatcaatcttttgtcttatgttttgtgcttctaaaatgttgagaaattattacatgcctcaggtcacaaaaacattttctcacatttccttctatttaagtctacagtttcacattttacatagaagcctttaatccagctgcagtccttctctgtatgaggagttatgtaggggtccagttttaccattttccctactatgagctgatttcctgacactatctactaagctatctgtcttcgccctggtctctcagcataagactgactctggggcacagaaagaaggaggcagagagtggagtacaaaggtccacatcagatgttcctctcacacaacactcaagaccaagctgctcagcaaagagaaagtcagtggcttcagcactaacaggctaagtgaccatctcccaagtcagtggcaaggtcagaatccagatccttctctctttttttttttttttttttcagacaagagtctcactctgccacccaggctggagtgcagtggtgtgatctccagtcactgcaacctccgcctcccaggttcaagcgattctcctgcctcagcttgtagtcccagctactgggactacaagcatgtgccaccacacccggctaatttttgtatttttagtagagacagggtttcactatgttggccaggctggtctcaaactcctgaccttgtgatccacctgccttggcctcccaagcgctgtgattacaggcgtgagccatcgcgctgggccctgtttcttttcagagcaaagagatcttcagcaagaatccagatccttgattttaaactctggcttcattaacttcagtcaaacttcactttacctgaaggctcaggggcatagctacccactgtaatcatgggaaaggccgcctaagaacgcacctgtgtacatatcccatgtggtggatgtagtcgagggccttcagcaccccctgcaggatgtaagcaatcgccagctcattcatgccatccatgaagtgtgtacagatgagatcttttgcagaacctgcagaaaaggattgcatggaggcagtgaaaggtaatggaggaggaaaacacaggcaatctgacaacagagtcccaataacccctttctaccaagaaccctttcccactcaccgtatgccatgaatgatgtgacaacccacagctcattgtctgcaataaaagtggctcgatatggcacgatattgggatggttgaagagtttggagacatgcagctcgccctggaagcaatgatgaagctgaagtcagaaccaaatggcactgaaggatgccgctcaacacaaagatggcagcatggacaatagggggacctggcactttctgggtgttctcagagtcatgggaacagcctaagcaggtgcctgccaacataggaaaaacaaggccctgctgcctctgcagggacccagcactgctttgcctctgccagatagggaaactgccaacaacaaagggtgccagcacaccgactcagagatgatgaaggcaaactgttgactgaagacttctgaagttataagcttatctcaatttcaagggccaacgtatagaattcctctttaagataagaaaacaaaaaatattttgttgttgttatttgtagagacaaggtctcactgtgttgcccaggctggtctcaaactcctgggctcaagcagtccttctgcctcagcctcccaaagtgctaggattataggcgtgagccaccaagccactgcacctggccaaaaatgttttcttttttatttttttgagacagggtcttgctctgtcacccaggctggagtgcagtggtgtgatcccgtctcactgcagcctgaacttcccaggctcaagtcatcctcccacctcagcctcgctggtagctgcgaccacaggtggacgtcaacatacctagctaattttttatatttttttgtagagacagggttttgccatgttgcctaggcctgctttggcctcccaaagtgctgggattgcaggcgtgagccactgtgcccagcccaaaactatgtttctattataaaagaaaacatggccgggcatggtggctcacgcctgtaatcccagcactttgggaggcgaggcaggcagatcacttgagcccaagagttggagaccagcctgggcaacatggcgaaaccccatctatatgaaacatacaaaaaattagttgagcatggtggtgcatgcctttagtcccagctactcgggaagcttaagtggtagaatcacctgtgcctgagcagttgaggctgtggtgagctgtgattgcaccaccgcactccagcctgagcaacagagccagaccttgtctcaaataaagaaaaaaaaaagaaaaagaaaacacagttgatggaggagaaggccagctgagactggcttctgctccatcctcagacccaccaaactactatgaacagatgaacaggtcctagagcaccatcaggtaaccaccaattcagaaaaagttgtaaatgaaggaggggaggggctgcaactaactctactgaaggaaaactgccccaggccctgactctaagctggcatcaggaaaggagagtctaactcccaagcacttactagactcacagtctctctccgttttgttttgttttattttttgagccagggactcagtctgtcacccaggctggagtttggtagtgcaatctcaaactcccgggctcaagcaatctccctgccttgccctcccaaagtgttgggattacaggcatgagctaccatgcctgccccctctctcagtttaacgagagagtggctacttgcttctcgaatagaaaggaatgtcaggactgggcatagtggctcacacctgtaatcctagcattttgggagactgaggtgagttgattgctcgagctcaggagtttgagaccagcctgggcaagatggtgaaactctgtctctacaaaaaatacaaaaattagtcaggtgtggtgtgcctatagtcccagctacttggggggctgaggcaggagaatcatttgagcccaggaggttaaggctgcagtaagccgtggtcctgccactgtactccagccagggcaataaaatgagaccctgtctcgaaaaaaaagaggccagatgcggtggctcacatttgtaatcacagcactttgggagaccaaggcaggcagatcacctgaagtcaggagtttgagaccagcctggccaacatgaagaaaccccgtcttttctaaaaatacaaaagttagccgggcatggtggtgtgcgcctatagtcccagctactcgggaggctaaggcaggagaatcgcttgaacctgggaggtgggggttgcagtgagccgagatcgtgccactgcactccagcctgggtgacagagtgagaatccgtctcaaaaaaaaaaaaaaagaaaagaaaaagaaaggaacatcaggcaaacaggaggctgagagccagaagatggccactggtggcagggcaggcaccttgtgtctggaacaagatggcctgggtttgaatcctgcctctgccatgagcaagttacttagcttctttctaaataataaataaatgaataaaaaagccagaagggagtgtttggagaagaaaagggaaatataaattaggctgagcagcatttcagcccaatccttagtgccaaatggccaggattctccactgaaagcttccataacttccgaacgtttagtctcccttcatttctttgtaattccttgtaattcctatcagagccaagagcccaccctccctccatgtgacacactcatggtttattacctgcaagaatgttaccatctcattggaacaagcttctaggttaatcctccgtacagtcacgtactctcctgttggtttgtaccttgctagattcacagtcatcaggtcctcaaatcctttgcctaaaagaaaaagggaatgccatacgcaaggacaagaacaacaaaaggttttaagaaaattttcctttaaaaaagggacttgatttcaaaagaaacttaatgttaaatttttcactactgttacttttttttttttccttttcccagcagaatttaactgttatgttcatggctcacatttcttgatttttctctcatcagttccttctcagccaacctttctgactcactatggccaggacaccggaaacatggcagccacaaaggaaagatggcaaaagagcttctttcctggaagtttgatctcttcccatacttggcataaaaaaacagagaagacccacagaagcaagtctgtgcccatgaatcctcctaactagtggatggcctctgctgtacacacatctggggctgctgagaaagctgcagcagcccctggagcagaaagcaggagagtaaggacggcccctgcacatacctatcacagtgagcagctcgtaacaccctccctctggcagaaagctactcatgacctcctgtttagagaaggatgctattgactctgagctcgcatcattggtctaaaaaagaaaaagaaaaataggttagtagagaaaactgggggtgggatgggagtggggtgaaggtggtaattcagacccacgaggagactggcatctaaacacacacacaaatcccgactcagtgccagcactatttgaagagaaacaaaacactacattcagggtagtaatcagcactaatatcagagcaagtgttagggttgtctacaaatgaggagacaaggacctgttcccatcaaatgttaatctgcttgtcctttccaacaatcaatgcatttgctaaaagctatgaaattctcacttggagaagggatgtctagagaatgaaagcatgtttggaaaagagaagcaggtggagaggtaggggttctcatgaatttcctgatgcattaggatcctatttttaaggtcctcaccacaagatcccaaaaggtcaaacgctgaatcttgctctagggaaaatgtggccaggagtagccccctctttagcaaaccaagagcccgggccagtcattgcctgacatttccaagtgaagtgggagaaccctgatgccctgagctgcaggcaaggcacagagctgtcaggtctcaggcatcgtccaggcagctgacatggcctgctccctcgttcctgcccacgtgtgctgtgagtgaagctggagtccagccacttaggatgtgtcacaactctggcctctaaggtcctagaggaaggtgtccagccatgtctgagtttgtgcaaaacacacggcagaccaacagctcttctttcagcttaatggactgtttccttcttccacacctaaatttatgtgtatgatttagggactgtgactgcttttcttttagattctctttctttagatgcacatctaactgaaatggagaaacctgggccagctcatgtttcatgtgctgcactcataaacctgacctccaggcagaaaaagtcctttgtgaaagtatgagaggctcctgacccagcactacccagaagagcacgagctgagagtgttctgaaaaggcggtgcttgaacaactctttgggaagcggctctgcagaggaaaccataaagatgacggtgctctatacctgtaagatgaccagagtatactttccagagcacttccaaattgcacatgattcctccatagctcagtcaagtagccgggacagatcttatctccacttttcactaacaaaaacgagggccaaggagattatgtgacttgccaaaaatcaaaacgtgagtacatggcacaggacccaggcccaaaccagtgagattaatctaccaccctgttggctgacgtttcacgtgtatctggtttgtttgttgttttgttgctgttgtttttaagatatgggttatctctttgtcgctcaggctaaagtgcagtggtgagttcctggctcaccgtggcctcgaactcctgggctcaattgatcctcctgcctcagcctcccaagtagctgagattattggcaggagctgagattattggctgtatgtggtttcaaaacagttgatgctgctgatggggaaagaaaccctcaagtgggctctgtctccctcaccacttaccctggcaataagaggaacctagtcaagcaaaattaagccctgtcaccaaattccatttctaatttaatcaatttttaaatttctaagatttggccatattgttgtatttcactgtagttcgcccattttcactgctgtatcatatattcagcacatgaatatatctcagtttatccaattccaactttgatggctcatttgggttgtttttcagttctgctattatggactgtgctactataaacatgtttgaatatgtatcctgactaaagcttgtaattaggagtggctggaattgctagtgacagagcatatgaacaatcaactgtttgagacaatgccaaattattttccaaaatggttataccaatttacactcccaccagcaacgtacgtggttttttttttttttttttttagacggagtctcactctgtcaccaggctggagtgcagtggcacgatcttggctcaatgcaagctccgcctcctgggtccaagcaattctcctgcctcagcctcccaggtagctgggactataggtgtgagccaccatgcctggctaagttttgtatttttttgtagagatggggttttgccatgttgcccagctggtcttgaactcctgacctcaagtgacccacccagcttggcctcccaaagtgctaacattacaggcatgagccactgtgcccggccacatgtgttcttattaatttatcttttccccaacacttggtattttcagatttcttaatttttgccagtctcatggatttgatttacatttccctgattactaatgaagatgaggatcttttcatatatttatcagtcatgtgagcgttctccaaggtgaaaatgcctcttcctgtctcttgaccattttcctgttgtttcagtgcaggatttccccaaagtaggccccacggaactctgattctgccagttggatggaaaaagtttccatgtccagtgaagttaggaaatgcagcacactctctcatggaggatcacaaggtgtacgtccatattaaaggcactgagaaattctgtagtaagaaaacttactgtgtttaacccagcatttcccaaagagatctgtctagggaaccttttgtgcctaacatctgttaaattttgggaaagataattgggaaaggctgttttaaataaaacatatgctacaatgcaaagagcataggcttatgggccacatagaggcagaatttgaactcaggtctattactggttctgtgaccctgggcaagtcactctgatctcttgggatctccattatatcagcagctgaataatttccatctcatagtgttgtatctattagatgagataaaatatgttaagagcttagtgctacctggtgtataaaagacattcaatacatgtgaatcctattctcctcctccttctattgctctctactttttggtgactctcctgttgaacaaataaaatggaaaagagaaaatggaggaaacagaatcctaagcagagcttgatcagtaaagttgatttgatactggtttttatacttatctgtgttttctaatgctctcaaaataaattctaggatcattaaattttattttattttatttatttatttttgagacggagtctcactttgtcacccaggctggagtgcaatggcgtgatctcagctcactatagcctctgccttttgggtttaaacgattctcctgcctcagccttataagtagctgggactacaggtgcgaaccaccatgcccggctaagtttatttatttatttatttattttagacagactctcactctgttgcccaggctggagtgcagtagtgcgatctcagcttactgcaacctctgcctcctgggttcaagtgattctcctgcctcagcctcccaagtagctgggattacagatgcctgccaccacccctaatttctgtatttttagtagagacagggtttcaccatgttggccagattggtctcgaactcctgacttcaagtgatctacccgcctcagcctctcaaagtgctgggattacaggtgtgagccaccatgcccagctaatttttgtatttttagtagagacagggtttcaccatgttggccagactggccttgaactcctggacctcaagtgatcctcccaccttggcctctcaaagtgctgggattataggcgtgagccaccatgcctggcctaggatcactaaatttttaaaaattattattattattatttgagataggctctcaatatgtcacccaggctggagtgcagtggcaagatgatggctcactgcaacctcaatctcccaggctcaagcagtcctctcaagtggctaagactacaggcatgtgccaccacgcctagctaatttttgtattttttgtagagatgaggtctccctatgttgctcaggctggtctcaaactcctgggctcaagcgattctcttgcctcggcctcccaaagtactgggattacaggcttgagccactgcaccctgctgactctagctttttgaaacgatctcatcttcagaatcatcttaagatgttaagatactggttaccacatgccaggtacctcaccaaggtgagagagatacacaaccaggaggcaaaaatggagcagcaatttgagcaaaaagcctcaagcaagagttctgaaatgacaactctccatcggtttagaattcacaacgctcatttggtcttgaagtgtctcattttctcaaccttatatacgcctaactcctgcacatattcttgctctgcagattctgttttcttaagtattaatctattccttaataaaatcaatgttaacagttaatagaaagctcagtgggttgctttcagacccaaactccccaccccagcctatgagtatacaaatgatttggcccttgcctacctctgtgatctcattccacaccacgctcgcctgacttgaacaatattcccacataaacaagtgtgttccagtctcaggaaacttgcactaactgtccctttggaaccctcctagcctcctccttcccttgaccctgctatttttctcatggctacctcctcaacatcactgatgtctcaacttaaatgtccttttcagagagactgcccagccaaagtaaactaggctcctggtcacgttatcagacagccttgctttcctttcttcacagaagttaccattgcagcttatttctctaaaatcttccactaaagtttcttccattaaaatgcaagcaccagaaaggcagggaccttgtctgtcatgttcactgatgtattcccccagtgcctggaacaccgctggcaaatgcttaaaaaatgaaaatgatttaagcaaagtttgaactgaggctttctgcccatgatcttttcattcccacgggctaaagaagagaataggtcaatgcagccagttcctttggtaacgggttcagcatgatgacctatgctggaaatgccagcctcataatgacacagtcgttagattcctgtgttactcagaacactctatagaccagaatctgattcctgcatgtgagaaagtactgcatttttcagtaggtaacaatatggcctcaatgagaggcaactactttgtatctgaaggtcttcgtgcatctgctctctaagcaaactccttaaaatttctctcacttgaaaaagagactatgaaagacagctgagtcctgagattcaaatattcattttatgtactttaaataactccctttggagaaaccacagatagatactactttttttttttttttgagacagagtctcgctctatcgcccaggctggagtgcaatggcgcgatctcggctcactgcaacctccacctcccaggttcaagtgattctcctgccccagcctcctgggtagctgggattacaggtgcgtgctaccatgcccggctaatttttgcatttttagtagagatggggtttcattgtgttggccaggctggtttcaaactcctgacctcaggtgatgcgcgcacctcggcctcccaaagtgctggggttacaggcgtgagccatggcgcccggcagatagatacttcattacctatgtccctcttccttgtcaggcgtgcatataagcttataagacatattgtctactaggctatacactaagacacattcttgctaagcctaggtagggaatgattcattaaactatcaatgtgcttagttagtaacttgacaatatttatttctactctccagtattacagaaaactaccaaaactaacccaaaagtattagttttagaaaataaaattctttttcttttttttttttgagacagggtctcactctgtcacccaggctggagtacagtggcatgatcatagttcactacagcctcgaactccagggctcaagcggatcctcccacctcagcctcccaggtatatgccaccatgccaagctaattttttttttttttaattagggacagagtctcactctgtctcccaagctggagtgcaatggcgctatcctagctcactgcagccttgaactcctgggcttaagggatttttctgcctcatcttcctgggtagctaggactaccagtgtgcgctaccatgcctggctagtttttttgtttttagagatggggtctcactatgttgcccaggctggcttcaaattcctggcctcaagtcatcctcctgcctcagcctcccaaagtgctgggtttacaggtgtgagccaccacacctggcctttagaaaataaagttctgggggctgggcgaggtggctcacacctgtaatcccagcactttggaaggccgaggcaggcggatcacaaggtcaggagattgagaccatcctggccaacacagtgaaaccctgtctctactaaaactacaaaaaattagctgggcatggcagcgggcacctgcagtcccagctactcgggaggctgaggcaggagaatgccgtgaacccggggaggcagagcttgcagtgagctgagatcgcgccactgcactccagcctgggcgacagagcgagactgtttaaaaaaaaaaaaaaaaaaagtaaaaaaagaaaataaagttcttggccaggcatggtggctcacgcctgtaatcccagcactttgggaggctgagacaggtggatcatctgaggtcaggagttcgagtccagcctgaccaacatggtgaaaccctgtctctactgaatacaaaaaattagctgggtgtggtggcacatgtctgtaatcccagctacttgggaggctgaggaaggagaatcgcttgaacccaggtggcagacgttgcagtgagctgagattgcaccattgcactccagcctgggcaacaaaagtgaagctccggctgggcgtggtggctcacgcctgtaatcccagcactttggaaggccgaggcaggcggatcacaaggtcaagagaacgagaccatcctggacaacatggtgaaactccgtctctattaaaagtataaaaattagctgggcgtggtggcgggtgcctgtagtcccagctactcgggaggctgaggcaggagaatcgcttgaacccgagaggtggaggttgcagtgagccgagatcatgccattgcactccagcctgggtgacagagtgagacaccgtctcaagaaaaaataaaataaaaaaaaataaagtgaagctccatctcaaaaaaaaaaaaaaaagttcttgactgggcacggtggctcacgcctgtaataccaggactttgggaggctgagtagggtagatcacttgaggtcaggggttcgagaccagccaacatagtgaaaccctgtctctactaaaaatataaaaattagctgggtgtgatggcacaggcctgtaatcccagctactcgggaggttgaggcaggagaattgcttgaacccaggaggcagaggttgcagtaagccgagatcgcaccactgcactccagcctgggcaacagagtgagattcggtctcaaaaaaaaaaaaaagaaagaaagaaaataaagttctttatgaaactggcaatatgagctcacaggcaatctggaattgcataaaatgaactagtccagtgatagcaactgctctgtccccagcttactaggaatgattctaaaatggaggccttctactttgtggatattgtataggtccgaactcaaagagagaccaaacttcatttaggaaaacaaacaaacaaacaaggaaacaggcaatattttgaaaggaagaagtctagatcatctgacattgccacaagaaacgcaggttagttcatcacactgtttcagttttagaacaggtctaaactcagataaaaagaatgaactatttagcccattctctttaaatgcagcatggcatagtttaattagtgcaatgtaataatctccaattgctcatagaaaggaactaattctgtcaaagtgttttcttagtttcccccaccatgaaatgcattttattcattttgaagcatctgaaaaataaataagcagctgatatccagaaatgaccataaaataactgtgtttaaagagtttaaaacaaaatacagtaaagcacacaaagacaatattcacaaaatgctaccaaataaacacattcaacttcccacaggtttcacacaggataacttttgatataacatcagcagctgtaaaaatataaaaatcctatgtaattggcatcgtattctagaaaaatagctaactgagcctatagggaacgtttttggtcttcagattggaaagcatttggatctgatagagaggtgctcctgattagcagatgacataagcacagccaaagctttactcagaaattcccagtcaacatcactgtccttcactcaaccttagggctgctgcagaagctgcaaatgtctgcaatctgaacagagtcagaagtctaggtaggaaaggttcttatcctctctccttataagacactgattcatatattccaaaatagcttggtacactgtgcacatctggtgctatttatttaagtaaaataaactagaagagaaggaaacagggtaagaatcttgcagctttcaccaatgaaaaaagtaaatgttctgttttatactttttaattttgcttttgttttttaaggtaagagatttgaggtcctgtcttattatctaggcagagatctgtattatctctgtggactaaaatctattattaataaactaaggacggaaaatttaataacattagtcactaaacaataaccgtatttctgactgttgaaacttacttttttgggggaaggggtggcagtcgattggcagggctggggagaggaggagaccttaatccccagaagagacaaaaactacctgagacttttttcagttttcaaactacacatccaaatttttccagggtgaaacctgaatctccacaagtacaaaaatcacactacaaataaagctcagtgacagataagcagaaacataaaatgataagccaacaaaacacacaaacttccacaagaagtcatctccatgcaacagccatagtgctagggcctaggaagccacttacttttctccgagtgtcacccggaggctgctctggggtagagaaattgattgttggcattttgtgttttagcagaagacacacccacattcagaacagcaattattgtacttaggactacatttattaatagaaaccacttaaaagtcattacagcaaaaagtgcctgcggggctacatataaacacacacagatccacagtaaaaatgctgcagagagatagggctttaaacatggatctatggttcttcaaaaggtggcaaggctactactctatgggtattctttactggatagaactcaactcttacatttctggtcatacatttacttggcatcaacacacaatgttattatgaataggccagttccttatattttgtgaataaacaattgattatatagttacagagatggttggccatttcccagtgagtgtgggaactagaaaacatgttttttcaaaaaagggcaaaaagttttaaaatagcaacacgtgtatgaaggaccattacccaacctgattctctaaagtcagatatatttgattctaaatgtaaataaagcaaaggcattttggcgctctgcttgtcctagtgaaaatgaacaaaacaaaggacaactgaaataactttctgttcttaagccaaattctgtatgtgcttttgaccttctctattctgtaaaagtgataaaaatcaccaaactgaagatttttaactgtaaaatattggggtgattatacatttctaattatcttaaattatacaattctaaataccttaaactacaaaatcagaaaagtctagttaccaaggaaaatgctttcttctttttaattttttttttaattttttattttttggaggcagagtcttgctttatcccctaggctggagtgcagtggtgtgatcctggctcactgcaacctccgcctcccgggttcaagcgattctcctgcctcagcctcccaagtagctgggattacaggtgcctgccaccacgcctggctaatttttatgtttttagtagagatggggttttgccatgttggccaggctggtctccaactcctgacctcaggtgatctgcctgcctcagtcttccaaaatgctgggattacaggtgtgagccactgcgcctggcctacctttttttttttttgagacggagtctccctctgtcgcccaggctggagtgcagtggcacgatcttggcaattctcctgcctcagcctcctgagtagctgggattacaggcgtgcgccaccatgctgactatcttttttttgtctttttagcagagatggggttttcaccatattgccaggctggtcttgaactcccgaccttgtgatctgcccacctcggcctcccaaagtgctgggattccatgcatgagccaccgtgcccagcctcattgtttactttgaaaccattttattcccattaatgatgggaagaaaatgagaataggaacagaatgtggtatttttgttccactatcctttcctttactgtgcatctaactaattctttccaactaaaatataaagaactcatcattattctaaactcccatttatctaaaacataatactttgacaaagttcacagatatcactagtccagaaattctttgagatgtgttagggaaaataataggtaccacctagtaactaacaagtttgagttttcaattacttaaacctatccctgaccttgtgatccgcccgcctgggcctcccaaagtgaaaccctgtctctactaaaaatacaaaaaaaatttagccgggcatggtggtgtgatcctgtaatcccagctactcaggagggctgaggcaggagaatctcttgaacccgggaggcggagtttgcagtgagccgagatcgtgccactgcactccagcttgagcgacagagcgagactctgtctcaaaacaaaacaacaacaaaataaaacaagaccaaaaaaacctatctgggcgtattttggatcagctaaccaatgtactcaatctgataatctgttttttaaatttccttcttattttattttttgagacggagtctcaaaaactcagccttgctctgtcgcccaggctggagtgcaatggcgtgatcttggctcactgcaacctccacctcgcgagttcaagccattctcctgcttcagtctccctagcagctgggaccacaggtgtgcatcaccatgcccggctaatttttgtatttttagtagagatgtggtttcaccacgttggccagcctggtcttgaactcctgacctcaggtgatccgcctgcctcggcctcccaaagtgctgggattacaggcgtgagccaccgtgcccggccgataatctgtttctttctttccttttttttttctttgagacggagtctagctctgtttcccaggctggagtgcagtggcgcgatctccgctcattgcaagctccgcctcctgggttcacgccattctcctgtctcagcctctggagtagctgggattacaggcacccaccaccacgcccggctaatttttttgtatttttagtagagacggagtttcaccatgttagccaagatggtctcgatctcctgatctcgtaatctgcccacctcggcctcccaatgtgctgggattacaggcgtgagccaccatacccggccggtaatctgtttcttaaactataggatcctaaaagagtatcttagaattcagacacaaagaatggggctctactattatttttattgaaaataatttttgttgccctaaattaagatgacagttcccaaaaaggctcactttgaaaatggccaaagggtaatgcctaggcctgtcaaagtttacttctgaaatcaacagtcaggttttacaataggaagttcatatttttgttctgaaagatttttccttagttctcttaaatctcataatttctaccatgaaaaaatgagtcaactagattcatcaataaaaccagaactttcatatcattgcttcctttgtcttgacaattattttttaaatcaaggctacagacttttaaatagttttcttcctttaaaaatatgtatttcacctggacaaaagaaaacatatatgcttttaagtaaatactggctttctaacaatcaagacaggccaaggaaaattgccatgttagtcttcaaatctttgggaaaccataaattcaaaaaggaaccaaagaaatccaacaactgtaggttacacttgcccttagaattgccaattgctatagattgatttagtcaacaaaaaagtagtgatttttatatcctgaagtgatggctaaatgccatactgtacttacctccaaatagttccaaatctcttaagccctcaacaatgaacttttccgagacccaccgctaaagaggaaaaccccaaagagaattagtatttcttccaagccgcaacaaattagctatcagcctttagacagacaaacaaaatcccaactatgaaaacagaatcatgcagtacagttaggaatcatttctatggaaaagtttttaacagaatcttgaactaaaaacaagattcctttctccactcctctttgcctatttgatgaataattcttaaatttgacagatgagaaatagatagtactggctgtaataatgaagactgtttttgccttccctatattggttccatcttactcgttctacattacagatgccttggatcactgatgtcaatttgaaaactattactggaattcataacacagaaaacagagatgaaacagtagttattcacaagaccctgttagtttgtaaaatggcacacaacaagttgcatattctttatccactaggggttctaaagacatggctgcttacattttctgccaagttcacaagggccaaactagtaagaccaaactagcaggatcaatctatggctcactttactggcctatttcaaacgagtattagatttctgtcattctgatcagtggtttcgtttcacctgaattaggctacgttgaagcagacaaggagctcatatttaaaagcaatggaatcaagattgtatttcccttaaggactggtgttacactttggcttgggggcattctttccactgggcagagttcaggctatggagagattccttttttcctcttaattaacagtgaagtttactctttctaatataaattgttcttatatgcataaacattagaaaaaagattaagtaacattcagaaataagttgcatgatacagactgtgaattggaactatagcatcttctgcccttacctataactattttttccaaatcaaaaaagaagtaatatcctaaattgaaaacttcataaaaattatatgcactgcatcaaaaaacataaattatgctttaatatgtaaagaaagtggtatactcataatatctcatagcacttatacactgttacaaaattctaaaataattacaactgcatttagaaattaggtacttgataataaagaaaataagaaactcatgaaataatgggaatttgtaaagaagctaaatctagtattgtttttgaaatcattttatctgacgaagttttgaagtataataaaatctttcatgttcaaaatgtcttcaattaaaactaatgatattacttagaaaaaagtgtcctagtaattacaacttgattttgaaaactcacaacctcacggggggtcataagcagttaaacgtctacacttaaaagtatcatcgactcatttaatgttgtatgactgatattcatgaaataagccactttcttcttatttcttctctatcagacaagctggtggtaaattttgtgtctctggtcagcctctgtctgcaaactcttctcaggagtggaggctgcactacctgccttacttcctacatccctcacttccgtatcattccgaccctcacgtagaaaaccacctacaacatctgccaaaatacactgcttttcagaaaacaaaaatagtaaagccagaagaatagaaaaacactcaccctgattcgctctggtttacttacaagaaatgacatgagttcctactgtgtaggcctacttcagtttcaaaaacttaaacctaaaaggaaaatagaaacaggttgagttagcaaaaatctccttatagagaaatatcttctgattaacaaaaacttattacaggtctaccattcaaagcactggacttcacctataaattgctagatttgtttagagaaactttaagtgatgataaatctgaatatactttggccaagtacattataaaattctgtaatttctggccagatgtggtggttcacgtctgtaatcccagcactttgggaggccgaggcgggcggatcacctgaggtcaggagttcgagaccagcctggccaacatggtgaaaccccatctctataaaaaaaaaaaaaaaaaaaaaaaaagccaggcaaggtggcagatggctgtaatcccacctacttaagaatcgtttgaacccaggagatggagattgcagtgagccaagatcacgccattgcattccagcctgggtgacagagtgagactgtctcaaaaaaaaaaaaaattttaattaattaatttctgtagaaagagaaatttgtcattatatggttttaaattaattcctaaatttctcttgacttaatcccccactaaccttttcccagaagcaattaccttcagttattttccatggttatcctgctttttatttatttacttcttatagagacagggtctctctatgtggcccaggctggtctggaactcctggactcaagcgatcctcccatcttggcctcccaaagtgtgggggttaccacgtgagccaccatgcacagtgttatcctgctttttaataattattcttaaacaatgtttatatgggtatgacttaattttagacttttaaaattttctttactgctccttgcagagcagggctaactcatagacaatgtacccagagtcagccagttttaacttcctactatggtagatgaagatgaagcttcttatagcatcatcttccactgtatctcctgctctcattctaccaacatagctctggcataatttggttaaatcaatagtccacatttatattattatgactatgcaaatatggttcagagctgaggcaaatagaaataactatgtctcagccaggcctggtggctcaagcctgtaatcccagcactttgggaggctgaggtgggtggatcacttgaggtcaggagttcgagactagcctgaccaacatggtaaaaccctgtctctactaaaaatacacaaaaaaattagccaggcatggtgacaggcacctatagtcccagctactcaggaggctgagaaagaagaat

SEQ ID NO: 36425 - DNA, 68615 bp, Homo sapiens
agcgctcgagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcaggtagcgcggctggccgcagacccagaaggtggcggcgcggtctcggggagccgcgtggggtacagggctggagctttcctccagccttgcggcattatacgctgaacccggcccggatggtggaggcgggcacggactaccaaccttatctcacatatgggaaaactgagaaggagacacttggccaaggtcaccccgcaggagcaggagtcccgtctccttcccttgggcggtactttgtcccacctccccattcagttgggaggtgctggagtatgagggggaggccttggattgggattgaggtggggggcgttaccacaggggcaagcatctgaacgcttcagtctaagagtggtggcagtttctgggtcttggtactcaaaaagtttaaggtgactgtcactaatcagttgttacctattgttgagggaacaccagacttcttgcttcgtctcccagcgacacagtagtgccatttgctaagactctaggagttatttatttatttatttgttgagacggagtttctcttttgtcaccgaggctggagtgcagtggcacaacctgggctcactgcaacctccgcttcccgggttcaagcgattctcctgccttagcctcccgagtagttgggattacaggcgcccgccaccacgcccgcgcggattcatggaaaatttttaaatctgcatgtactttaaagaaatacttttgagtcggtggactgaacatgactgatgtatataggtttgtaatttctcttattgaggtttttatttattgtaatgaaagaaattaaatattgttgagaaagtgaggagactaaacataggtactttgagatagaggctaatggaattagtcataactccctagcagtgttttcaacatgagtacagtaatgaagacagtcaccacaataaataggtacatttgaagtaataagatagtattttggaaatgggaagtacagaatgtgtcataaaatttgccggaatgtttttcactgctttgcgtttgtgtgaacgtacatttcttttttttccttcttcacttaaaaacattattttttagaggagagaagctcctactagattgcaagcttcctgaaagtagggatcaaacttgttttgttccccattgtatccatagtcagttggtgctcaataaatatttgcgacccaaatcaatgactaatcttgagatttcaagcaatgattatttctgcttttaccatttatgttgaaacaaaatcaggcttatatagttagatcagcgatttaatttagtttgctactatgttgaaaaaaaaaacttcacagtgtatgttgagtggttcactgtgtgcatgtgtcctaatatgtgatttcttttaatgagaaaatgatgaatgtcttttaataaactttggatactgctttaagtagtgacgtttaaaaatttctaggcattttgtctgtctgccgtcttagctatttgtagtgatctgttactctaggaggaagcatttaaaaatggataattcaataaatggtgttggaacaactactaagtcattacaccacatgaataaattccagattgattaaagatctaaatataaaacaacaaaattgtaataaaataattagaggaaaacatagattattttaataatccttggatagcagaagaggcctaagcaaaacttaagaattcataatccataagagaagaaattggcagatttgattgccgaaaaaattttaaaactttgataaaagacatctcaagttagtacaaataagaagacaaaccaacagaatcaaggacaaaggattggaacaggcatttcacaaaagggtgaaatatagatggacagtgaacagatgaaaagatgttctctgtccctaataatgtatagcatcctcccacccctgccatcagatggacaaaagtgaatatgatttctagtactaatagggcatggggaaaagttactctcaaactattgggtctgtaagttagtattactttttgggaacgtaatgtagcaatatttattaaaatgacattctctggcctgaaaattctacttatgggggtttatctgatagaaatgtaaagaccagtacttaaagaaatacacaatgatattaattgcagcattatttgtaatagcgaaaaactagaaatgttttaaatatatgtcaaattattgtacaccaatccaccaattccacttctgggcatgtatccaaaggaattgaaattgtctaagaggtatgtgcagtcccatgttcattgcagcagtattcacaatagccaagatatggaagcaacccaggtgtttatcagtggatgaatggataaagaaaatgtatataagatacaatggaatactattcagccttaaaaaagaaggaaaccctatcatttgtgataaaatggatggatctggaggacattatgctaaatgaaataagctagacatagaaagacaagtagtgatctaaaatctaatctttttggggaaatctaagaaagttgatctcctagaaacagaatagaaaggtggttaccagaggctgagggggacagaggtgagagatggggaagaggaatggagaagagatgttgatcaaagggaacaaagtttgttagactagaagaaaaagttttagtgatctattgcactgcaaggtgaccacagttaataataatgtattatatatttcaaaattgctaaaggcttagatttataattttcttacaaaaatttaagttggtgcggtgatggatatattaattaccttgatttattctttctattctttgatttatttagttcaaaatatcacgttgtacctcctaaatgtacagttattatttgtcaaaaacatttatacaaaaattatggtatggtcacatttttacagatccaaaaatgaagaagtatatctgttaaatacgttgtcttgaaagctatggttatattaagtaaaaagttataaaataatatctattttgtatgaactcatgaaatctatataaacatacatatgtttatatatgttaagaatattcaactaattgtaactagcgattgggataataaagatagattgttggtagagggtggaggaactatatttctgaattgtttgaattactatagtgagcatagtttacttttgtaatttaaatgattgtaattgttaaaatttataagattatgttttgccaagaagtgaaaacaggaggctgccttaatctgttttgtgttgctataacagaataccacagactaggtaagttacaaagaaaaaaaattcaagtctcacattttgggaggcaacgaactccagcttcaaggtgccggtatctgatgcgagcctttgtgctgcattatcctgtggcagaaggtggaaaggccagggagggcaagagccagggactgagagggctgaacttgcttttacaacaacctactcttgggataaagagatgaatccattcatgagggtggagccctcatgatctagtcatctcttaacaatcccacctgttaatactgtcagaatggtaattccatttcagcatgagttgtgaaggggatattcagactatagcagtggttaaagtaataatttatcggaaaccctgtgtttgacttgtaaatgacttataaatgtgactcaaatccagcaactattcacagtgttctgtttctggtagtacaggttggagttatgtatctatatagatctgttataacttaagtaattatgaatctgtttttgtagttgagagctctaatttttagtgtatccaacactttgcttattacctttccttcctgtggacatgagctaacactgattatttcttttggaaacatttaaagatatctggcatctctctgtggtattcttgaagtgacttctttgagatccttattcataaggatatctttttagaagtcttctctgaactccccagtttaagtgaactgcttctatctccttactaccagtatttcccttgccaacttttctcagttatcgttcctaaataggacttattctgtccatttctactgctgttaccttagttcaaagctttgtcattttttgcttagataaccatagtagtctctgaattgatttctctgcttccagtctggcttccttccagtagagtccatacactgcaagcctcagtgggttttttgtttgttttgttttattttaattttccttaaaaaaaaaaaaacctcctcttgttttaacattttgttggtttctcattgtcagtaggacagcctcatgtcttgtcacttctttccttgccccttgcctgagatgtgcactttgcttgaataactcctgttcatcctttaagactctgggcaccgttttaaccatttaatgtaagtctacctgacatttttttcctgtcaaatgagaaaggtttgttgtctagtttttttttcctgataatgataatgatatgttgccattatggaaaatgaaaacaatccagagataaagtaaaaattacctgaaatcataccacacagattaagactttaaaattccatccatcattaaaactttgatgagcaaagctatttcattctctttccctgaattaaaaaaatcgacatataatatgcataattttttgtaacctgttttgtcatatattgggatctcttttcatgtctgtgaatggaattacacatcatcattttaaaatggttatgtagtatttcattgtaatgaagaagccaaaatttacttaagtagtattactcggatgggtatttagagagttgttatcagtcagttcaaccagagaagcagaagtaccaggatatctatttctctctcgagccacacacacacatgcatgtatgtgcatacacaaacacatggcaaagaattggctcttaatgtggaggctggcaaagtaagtgcaaagcatgcaaggcgggcagtcaggagccgggggagatccaggactaagcactggcaagaccaggtactacctggagtgtctgatcccagggaggacttagacccttttttaaagggctttcaactgataaaatcaggccacttaggatactctcccttttgattaatgtaaagctaactaagtagggactttaattatatcagcagaatctctttatggcagcacctagattagggttagaaaagctaggaggaagtgtgtgtctgctacaaaatgacgttgcctctcttctcttcccaacacctggcggagaatatcccttgtagcccactttagagacatagtagaaagggaattttggcaagtgtattcagtgtaggtaagctgatgtgtcccaaagccatcacacgtgtgtgtgatttttgtctgttgtaagcagtgcttacgtaaacatatttatgcatctgttcagtagttttttggaatatattttttaaagtggaagataattttgaactgttcttttagcttaatatggaaagaaatggtaagttatgcttttgaatgaatagttgtttctctagatgatgatgtgctggatttagaattttttttttttttgaggtggcattttactcttgtcacccaggctggagggcagtggcacaaccttggctcactgcaacctccacctcccaggttcaagttattctcctgcctcagcctcttgagtagctgggattacaggtgtctgcccccatgcccagctaatttttatatttttagtagagatgggatttcaccatgttggccaggcttgtcttgaactgctggcctcaagtgttctgcctgccttagcctcccaaagtgctgagattacaggtgtgagccactgtgcccggcctagaattttaaaaggataaaaatagacctggatattattaaaaatagtttaaaaatattttataacctgtatatttgttttcactttttttaatggagagatttttcaatacattactcacattttgtttttttaattttgttcttccagtcagttggttatgaatatatcataggggagggttgtgtaatcccatttgggctacatgacggcatttggagcagccaaaagggtagagtacttgggtggacaggcctaactcacttgcccatccctgtgccaggagtggctccaggtattagggctccacagtgccaccagatacacaaaagaagggagagaggtgttgagcactaaacagcagaaattggctgcagtgttgattgcttccttcacgttgcttttacactttctatggattttgaagtgaaaggtctaacctgggttcttattcagctacttcctagctgtgtgaacttgggcaaattaactgcctttttaagcctgagatttctcatttgtaaaatggtgaaaataataatgtgttactttaaagatacaattttggtaaagctttaaaaatttatttgtaaataacagataatttaattcaataatatgaagtatctacatacagttattgcagttattaaaattacttagtaatgtatcctagaataatttgttattccaggatgtttatttcaagatatatacatttgatatgctccagccatgtttattttcattataaaattgaatcttggtataggtcatattggcggtctgttaattagaattgccatagctggttattgataataagagtaagcttttgagctactgtgttaaatgatttatatacgtaattgctaataataacaatttggtcttgttaggtattttgtggataagaatactgaaactcagtataaaggttaggaacaaggtcattggagtaagagctggagtaagctcaaccctgcttcttgttggcaggcctttctagtcctcagtttcctcatttgtaaaaggggataatatatttataatgtatgtcaagtatctagtatagggtggtagataataaatgttcagtacatgttagtttctattgttacttttattgcccaagagcctttcaccttatagtaaggggtcctttgaggatattaactcttaacatgtagtatcccattaccattttggacagcagaaaatgcccaaagtattcttacttttctttactcatataccatcttttctgatttattactccaccggtgccttgccatattttaagcacatcagttagtttcatcatactataatttattaatcttttgaaataagaacaatatctgttctgttctttatttagaagctcagtaaactatataaaggatgaaaaaagaatggtcggaatattccatttatctcgttgtgggcatttgggtgcttaattatttaaatttattaataacttcatttaagcagtagcattaatttatagtatgagctaggaaagtagttttgcagcgttccatggaacccatatgtacgcatcttgaaagtgtgattaaaacaggtatgtttttaaaaatttgtttttatattggtaataaagtgttttcattccatccctcctcacatgagtactggggaatctggacttgaaaagcattcagaagagttccagaggctaaaggaagtagaaaataaaggtttaaaggcttttgtaatatagaagtgatgctattgctcacaatgaagaaaatgatggtaaaggcttgtatatccatgtatcagaatatttaatgatgacagttgcaacagataattgaagaaatacaatgcattaaattcatttttctcttttttgagatggagttgcgctcttgttgcccaggctggagtgcagtggtacaatcttggctcactgcaacctccgcctcctgggttcaagtgattctcctgcctcagactcctgagtagctgggattacaggcatgtgccaccacacctggctaattttgtatttttagtagagaccgggtttctccacattgttcaggctggtctcgaactcccgacctcaggtgatctgcccaccccggcctcccaaagtgctgggattacaggcgtgagccaccgtgcccagcctttaatcttttgctcttgaaaataaagatattttgttatttttactcagtattctgaggattttccagtattgaggaaggcactgaggaattattaaaaagttattggaccgaccgtcacgtttaagagaattaaaaaaaaaacatattagtcatatgaataatcttacacagttgtgcttatgaccttgaagatacgaagctgagattgaatggtgcagatggtaaagcaaaatagtgacaaaataggttatacttcagactagaggcaagatatagtttattgacagcagtggatcctgtattttattatactgtattgctgaataggttgaaactggtttttttttttttttttttttttttttgagatggagtcttgctctgttgcccaggctggagtgcagtggggtgatctcagctcactgcaacctctgcctcccaggttcaagtgattctcctgcctcagcctcccaagtagctgggattataggtgcccaccaccacacctggctaatttttgtattttcagtaaagacggggttttaccatgttggccaggctggtcttgaactgctgaccttatgtgatctgcccgcctcagcctcccaaagtgctgggattataggtgtgagccactgcacctggccaaaactaaattcttaacagcaatattatgtaaatttttgaaaactttgataataagatcccttcagaggcttgttttctgctaatgaaatagttcataggctgtaatatgagttttaatttacttaatgtggtttattaacattttatactctgaaattacatgatttttagtttttaacttaaaagattttggtgatgggtgccccataaaatttgtcagtcttatttctttgaagacttttgagttattaacgttagcccaagcttgccatattttggtgaaaattgaaagaaaacgccaccaaactttttaatatttttcaaacatttttgaagtttcttgataagcagttatcagatggactgaagatatcaaatagagatgagatattgaaaattcaggcttctcatttttttttcaaagacagaagttataatattcagtaaatccagctatagacattcatatatagaagtatttgccttgccagtaaaagggatgcatgctttaattttttattgctttgtaaatgatcctctcctctattcttgaacacttttcttatttttgtacgctctataaatgaattatggttttgaacttttttacatcagtaataaaaatgaaatttgattggttggtaataaagaaggttcttttcataaaagcaatcattttgtcatgacaattctcgttaactgtaactgtgttggcaaaatagaaaccataaaatgcatttcactgtttttatacacttagctatgtttttttgctgatcatatattttatctctaagaacttgtataagccaaagaatttcttcataacttgatctgtctttagatggaaaaaaatagacttttgatgtgtatatttattacagtggatacagtatctttgagtattacaatggtatttacccccacatcatattttattacctggtcaatttagagcactaatcagaactttatatgaataaattgtgtcatttgtataacatgaagaggccattattattccagtgtttatttctgtaaagtaatattggcagctgactcaatgaactagccttcttttgacctccatttcttttgattgttagcttttatgttatagaaaaatgttttggcattatgaattataagtaatgtttctttcttattttataaatttaaaaaaagattatgtctttatgagaaataccataaaaataaaagttgctatctagttttttgttagatgctatcattgttatttttactattactgttattactgttcatcgatttaagattctaagttggctagtccaggagaactagttacataatgttaactatttaagtgataattgacatttgttcttacattgagattgtgaattatttttgatgtattttctccctaaacagttttctcctttttgccatctacgtgcactgattttctcatactagcatttggtggctgtttggagaatataaaataattttaatattaaaataaatatttagaaacggtgctaatgtgtgagaaattacagagtgcagattatagacaaatataaactatgctttcattatttactgttttagattatctttgtatcataggtaaatgactattggtttgacttttatgaaaagatatagttagatttgactttagctagagttgtttctctcttggattctcttttgtttcctcaatctgtgaataatgtagcaactgccatttaggtcagtttttaaagatggatgtaagccattctagtcactgggtaccaaatcctggggactagaggccagggagtcagggtgatgtggtcagcaaattggagatatagtgagatttcaggaaggcaaagattcaagatattggattaataaagtgaaactgtagggaaagtgcaagtgtcaaaatctatgtctgaagcagtaaagggaatttataaacgtaatatggtcaggagtcagcttggtaaccgatttagataaacggaattctgaggcttcagatgagtcaacattttgtgtgattaatagtaactatcaaaagtcttaactggcaagttacttttgcagtgtaacaaaccaccctaaatttacaggtgtaaaacagccactttcttatgtttatgaatcctgtgggtcagtaatccacacagggcacatgttgtgagtggcacaaggtgagatataaccatatccacacacatttgtgtctttccacaaggtcagacttctgttggtgcttattcagtcataaaagcaataagcaacatcgagttccttaaggaggcaattctccttagtactacctgttcactcagtagtcagagctgtggcacatagactaagccaatccacaagtcagtcaatgttgcaaaccgcacgtagcagtatacttaatatataaatgttatagattaaaatttccacatcacacagtaacatttaacatcaagagaaaaggggacaggaaaagaggtaatgaaccagtctaaggagagcgtcatggacaaggatagtgtcctgggctgatccagacagttgtcagtgtcttgcaaggaagagttcttgatttgggcagagcatttggcagcaaatgctgggtgctgatcatgagtgactgccagacagtgtctattaagatggccatcttgagttggtggagttctgctccttttatagccctcacatcttctggtgaggactgatagtaaaaagtgtgtctggttatgtctttgtctggttggtacgtgtagtctctgttgattagatgaacatgtggtccctgttggcatgatgcctttttaaatgtaaggtggggtctttttctaagatagggttacttatgtatagggtgctgtatacagcacaggaaagatggtttgtctctcactcatgatgtctgggtcttaagctgaaaagactcaaaggctgggaatgatccagtggttcagggttggaaacctctggaagcatcttcacttgtatctctgacagttgattctggctaggactttggctggggttgttctctggaatacttacatgtggcttcttcatgtggcttggcttcctcacagcttggtggcctgagggtagtcagactttttatgtagtgactcagtgcaccacatacaagtgcctgagctagcaagatagaatttgcatcatcttttataatctactctcaattgtcctgcagcatcacttccacaatattctgtgggtcacagtgccagcccagattcaagggaaggggaattgtagggtaggaattactgttgtggacgtatttaagacatatactttgccacaataaccaaggtggtactgcctgtttttcttagatctgggaaccgagaaggcacacacatgactgaatagaggttctaaagaaggatggggatagatggggagttgggggtgagtagagtagtgcgggtggttttgtacgttgtaattagttatctatggaactctctaaagctagtgatgcctgctcgaacatgcatgcatatacaaatactcctttattctcaccaaaggcctatcatatggaaagattgaggatggagataagacaagtatagttttcaaatactctgtagatcatttgtctgtgtgtctttgattaggaaccactgaatgattcggagagaaagtgaattcttgagtttacactgttgaatttggtacccattgttgagatgttatccttccttaaattggttcaatgatattatttttagagttacagtagttttttttttttttttttttttttttttgctgtcagatatctttcaggctttagatagcaaaagacctgcttgtattttctgcagaatgtttgttgagtacctaatttgtgctaggtgctctgccaggtgctgggggtacaaaaataagtaacaattcttgcctttcatgagcttatattcttttgcagaaatagatcattttaatatgaagagctatatctatagtagaaatctgcacagaggcatctagtttagtaagcctttgctgaacattttgcctccgtttcctcaaactgcattagggatgttaggtttttggtaaatatctaaactcgtctccatgcctcctaccttctatctggcatgctttggattatttttttggatccaattcagatttcatctccttttgtgaattctttcctgttttcctcaggcagatttagttatttcttcatgaatatttctatagggctttatacacacttttgttctaatgtgtatattaagaattattgattgaaaatatactgtgagctagagactttatagggtacttagtttatctacttttttttttttgtttttttttttgagatggagtcttgctctgttgcccaggctagagtgcagtcgcacgatctcagctcactgcaacctccatctcctgggttcatgcgattgtcctgccttagcctcctgagtagctgggattacaggcatgcaccaccacacctggctaatttttgtatttttgatagagacagggtttcaccatgttggtcaggctggtctcgaactgctgacctggtgatctgcccaacttggcctcccaaagtgctgggattacaggcgtgagcaatcacacctggccaatctagttttattcttccaataacccaacaagataattaatatttccctcttttacagtgaggtaattgagacaagaataggttaaccagtttggccaacataactcacacaataagttgtagaattgggaggggaagccaggtatgtgtgactctgaaatgtatgctttttccctacaccacctgtatttgcttaatgtattttaaatggttatgtttaccttagtcacccctaatcccacctccctttttgttcttcacctgctcaacaaaattagatcctagagggcaatgacagttttatattcatctttgtattatagttgtgggtacattttggatgtttatcacctatttgttcatttaaatgcctttaatattttttagggggaatcctctgagcattttctactgtgttctcatactcttaaggaaattcttgaccgttacctcatttcctgtttccttcttcttggagaatcttgcagttttgtcagcatttcaggtggtataataataagtcagattctctgtgggggataatttgttctataactagctgggaggagtgaaggaagaggaatagagttttttggttagctagcttgatatgagatagcaaagtatatgtacagtacctggaaccataatcacatagtagatacttaaaaacataggtgctgacattacagtgattgtatttggtttagatgggaagaactacttagtttgaaggatatttgttttctgtctctagagttagatttagagaaccattaaactattgcactgtgaaggttaatgttgttgaggtctcacagttgtgtggggctgtttttgtatctgttttttggccagatggattagacttttactcttaaccagctgtttttctatagttctgctgttgatctcatattcatttttagttctgagaaaaactcatagtatcagtgcttcttttttttttaaatttcagattaccattttaaaaatgaaaaaagtttgagtaacaattacaagactcttctgttaatttatcattatcatatgtagttggcctgctttttattggaaattaatgaaaaataatggatttttttcttttttttttccttttctttttgtgatggggtcttgttatgttgcccaggcgtgcctcaaacttctgggctcaagggatccttctgcttcagcctcccaagtagctgggactacaggtgcacaccaccatgtccagctatgatggattatttttataatggatcaaagtctaaacataaccatttgagaacatgacacatacatacttattaaggaagaatggaaagttttaaatttgacttatatttatttactttacctgagttattggcttgttggtgctgtgaatttgttttcttgacccttgttaacctctagaagtttgtcaggtttacgaaattggtccttgaataccattttgaaattgatctctagtcacagatagatatcacaactgatattcataattactaacttatttttactttccttatcgaatacttctaatggaaaaactatcatgttaccactttgattgcaaaataaatgtggcctgagttcattaatcttaaaggcttattcttgaacattataaaatagcaacatgttactaaggcatgttttaaaacatggctttaagccatagccacaatgcttaaggagaaaaagatggtcaaaaatcttcttgaaaaaaattaatctacacacatccttactaccattttctctgagctaaatgaatgaaagataaaaagaacataatcttatctcaagtgccatctgtgtctctaggatggtctttgttgtggtgttcacagaccatctgcatcagatttaccaggattgcttgttaaaggtgcagatttttggtcctcatctctacagtatcagaactcctgagtttaggaaatacataactttatcaagttcctcaagtgtacaggaagagttgagaactactgttgtaagataattataattgctttaattctaataattactacccaagaatgtttatttgtgagctctgcaggaggttagctaatttagttgtgtgttcactgactgtagagcaacactacttgggttcaaatcctggctgctgtcacttactagcattgtgactttgaacaaattacttagcttgtgcctcagttttcttattgtaaaattgggaaaataataatagtgtctacctcataaagttgtgggatgtttaatatatgtcaagcacttacatgtacagtaagtgcaataagtcttttaagattttctgttcagctttcttgagatataatttacaaacccttttagatttataattcagtgatttttagtatatttacataattgtgtgactattgccacaatctttttttttttttttttttagttttccactcatctctgcagttaccacagtctaacagtaggtttccatcacctccaaaagaaactccttgcccatttacagccactcctcattcccaccaccagcctgagtcaaccactggtctactctgtttctgtagatttgcctcatctggacatgtcatataaatggaatcatatgttttcttttgtgtctggcttttttttttttattgggcataatgctttttgagggtcatccatgtattcatgttgtagcatgtatcagtacttaacttggttctttcttattgccaaatagtattccatcatatggatatgctgcattatgtctgtccattcaccagttaatgaacatctgggttgctttcctttttgactattgtgaataatgctgctatgaacatttgtatataagtctttatttggatatttatttttatttcccctgggtgaatacataggagtgtaattgatgggtcatatggtaaaattctgtgtttaacattttgagaaattgccaaacatttcatggtcccatcagcaacgtgtgagaatttttgatttctccacatttgctaaacatttgttattgtctgtcttgttgattatgaccttcttattgggtgtgaagtggcatctcatggtggttttggtttgcatttccctaatgactaatgatgctgagtatcttttcatgtgctttttggccatttgtatatctcctttggaaaaatggctattcacattccttgctcaattttaaaaattgggttatgttgtctttttattatagggttgtaagagtttctaacatattttggatatatgctgtatgagttttgcggaatcttaattgctgtcgttatcataatcatcatctgcctaaatagaagtctagtttgtatttgaccaggagatagattctagttattctctagttttatttgggctccagctttggttgtgagagggaagttctgccttcctttttctgtgttttcaatctttgttgctttccatcttgtgcttctagaatggcagggtattaagacccatctgccttgggtattctactgtcctcattcattcattattactcactctgagtcttttttttttttttctgagatggagtttcgctctggttgcccaggctggagtgcagtggcatgatctcagctcactgcaacctccgtctcccaggttcaagcgattctcctgcctcagcctcccaagtagctgggattacaggtatgcaccaccatgcccggctaattttgtatttttagtagagatgaggtttcaccatgttggccaggctggtctcgaactcctgacctcaggtgatccacccacctcagcctcccaaagtgctgggattacaggcgtgagccaccatgcccgacccactctgggtcattttaatcttttgcttactaccttgttccaaatgaatgggttgctggagatagttatttgtggaatattatttgagttatttgccgtagttcagtaaattggaattcatttggtgttttagagattatacactgtcgtgtatgtttttttcttgttttttgtgtaatgtgtagcccaaacagaattaagccttgttatatgtataccagataatattgtcataatgaggtagacttcagtgtttttaacttcagacattgtaaaggtacacataaggagataggccacatgatacctctaaaatagaagtgccttatgggcagttacttggttttctttataattgtgcctttagctcttagaatggtgcctgacactttatatgcattcaatgtatttattgaatgaacgataaaactgatttgtagctgtggctaaatttactttctgaagtaagatgtatgtataatttactatacatatttatatacactgagtatccccaatttgaaagtccaaaatctgaaaatgctccaaaatccaaaactttttgagtgccaacatgatgctcaaaggaaatgctcattgaagtgttttggatgtttgatttttgggttagggttgcttaactggtaagtatataatgcagatattccaaactatgagaaaaatccaaaattgaaacacttctcgtgtcaggaattttggataagggatactcaacctgtatgtaacaagcaataatggatatacagtagactcttatgtcagtcaacaagtttctttttcctaaaaacttgtgatgatgtgtagccaaaggaatagttctggtctgaatcttcttctagaagaatcttctagaatctaggacttcttttgtatttgtgtctaatacttctctattttgtcctagaatgtttgctttctgcttcaggatttctattttaattgaaggtagtctatatctttgtatctacacctgcttgcaaatgtgttttttaagtagccttaccactgtgctatgcaatactgactgctttttttttttttttaacgtttatggaaatggcaatatgacgctgcacttccctgttctccaacacaagccattttcttacataaacactgatctctgactattaaggtaatgggaaaatggttttaaacaccttttgtgggaagagtcacttctgcttacacatcctgtatcgtatcattaaacattccctatgaaacactagctaaggggcattactatttaataatttcatgaccatcattatatagtgttatttttgacttgcactatagtttgcaggttgaattgctttcgaatttaatatatagcccttaaaatttcagttttgataaagtcccatatcatcatattttaagtctaaacatcttaaaaatctattttaaatgaaaccttcatatattgcctaaaacttgatgggttttgagtatggtgtctatgttatcactgatatcattagtataatatttatgtcaaattaacaaatttccttcctttctttgtgtgtcttgcagtaacttgtccatgtttaagagctgccgaatgctctttgaacattttgttatattagcagtatttgcatttacaactttggcaggaagccatccaaatttggagataggctacccatgtttcttgctccttttatataacactgtctaaatagtcttgctgtgctgaagagatgacatctatgagcttttggaatctagttgcctaaggataaactgagtttgacttcattagtgcacaaatgataggtttgtgtagagttattatagcattaatcaatttgatggattggaaatatgacagaactgaagcagcatgtaatattagtgcctattattctggaaattatgtcttcacctacattcatgtggcagaggagtcatgttgtacatcaagaaggcagaacttaaagaaacaaacaacagagggcatctcttttcatggcccttctcttaatcctcttatattagatcatcgagagatggacctcagaattagactaattttttttaggtcatagcactttcatactttgaaatacgttgatttgaatggaataaatagatacataatcctaacctaatatttaagagaatactacaagtaatatataaagtctttaagagacttacgggtatacttatgtgaatttattggttagcagtcatttcattaaaaatgataatggattaatagtaagaatattgttttttttgtattggttgataaagcttaaaaataggtaacttaaagataattaaaatgaatgagaagcaaatacttatttttttgggtcacgggtgttgctttatcatgtgtgcatttctaacatttatgcattatttattttatggctttcagaagttcaagaatatgtgtcacttctttttgattttactttgttctccaatgtaaatacttatgagtttctttgagaaatattcatttgcataaaaaaaactctcccactaaagcctgaaaccttaagcagcatctcttttgctcctggtaaagaagacactaaatatagaataatcagggcctgggcaaaattgggaagtaggtaaagaactaactggacttttaataactaattggatatgcacttagttatgaggtgctttgatatttgctttatttctaggtattctttttatctgcagtatagggatatatttcttctttataaaaatgataaaaatttattgcatcttttgttagagaatactattagaatagtaattctaattttaaagggtgaattaatgtaggtcactaggagtaccttagagtaagttattgctttggtatgaaagtggtacaggaatttctttatcatgaaataattaatttctaaaaggtgggtagtttaatttagaactcttataatgaagatattagcttaaatgatgcctatataaaatttaatcttggttaatttaaatttcatattttggcatgtattattgtagatgtcatcttcagtttggagtaattgagaagccaagtttttaataaccttgggaccacaaggaatttttcacattctaggaatttacctactagaaagagaaataagatattgacataacaatatgatagagtagaaaatgatatataagaaaaatgcagactgctatggacagtatagataaaggagaaattagatttgcttagtcctaaaagcctttttgatggatgtggcatttaaacttggttgagaaaggtataggatttgggtatatggcagtgaaggagtattctgaacttaaggggaacaatttgagcaaagtcacaaagatgagaaagtatgaagtttgtgggggaaatttgaagtactctggttgatacaagggtcatgttagggaggtagtaggcagggatccccattctcctcactaattcatgtgtgttccccccgcaagctttctccttggtcaaaaaggatgattttatcagaagagagcaagactcttccttgctctagagtacatgaatgactgggtttcctgcaaaaacttcaaataagtagttatttaattagaacggcattctccaatgtgggatgagatgtatgtaggagcaaggggtgattactgactttgtctgaccttgggaaagagaagagtagagaagaagttgtccttttggattttgtcttttcccaaaccaagagatcagctttttataaggtgtggataataattctcatgattcatagatttacatatgaagacagttatagagctcatttcctagaatgatacctacatggttgatttgtagattcattgcccagtttaggatttcaactttgggcactcctagggaataactagtttttttttttttttttcctctcatgtcatgctttacatgtaatatgtgtgcaagacaaccctttgaaatacaggaagaaaaacataaattaactatatatttcttacctttgcactaacactaaaactggaaatctctttctatacaatgttttatattaaatatatagtttacatcagatgttactgctgtatcactcctcagttcagcttatctgacaaacagtctcactcttcccctttccatttcctatgactctaacccaagaatcaccatttatgaaaatctcatgtccttatcaataaaaatttgagcatgcaggcctgaatttagaaatcataaagttgttaattgctgagccgatatatcatgcacattataaaacatacactaaaaaagaaagtagagttaaaaaagataaaattcaaattccaggaattttaggcagctatttagtatttttttgagttgtgttgttggttatagtgttgaagttgtttgagtaaagtttattttattttttatgttttgccatgaatttttcttatcttccctgctacattcttagcctgaatagtacagagtaataacaacaatgatgatagtgctaataatgaaaacagatgtttattcagcaacatttactgattacctgctatgtgctaggttctagggatgaaatggtaagcaaaaatcagacgtgaatgctggattgatggtgcgtattttctcatggagaagataaacaaatacttaaatgtaaaaatacagacggggagtgcatgctgtaagagcttgtaaaaggagtgtttgaactattcaaggaggtcagcgaaaacttccctgtggatagaactggctacataatttttaaggcccagtgcaacatgaaagtgttaaaatattatccactttcaagactgagacagcagaacattaaaccaagcagggggcccttccaagtgcagaccttatgcaactgcacaggttacacgctcgtgaacctggctgtacctgaggaagtaatttttgagctgagatgtgacaataccataggaggataaaattgttccaggcagaagaaactgcagtggggagagtggtgcattcagaaactggatgaaggccagtggggctggagtgcagagagtcaaggttagggatgtgtgtgtgatgaggtaggctgatagagagggtaacttgaaaggctaagtagagccctgtaggccatgttgaggattttggtctttattccaagaaccacacataactattgatgtgtcttaagcataaaatttacttttgatgtggtgagaataccagtaacttgcactttgacagcattggacaactttcttcctcagcctccatttcttaccaaccccttttttagaaactttcagtctcaccttctgtgtttattctaaggctgtcccttcctttaggtgtgtttaaaatggcacttcacaccagggtgatagaaactgaaaataggtagagtaggtgagtcatgacattttatttactattgaagtagtttgtggtctaaaacatttcaggtcaactgaagaaaaactagtaaaatataaaaatgttttattgttgttttaaaatgactttccttttaaaatgccacagatttttaaaatgtatattgtcagcatcatgattttaaatccttaatctcctcttttacacatgctcaggagcaaggggtgattactgactttgaccttgggaaagagaagtgtagggaagaagttgtctttttttgtcttttacataataggtattcccaaaccaacaaataagctttctttctgttagatgtggataataattttcatgattcatagatttacatatgaagacagttatagagctcatttcctagaatgatacctgcgtgattgatttgtagatccattgcccagtttaggattttcacttttggcattcctagggaataacaaactagagattttttttctttcatgtcatggtttacatgtaatttacatacaatttatcctaaaaggttattttttcagtaatttgctgatgtcagcttgtttttgtttccttttatttaaaaaactgttatacaagttaattgggttcttattgaaattttactttgttaaaagttgacagcaaaataaattttgtttcattgctgtgttggtatgtgtgttgaaattcagtagcccttacgtatatgtgtaatattgtgtgtaacagcatacaaaactatgtgtagttcattatttacttgatgttttcatggcattatctctaaatacgagtttaattttgtgtagcccaaaccaaaataaacctaaaagtcacatttgttatttattgtaataatactgtgtttttctttttattctaaagcataagtattctaaagcataagtaaaagcaaattaaggagttctttttcccactccagggattgctttagaacattttaaatgatcagtcttaagaaaaaaatgcttcacatgtataaatttcttttaaaaaatcagccagaattacatattaaagttatttgttgctatgtcacagagactaaagtagtataaacacaattagaaatataccagttactgtgtaattatatgagctctgtcactgatacagtttggatgtttgttccctgcaaatctcctgttgaaatgtaatccccgttgttggaggtgggtcctggtggaggtgtttgggtcatgggggtggatccctcatgaatggctcagtgctatccttgatagtgagttctctctctgtgttcacatgagatctggttgtttaaaagagagcggcatctcccccccttctcttgctcctgctcttgctgtgtgtgacacctgctcccccctttgccttctgccatgattgtaagcttcctgcagctctcaccagaagcagatgctggcaccgtgtttcttgtacagtctgcagaaccatgagccaaaataaacttcttttctgtataaattacccagtctcaggtatttctttacaacagtgccaacagcctaacagaatcatgtaggtgatgcacttaagtcagtgatatttatattctctgagctgctcataggtaagataggcagctgttcattctttgtatactctaccatttcttgtctactgcatgataaactgcaattcctagctgctggctatatgggtttatatcagtctacttgccttctctttttaaatcataggttctatttgtgatgaaaacactggatgttttggtagagttactttctgagaatttattttcaataatgatttctgagttgaaacagagtttatgtcttagattgagtgaaatattcacccttttcacctatttccagctttagattcttaataagagagcttttggtatttgtaggaagcttctttagtcttatttgcagtgaagtaatatgttgcaaactttctattactttcatatttgtcttttggatgagatctggagaatccatgggagtgatgatgaattaactttttttttttttttttttttcctaagacagagtctccctctgtcacccaggctggactgcagtggcgtgatcttggctcacagcaacctctgcctcctgggttcaagcaattctctgcctcagcctcctgagtagctgggattacaggcgccagccaccacgcccggctaatttttgtatttttagtggagatggccatcttggccaggctggtcttgaactcctgagcttttgatccacccgcctcggcctcccaaagttttgggattacaggcgtgagccatggcacccagctgatgaattaacttttaactgaaattactgaccacataaattgctgttcatataagaactctgttacattacagagtagtgaagtagcttctgatttatcagagaacacttaaatcatattcagcatatgtttaatgctagtgtatgtaaaggttggtgcaaaaataattgcagtttttggcatatcgtttgttggattcttctttgtaaaagccagaaaacatcagaatcaccaattttaacacagtaatacaggtttaatacagtttttggggaaaaacggcaatacttttgcaccaacctaatacttaattgttttaaaaatttgtaatgcatgcctagtatgtgcacaaaatagctaactaagagttaaaattaccacaattttaaattagaatatcctgttaccttaacatagatgataatattgagtaaaactttaattagccagcatgtttagggaattaaatggtaggtttaatcaaatatcttctttctttctacagacaattaacatcaactgtatgcaaatcgtagtacagtgtggggtacacagatgcatatgacacatctgtgcctccaaggaacttgatttcaatatttattctttgaaattttgtgaattttattactatgctttattgctagtaagattaatgtaatgcatataattgaatctttgatgatttagaattttataacgaatctcattgtattgtttttagtatagatgtaagcaatataggtgtgctgaccatacaatttatcctaaaaggttattttttgagtaattggctaatgtcagcttgtttttgtttccttttatttaaaaaactgttatacaagttaattgggttcttattgaaattttactttgttaaaagttgacagcaaaatattttgtttcattgctgtgttggtatgtgcgttgaaattcagtcccttacgtatatgtgtagtattgtgtgtgacagcatacaaaactatgtgtagttcattatttacttgatgttttcatggcattatctctaaatacaagtttaattttgtgtagcccaaaccaaactaaacctaaaagtcacatttgttatttattgtaataatactgtgtttttctttttattctaaagcataagtaaaagcaaattaaggagttcctttttcctattccagggattgctttagaacattttaaatgatcagtcttaagaaaaaaatgcttcacatgtataaatttcttttaaaaaatcagccagaattatatattaaagttatttgttgctatgtcacagagactaaagtagtataaacacaattagaaatatatcaattattatcaaatctcatatatttagttgctgagagcaaatgtagttatgttattaaaatgggtgattctgatgttttatggcttttacaaaggagaatccagcaagtgatatcctgatatcctatatattctgtcagtggagccattgcttcttaagtgcagttgattagacaaaattcaaatctagtacttttcccaaacactgggaggttggtaatattctctttgtagctgcagtcttctctggatgagagattaagggtcaagtcaagtttcatttcaggcctaaaattatctttactggcattatttcacattgtaggtatgtaatgcttcatcatgcaactttgctctaattgtgtttgtggggtggtgttggtagggtcaaggcaatgaaatcttctggaatacaacaggattcctctgtatttttaaatactgccagattgtggggaaagatggacagcttgatacagatatatttgattctttcttacaatgtctgcttgaaattttactttgttaaaagtttgccgtaaaatattaaaaatattatttcactacaattttttgtagtgaattaaacatcagtatctttttatacatatgagtaatatttaggatatgtctgtgtttgaaagaagctaaaggaattgtagcatatgagctattttgttttttttattctcattttggattgggcaaggtatcttcccctcttccccattaaaaaacaatcaccaaacaataaaccaaacatgcttttaaaacaagttatctaacctacttatacaggttaccatagaatctaagatagtgtgattagttgccatgtataagtcaaccttagcaaatgactttaaatgctgtaggcaaatgtacatgcttattaatttggtttgttattgatatgtttttgctttatgtgcctaattatcactgccttgtttccatagctgcagaaccttggcctgaaaatgctacattatatcagcaattgaaaggtaagtcttgttcacaattaaaaatggctttgtatcaaactatatttattacggaaaaatcctcagtaatacaatttactgcaaagagaatataaaatgtaaagaagggattcccttgtataatttgtctaggaggttttacctgaacttgtatctgccagtgtaaaccaactattcatggcctataaggtccttagtttattattgactcattatattggctgctgtaggcggtgtaaaatgatgtggttgcaggagcagttggcagatttactgcaccaatagctgagacagcagatttttgaagtcctgtggtaaagtgggctctcagtaaaaaggaactgttaaaatgtataggctaggatggttcaggctccctttagcagctcttcatatatcatcagatcacattatggaccccatttggggcttagcagcctgctacagttgtcagaagactgcaaagtaatgaagactaataggcagcagccctagtcttctaagcatggaatttttattgccacgaacttgtcatctttcttttgtgtgacggacctagacacactgtgcaatattaactgcaagctggttttatattattgtgaatgcttttacttttaactagaaaggtttcaccagattttacttaattttaatgaagaggaacatttcttgaaaacttgaaaaatgaattggattttaagtaaacaattttaattacattgctgataaaataagtgatcaaatagttttagaggaaactgtcctagtttatcattatttgtgataatttaatcaaaattataattatatattaacattgatataaaactttagaatttagtggtaggcgatacctttgaataaatagaaatactttttaaaaataaaaatactatattctacttggttaacatttatgcttcattgtatttccacaggggagcaaattttactttctgacaatgcagcttctcttgcagtgcaggtaaatatgtaaataatgtaatatctttttcaccccctaggtggtttgcatcattttgacttgcagttatatttttccccttccaaaatgtctgatactatatgtttagatttttttctgtgtgatttaccattatctatataacattgcttctttgtgaagaataattttattatgtaatattattcagttaattgtcagtatataaaataaacataaattttttttttttttagaaatcacttttatgtggtaggcacattctgtgtcttagcagttgttttgcttttggctggatatgatggtgttgattatttggggtgatatgttcatttgtggactcacaattattttctaattcgttaagatttatttatcacatatttttaagcattgttttgctcattgcactcattggcctctagcttttaatctgtttggtaatcctgtagcaatgttctggttctctagccactcctcatatatttattgattacatgagtgtttattatccccaaaccatttatgaaatgtaacagctcttcaagttgtatataacatttgtataatccaaaaaaaattagtgcccctgtaaactttaagctgcattataggaagaataggatacttggggatggtttgcttaaaaaacaatgtttatgatgtaggttatggaattatagttatccaaacattttgcatatttagctgccatttacttagcttgtgtagtttaacataggactgagcatgtagactgtatccactaaatgtctgttgtatgaatggtttataagtgtggtgaaagtagtcatgccttgataaccaatgtaaaagtaaatgatttgctgtgtataaaataatattttcaatctttatatctttggaaagacagtttgaaggcactgtgaatattttagttgaagcactgattcttaacccttttaaaattgctattttggggataaccctttcaggatctggcaaaagctatagaacattttaacagaaaatatagccaggctattctgcatgtggtttcagtaggtttactgatttccctgctgaagctatcgggatcccctaggaagagcccctaaaactacataatactagtttaggaagtgctgaagtaattttcatcaaatagaaaggtattttgggtaggaatagacagtggtttccaactgggcagctctttagtactccccctaccaccaccctgtgacatttgacaatatttaagtgtttttgctcgtcaaaacggttgaagggttgagtgctattctcatccattgggtagatgccagagatgctgctaaaaatcctaaaacatacagagtggtccctgcacaacaaagaattatccagccccaaatgtaaatagatttgtcaaggttgacaaaccctggaataggtgagttagccagttttcagtacaaaccaaaataccagtatattaccatttaaaaaaactaacgttttaaataacccggagaaggggggaaaaaataaatcttagtgtgtattttatttgttaattctatttttatgatttctattaatttgctttctcaaatcatagttgcaattaaaaataaaaccagaaaaaaggaccttttacaatgtagaattttccttaaccatttcaatgtttttatcctacatatgtcacttcgatgataaattacgcagcatatattaaaatttcttggttttcttcaatattctttggcttgacagctgatagtagccatgactataaatgtgacttttccagttatctgatataaactttatggagtaattttcttctatatagtgggccagcatttgtttagaagaatcagttaaaggcctacatttgatgtataaaattgatcaaaacaatgtgacaggtatccacaaactggattattttctagaagataccagatatcaaacatcagatattttaatagtctgccagttaggccattaggaaatttaaattttacttaacacatacacttggtgtttattatacccccaaaactaagtgattgggtctttttgaactctaagaacttttatgatttcagtttaaaaataatttttttttcctgtagctatttccccttagatttgctttccttcactcttgtatgttgagtatactgaagtattagtatagcatgtttctctggtcccttgagccgaatgtgtatatatgcagtattatacacacatgcacacactagagagacagagagagagagagagatatcttccattctgtacttgtgctttgaaggacttaagcttatgctgactggaaaaagtaactttgataataattctctgttactattctctgttacccccaaatccaaaccagccatctaataaatacacaatgttggccacatttgtgatttgaaattttctagaagcctcatttaacaaaagtaaaaagaaattggcaaaatgtattttaataatatgcattattttacccagtatatccaaatattattttagtatgtaaccaatacataatttattaatgggactttttatattaagttcaaaatctgatgtgtattttacacttacagtacctctcaatttatgctagccagatttcaaatgcccactagtctcgtgtagctagtggcttttgtgttagacactgcaggtttagaatacaatatgagcaaatacatatatgctctcaaaggttttggccaaattgttttatttaagaagtttatgtctattgattgagtatatgctgtcttttatagaagattccaattggtatctgtttcaaaaaacagcaaaccctaaatagagctctttgtttcaagtttgctcaaatgtaaaatagaaatataatagaagctatcctgttgggtaggataggattgaatatgttaacatattgaatgtgaggattgaatatgttaacatatgtaaagcacttagaagagtacctggcatattgtaaatatgcaatgaatgctgtttattacttctttctctcctaattctttgaaagaaatacacgtattcaatgttagtaagaggaatggaagcttgcagccttcatagtacctgaaaacactagagtaattgaaaacaaatgttatgtgtaagaatcttttttggacatgtttgtgtttgtgtgaacattaacttttgtatcattctttatctaaaaattaatattgaatgctttaatgcaaacaaaattttattgatactgaataatatattttaaaacagtatttattgaatacttttattgtataagacactctattgaaagcttttatgtggagcattgcgttcaatccttcccatgaccctagtgcacagtactattattatcctcattttaaagatgtggaaactgaagctcaaagatgcttcgcccacatttcatagaacccacaaattgtggagataaacagaaaacaacaacgacattggttgagtgccacctgtgcttgtcactgtgctgagctcttaattcatattaacccatttaatccttataacaactgtatgaggtaagtgctgtataaggtaggtatcataaataatcctttcacacagctaccctatgaggtaggtactattattattcctattttcctacagattaggaaggtaaggcagagaggttaaacagtgagctcaaagttacataaatagtatgtggcacagctggaatgcagacccaggaagtctggatcgacagtccacactcataacactttgctgcatattggtctagtccagtgataacagatattgaagtttcacctaacaataagtgatcatttaatcacaaattacttctgacatttcttagtaaattatatcttatgattaatagtttacattaaggagtaaaagaacatgtcttagcttttgtatctttgaaatgggataaagatagtcttacctctataatattatgaagctcaagttaggtaataaatgggaaattcttttgaaaaaagtgaaaggaataggaatgtaagatgtcaaatacagaattagtgcctattttgacttcaaagatttatgtacatattttgtgagtgtctttatataataaaatgttactttctaataagttttagaagtccaatgtgctagccgttgcacaacagagactttctagtaagttttagaaagaatttcgcttcatgtatgtgaagccagttttaaaaagctggtgttttttttttttttttgtatggcttaatctagatattataaaaatttgaatttgttttttagagtgtctcaaactgatgatcattattagaatattgcatgaacaagtaatcttactttgtcctttttacttcaagtaagaatagcatttaaggtaaagtgaaggagaatgttcttgttccatttaatatttttactttttcttactctttgttaataaatacttttctctaaaaatgaaagggaagacaacagaaaaaaactattttatttctgttgaatgtagtatataatttaaaagtcagcattttgttttgttttgtttttttgagatggagtctagctctgtcgcccaggctggagtgcagtggcgtgatcttggctcactgcaacctccatttcccaggttcaagtgattctcccacctcagccttctgagtagctgggattacaggtgtgtgccaccaagcccagctatttttttgtatttttaatagagacggggtttcaccatgttggccagggtgatcttgaactcctgacctcaaatgatccacccatctcagcctcccaaagtgctgggtttacaggtgtgagccactgcacctgaccaaaagtcagcatttttataggccccattaatgctgggccatgaacactcacatttcagatttgatgataaatacttagctgacccttgcattttccttttagcaaatgatgctttctagaaggatgtattaattattggctaatgctaatatccaaatgtagtgtttgggaaagggcaggagagaggaatatctgtctttcttttgaggctgcaggttgattactgccttagagacaaaactttgagtgtgaaaatacagctgctgtaaatttgtcttgtcatttaaatggccatagtagacagctacctgcagaattttagaggaaatgattttgaattttcagtttgattggatacattttgttttaaatgagttgttcagggttttatgccattttaaaggatcagtttaaacctgatgtaaatagaagtaggatgacatgagtggacatattttaataaataatataatattttatgaaaaagatttaaaaattgacaaaactttattaaagcctcataaagtataaagttttaggtttttaaaatttgtacattcctctcaatttgatcatcctctgtcagatgaggcttctgaattcactttcaggattagatgaaggaaaggaaagctaagggataaatagaatttagtgaacatttatgagatatagagacttgtaaagtccttttcagtattccagacaagcaaaatggaggctgcagatgtttctttgatatcactgagtttaaattcttcagactgattgtcttacattattatagtttgtgtgtcagaaatgttaaagcattttgctgatttatgctcataagaccttggattatttcagtatataaaatgtgatctttatcaagataattgtgaacttaaattgcaaatagaatttagcagattaaaaaacaaatctcaatattagtttctcaacacttaaatggcatggtgtatatacaacattaaaattaggcagtgtagaatttgtggaaatgaagtatattcaaaatagaattaggtggctataggagttgttgtttttagtaattagtgaaataatgtaaaatgtttttaaagggtaatggtttactgatataaatacgtatttaacttaacgaaaattcacactcctgtagttctgagagattgcaacttagaatatcagctgtgtacttttttgtttaaaaagtaaatagcaagcaggattttatagtttgttgctattaaacagaaccataaagatacagtagtaagatggaaaaacaacagcctttttttaaaacagaaaaaggctagaatttttcattattagatatacaatatcaacataatcaatctagcagcattatatttgagctgaaaatacacttaaatttgaggccatacactaccctgtgtgagtgaaacatctttcatatagttctaagatgaaattacccttgaatgaatagcatcttcatttatcttcaaaccccttctgtgcttttagtgaatctattctttgaacattctacaacaagaattacattatactgttataccagagtacttctgcagtgtgaaatagattggtttggaaaatgaacctggctttgctataaattacattcacaggtacaaaggaatttgttattttgtttaaaatagtcacaaatataattaaggtcttaatttatgttaaactacaaatatggctgttatggtaactggattaggaacttaatctgttgcgtcaagaatgatacctaacacttttcatttataaccttagataccttatttcaattacagggtctgcagctgtttgatataaaaatgaattattttatagatagatttgttcatggtttttaattttaaattgtgcctcttcagtaaggtagaaaataattcttcaattgtcacaaattttcctttgtgtctggttgaaaaaggatatgaattaaaattcacaatcatttttattttgtgtcctgaaaatggcattgcatgcttgcgagtagtcgttagtgaattcttacataaaatatttcaaatttaattaggaaataaatagaagctttgttctaaagaagaaaaacctgaggtctgctgtctaaggatagctttacctggttggactgaaaatggattgctacctatctagaatttgaataactttgttcatgtgacttacataaatttagaagctgtgtttataacgccttgaatctcatggtattaatcagtgtaaagcatctaatctttaaaaacttattaaaggcaattctttaaaattttgaattacttttatatttttattggcaagcaatgctgattttattgcttaggtgcaactaaagagagtgtgctgtgtatctaacttgaaagacaaatgttcatttttgtctttggaataaagaagaggaaagaagacagttggtgctggtcattggcaagtgtttcaatattgagttactattagttaattaaaaagaatatatgttccttccatctactagttcatcctaagaattttaatttttttgttattatttttatcagttgggaattttcttgtaagtaacaaaattttaaagcattcattataggagctcagaaaaagaatatatatattttttcgttttctccccaactgttcattgagtgctaactatgtaactgctgttgtgttaggttattgggttacaagaattgttctttctgtactttcgactattttataactcttgcttaattttgaccctacaactttatgaaagttgtaaacaagatagacatggtctgtatgtactaatgaagcttatattcttgggaggacaggcttttatccgttcatttattggttttatcagtgcgttatttatatgtaattatcacagggaaagcttatatctttctctattctaattgtctcttttgttgctttcagaaataacctgatttttttctatagctgtcagatgttgatgtatctaaaattgactcaaatattccaggagtagtttctaggtgagagtttcattaaggaaggtcagtctatgaagtgatatgtcttcaaatgttctctcaaataacatttcatattttttggtaataaattcactctctttaaagctttttatgcttattgaattgtggtttctgatttctacatagatcattattattattttttatactttaagttctagggtacatgtgcacaatgtgcaggtttgatacataggtacacatgtgccatgttggtttgctgcacccatctactcatcatttacattaggtatttctcctaatgctatccctcccccagcacccccaccccctgacaggccccagtgtgtgatgttccctgccctgtgtcgaagtgatctcattgttcaattcccatctatgagtgagaacatgtgtttggttttctgtccttgtgatagtttgctgagagtgatggtttccagcttcatccatgtccctacaaaggacatgaattcatccttttttatggctgcatagtattccatggtgtatatgtgccacattttcttaatccagtctatcactgatggacatttgggttggttccaagtctttactattgtgaatagtgctgcaataaacatgtgtgcatttgtctttatagtagcatgattcataatcctttgggtatatacccagtaatgggattgctggctcaaatggtaattctagttctagatccttgaggaatcgccacactgtcttccacaatggttgagctaatttacactcccaccaacagtgtaaaagcattcctatttctccacatcctctccagcatctgttttttcctgactttttaatgattgccattctaactggcatgagatgatatctcattttggttttgatttgcatttctttgatgaccagtgatgatgagtatttttttcacgtgtctattggctgcgtagatgtcttcttttgagaagtgtctgttcatatcctttgctcactttttgatggggttgtttttttcttgtaaatttttttgagttctttgtagattctggatattagccctttgtcggatgggtagtttgcaaaaattttctcccattctgtaggttgcctgttcactctgatggtagtttcttttgctgtgcagaagctctttagtttaattagatcccatttgcctattttggcttttgttgccattgtttttggtgttttagacatgaagtccttgcccatgcctgtgtcctgaatggtattgcctaggttttcttctagattttttatggttttaggtctaacatttaagtctttaatgcatcttgaattaatttctgtataaggtgtaaggaagggatccagtttcagctttctacatatggctagccagttttcccagcaccatttattaaatagggaatccttttcacatttcttgtttttgtcaggtttgtcaaagatcagatggttgtagatgtgtggtgttatttctgagggctctgttctgttccattggtctatatctgtgttttggtaccagtaccatgctgtttttgttactgtagccttgtagtgtagtttgaagtcaggtagtgtgatgcctccagctttgttctttttgcttaggattgtcttggcaatgcagactcttttttggttccatatgaactttagttttttccaattctgtgaaaaaagtcattggtagcttgatggggatggcattgaatctataaattacttcaggcagtatggccattttcacgatattgatttttcctatccatgagcatggaatgttcttccatttgtttgtgtcctcttttatttccttgagcagtagtttgtagttctccttgaagagttccttcacatcccttgtaagttggattcctaggtattttattctctgtgtagcaattgtgaatgggagttcactcatgatttggctctgtttgtctgttaatggtgtataggaatgcttgtgatttttgcacattgattttgtaccctgacactttgctgaagttgcttatcagcttgagattttgggctgagacgatggggttttctaaatatacaatcatatcatctgcaaacaggaacagtttgacttcctgatttcttaattgaatacccttcatttccttctcttgcctgattgacctggccagaacttctaacactgtgttcaataggagtggtgagagagggcatccttgtcttgtgcgggttttcaaagggagtgcttcccatttttgcctattcagtatgatattggctgtgggtttgtcataaatagctcttactattttgagatatgttccatcaatacttagtttattgagagtttttagcatgaagcactgttgaattttgtcaaaggccttttctgcatctgttgagataatcatgtggtttttttcattggttctgtttatgtgatggattacctttattgatttgcgtatgttgaaccagccttgcatcccaaggatgaagccgacttgatcatgatggataaggtttttgatgtgctgttgctggattcggtttgctaatattttattgaggattttcgcattgatgttcatcagtaatgttggtctaaaattctctttttttgttgtgtctctgccaggctctggtatcaggatgatgttggcctcataaaatcagtttgggaggattccctgtttggaatagtttgagaagcaatggtcccagctcctctttttacctctggtagaatttgtctgtgaatccatctggtcctggacgttttttggttggtacgctattaattattgcctcaatttcagagcctgttattggtctattcagagattcagcttcttcctggtttagtcttgggagggtgtatgtgtccaggaatgtatccatttcttctagattttctagtttatttgcatagaggtgtttatagtattctctgatggtaggttgtatttctttgggatcgttggtgatatcccctttgtcattttttattgtgtctatttgattcttctctcttttcttctttattagtcttgctagtggtctatcaattttgttgatctttttaaaaaaccagttcctagattcattgatattttgaagggttttttgtgtctgtatctctttcagatccgctctgatcttagttatttcttgccttctgctagcttttgaatttgtttgctcttgcttctctagttcttttaattgtgatgttagggtgtcgattttagaactttcctgctttctcttgtcggcatttagtgctataaatttccctctacacactgctttaaatgtgttccagagattctgatatgttgtgtctttgttcttattggtttcaaagaacatctttatttctgccttcatttcgttatttacccagtagtcattcagaagcaggttgttcagtttccatgtagctgagcagttctgagtgagtttcttaatcctgagttctaatttgattgcactgtggtctgagagacagtttgttgtgatttcagttcttttacatttgctcaggagtgctttacttccaattatgtggtcaattttagaataagtgcaatgtgttgctgagaagaatgtatattctgttgaattggggtggagagttctgtaggtgtctattaggtctgcttgttgcagagctgagttcaggtcctggatatccttgttaacctgctgtcttgttgatctgtctgatattgacagtggggtgttaaagtatcccattattattgtgtgggagtctaagtctctttgtaggtctctaaggacttgctttatgaatctgggtgctcttgtattgggtgcatatatatttaggatagttagctcttcttgttgaattgatccctttaccattatgtaatggccttctttgtctcttttgatctttgttggtttaaagtctgttttatcagagaccaggattgcaacctctgcttttttttttttttttttttgccttccatttgcttggtagatcttcccccatccctttattttgagcctgtgtgcctctttgcacatgagatgcatctcctgaatacagcacactgatgggtcttgactctttatccaatttgccagtctgtgtcttttaattggggcatttagcccatttacatttaaggttaatattgttatatgtgaatttgatcctgtcattatgatattagctggttattttgcctgttaattaatgcagtttcttcgtaacatcgatggtctttacagtttggcctgtttttgccgtggctggtactggttgttttctttccatgtttagtgcttccttcaggagctcttgtaaggcaggcctggtggtgacaaactctctcagcatttgcttgtctgtaaaggattttatttctccttcacttatgaagcttagtttggctggatatgaaattctgtgttgaaaattcttttctttaacaatgttgaatattggcccccagtctcttctggtttgtagggtttctgccgagagatctgttagtctgatgggcctccctttgtgggtaactcgacctttctctctggctgcccttaacatcttttccttcatttcaagttgaatctgacaattatgtgtgttggggttgctcttgttgaggagtatctttgtggtgttctctgtatttcctgaatttggatgttggcctaccttgctaggctgggaaagttctagtggataatatcctgaagagtgttttccaggttggttccattccccatcactttcagatacaccaatccaatgtagatttggtcttttcacatagtcctatatttcttggaggctttgtttgttccttttgactcttttttctctaaccttgtcttctcactttatttcattaatttgatcttcgatcactgataccctttcttccacttgattgaatcagctattgaatcttgtgcatgcgtcacgaagttctcgtgccatggttttcagctctgtcaggtcatttaaggtcttctctacactgtttattctagttagccattcgtctaaccttttttcaaggtttttagcttccttgctatgggtttgaacatcctcctttatcttgcagtagtttgttattaccgaccttctgaagcctacttctgtcaacttgtgaaagtcattctctgtccagctttgttccattgctggcgaggagctgctatcctttggaggaggagaggcactctgatttagaatttttagcttttctgctctggtttctccccatctttgtggttttgtctacctttggtctttgatgttggtgacctacaaatggggttttggtgtagatgacctttttattgatgttgatggtattcctttctgtttgttagttttccttctaacagccaggtccctcagctgcaggtctgttggagtttgctggaggtccactccagaccctgtttgcctgggtatcaccagtggaggctgcagaacggcaaatattactgcctgttccttcctctggaagcttcgtcccagaggagcaccgaactatgtgaggtgtctttcggcccttactgggaggtgtcttcgagttaggctacacgggggtcagggatccacttgaagaggcattgtgtctgttctcagagctcaaacgctgtggtgggagaaccactgttctcttcagagctgtcagacagggacattgaagtctgcagaagttgtctgctgtcttttattcagctatgccctgcccatggaggtgaagcgtagaggcagtaggccttgttgatctgcagtgggctccgcccagtttgagcctccaggtggctttgtttacctactcaagcctcagcaatggaggacacccctcctccagccagggggctgtctcacagatccatctcagactgctgtgctagcagtgagcaaggctctgtgggcgtgggagccactgagccaggcacgggagagaatcaccttgtctgccggttgctaagaccatgggaagagcacagtatttgggtggaagtgtcccgtttatccaggcagtctgtcatggcttcctttggctaagaaagggatatcccctgaccccttgcgcttcctgggtgaggcagtgccccaccctgcttttcctagccctccatgggctgcacccactgcccatccagtcccagtgagatgaactaggtacctcagctggaaatgcagaaatcacccatcttctgcgttgatcatgctgggagctgcagactggagccattcctgttcggccctcttgcagttgtgtgcagatcattattaatagtttttaagttgaattcctgttactgttttctaaagcagtatcaacgtattgatatttgtaactattgattttttaaaatatctctgaacttaacaagagttacatctaactttttaaagcagtgagctctgaacccataaaattacaaaatgctaatttttgctatagtttactagctttctgtgaacttaggaatgtttgcatttatttttaggaatatctatggcttgttcattaagcaaatgtttattgagactttattgtatgccaaggactaaagtagtaaacaagatagacattgtctatgtatactaacgaaccatatattcttgggggatggagtccttctgtcagttcatttatcagttttatcagtgtgtatgactctaaaaattattcacaaacctctatatcaatatttagatatcttgtttttgctttgttagaaaagatgatattatgtaattatatatattgaaaacatagagcatatattcactattcttttgaaaagtgctattgggccgggtgtggtgtctcacgcctgtaatcccagcactttggaaggctgaggcgggtggatcacctgaggtcaggagtttgagaccagcctgtccaacatggtgaaaccccatctctactaaatacaaaaaattagccaggggtggtggcgcatgcctgtaatcccagctactcgtgaggctgaggtgagagaatcacttgaatctgggaggcggaggttgcagtgagccgagattgcatcattgcactccagcctgggcaacaacagtgaaatgccatctcaaaaaaaaaaaaaaaaaaaaagaaagaaagaaaagtacttttggttattttcctttattcttttaacatctttctagaagtttttatttcggtacacaatcttggtattttgattttatagaagtaaatacaattaaattatagtacataataattattttaatttttctcataaggagacattaaaaggtaataaaataaatgaagccagctttcttttgaagtcaccaaggttaagtggtctttcttcctttgcagatgaacaaatgagtatttattattatgaatgttgttactactattaataataatacctaatattttttgaattactctgtgtcagatagtgtataaaatgttttacatatagaacttcagttaatctgcctgattgtctaatttagaaatgagaaagcttctgagataaaggtactttttcaagctaacacagttcccaggattctacccagagagctctctctctgatcttctgctcattaacttcttattgttctacactgattctttttttttttttttttttttggagatagggtctcactctgtctcccagactggagtgcagtggtgtgatcttggctcactgcaacttccatctcccaggctcaagtgattgtcctgcctcagcctcccaagtagctgagattacaggtgtgcaccaccaccacccagctaatttttgtgtttttagtagagacggggtttcaccattttggccagctggtcttgagctcctgacctcaaataatccacccgccttgacctcccaaggtgctgggattacaggcatgagccactgcacctggccttattgttctatactgattcttaagactgatgcagaggatttccttcttttaaattaaatgtatgttcactcgaatctttttttcacttaggtaacttgctttcaaaatctgtattctgttaggatccattaggttctgctagggtacttaatcagtaaaatgtgctggtggttgcccagtcatgagtggtagggtttatgactcagcaacagaaagtaagaataaaggatggtaaggacagcaatctcaatgagttagcgtcattcttgtgcacagtagccaccaaggctgactatttccattcaaccacattgagccctttttaccattttctgaactgtgtattgcttcttcttttttttttaacttaatgcagttaaagcaaagtatatttgatattttaaaaagtgttgtagagtctgttcccttactcgtgtcagaaaccatcatatttaaagggctgggtgcggtggtgactcacgcctctaatcccagcactttggaatgtaagacgggcagatcacttgaggccaggagttcacgaccagcctggccaacatggcaaaaccccgtctctactaaaaatacaaaaaattagctgggtgtagtagtacacgcctgtagtcccacctacttgggaggctgaggcatgagaattgcttgagcctgggaggcagagattatggtgagtcgagattgcactgctgcactccagcctgggtgacagagcaagactctgtctcaaaaaaaaaaaaacccaatatatttacttttttctgtaaaataattgggttactttttggctttacatttagtttcactgatttcctccaacatttctttctggagtattattagtatatttgggattgaagacttgaaattagatatgtataatatttaagatgttttgttttgttgatttacacattaatgttattctgtttacctgcttttcttaattataagacctgcttgtttacttttgacgtcctgaagattgggccataattgctgagattttaaaggattcaagctaacagtggttccttcatgtgtaacttctcagtaaattttcagaagattatactgctcttatgggacagcttcttaaaacttctcatttaactaagacgttaaattgacttttcagtttttaaacttggtacgctataggtgcaggaagcagaaaagaccaaagatgaagatggtccttgattatatttttattctgcctgacatctgtagttcttctcatttcttagcaccttgataagtatcatacctgcaggaagtgctaacagatagtatgatgtacatttgtaggctcttctgtcagttgtgtgcataaaagaggttgggtggccttgaggattgggcttctcaaatttttaatagaacctgcttatctggttttcaaagcacatggccgtactcttagcaattctaggcctttgaaaaaagagtagagttgtctgctattcatttctcgtcagaagtctatccaaaaagtgataattagagacaacaatctaaagacatgtaggtccccttccttccaccaaaaactgctcaccccacagtttttcctagctttgtaaataccagttccatctttctagttgtttatgccagaaatttttagtcatttttggaattatttttcctatatccacatcgagttatcagcagaacttcttgaccctcccttaaaaatatagctagaatctgacgtatcactttcatcactcccaccctggtccaggccaccatcatatcttgcctggatcattacaaaagcctcctaattagttctcctgcttcagtggttctgctctcaacagtctaatctctgtgtagttgtttgtgtcctttgaagggttcggtcagattacagcaatccccagctcaacaccttctaatgatttcttgtctcactcagtagaagccaaagacttcacaattacctataaggtcctaaatgatatttttggttgcctctctgatcccatctcttagtactcacttctttactcccacatagtcatactggtcttgttaactgttgctgaaacatagttgaagcacaagcctgcttcaggtgtttaaacttggactgttctccccttagatatctgcatggcttgctccctaactttctaaggtttatgatcaaatgttaccttattagtgaggccttatctgactaccctatatttaatagccatacctttacactgctttgtatttctaagtagcaggaattaccatgcatattttctggtttatttgcttgttatctgtatccattgtggtgtaaaccccataaggactaagactttatgttgcctgcttgtcccagtagctaggacagtccttgatacatagtgggtgctcagtatatacatgttgaatttatttttgtaggtcctcaaagttatgtctttctggcaagttagctcaccaggaagtttcatagtggaccaaatagcctttgtaggcctttttgaactatgttttaatgttttgctctaggtcattagaagaaacagcctcatgaaaagcaattttgcatttggcatatgtcatcttgtataattcagtagcccttattagagattccagaggagaaatgtcttttggaatttagtgtaagaaatccagttgagaagcaaccttgctctttattttatttatttatttatttgtttgtttggtttttgttttgacagggtcttatgcccatcacccaggctagagtgcagtggtgtgatcacggcttactacagcctcaacctcctgggcttaggtgattctcccacctcagcctcccaagtagctgggactacaggcacacaccatcatgcttgtccatttttttgtatttttagttgagacgggattttgccgtgttgcccaggctggtcttgaactcctgggctcaagcgatccacctgcttcggcctcccaaagtgctgggattactggtgtgagccaccttgcccagccaaccttattcttttttgaaggctataaatattccgttgatggatgcgtcacaatttgttttaaccagtcttttattgataggtatcaaactattgattattttgctgttataaatagggcttaagtgtgaatatccttacacatatcttgtataattttatacatatatgttcatattatgtatttatagcaataacatttctagttcaaaggatatgtatgtatagaattttggtagaccttaccaaagtgccctcaaaaggtcacattgattgtatattacaaccagtggttgactataaattgtgttttggattttgactaagtgtcttttttaaaaaaaaaaaaacaaaaacttttattttcagaagtttctgttgctttgttttcaaaaattcacatgactaaaactagacaatattttttacattttcatatgttcatttatttattcatctggtaatcattatctgcctgttatgtaccaggcgcataacttctttccttccttttttccctcctttctttttctctccctccctctctctacaccctgatctctgttcttttttctcatgttaagatagtgatacttgtacataccttatagggtaaagttcttgtgcaagtacttggcatagagtaagtgctcagtaaatattcaccattataatttttcagtgaagttgtcttgctctctgcagttttgtttgccagttcctttttctgtggtttgttttggctctgtattttgtttgaggctttcctcaagtatctattgatctctgctaacaatttatagttaagagtgaggctaaagagatgagggactttttgacatgtggatgtcactgtagattgattatatattgagaggtcatttttgtttgtcactattcctagcccaccccacccccaataaaaccatcaatatgtagattttttttctccagagagatatcctggagtgatatcctatgtttgggagctgagagggagagggatcctgtgtgaacctcgatcagtatgtatacttacccttaactttgcctctttcagagtggcacctcacccagtgccctctgctgtttgggtccctctagctcagtttctccaaagaataaacctttgtctcctgctagactgggggagggctaattgtctaatgcttatgtagactttcatccagtcctttatttgctgtcctgtgtctcacctctgccttctgtgttacttggtgcttccaattttggaatcttcctagtttctgtgatgcaaatgtattgattttctactgtgcaaactcttaggtttcagcttcctctgccctctgccctgctaagtctgctttccatcttagaaaaatgggttgacatctctggtctgcttttgtctcctctgctcttcttaatgtttttctgggtgtataccttttctgtttcttcattgttattttaatagatttttttttaaaggttgcagagataaatgtgtaaatttagtccttcatgtttaaccagttattgatgatctggtaatagtttttttcctgtgaatttttttttaaagtaaaaaaccctacccctgataccttaccccttcaagtgaatttttttgatgttatgaattcaattaatgtattcaatatgttgaaactacatcaagctgattaaatttcagggtcttagaaatcaggtacaggcaattatgttacgtgtacatatacatatgtgtgcatttcaaaaatttcctaccaggtagtcactaaatttatatataaagaatgggtgcagttttaattcattctttagttcttagttttcacataagaatacatttgcctcctcattttagcaattggagttgctcagcaaatgagaaatctttatattctctcagaaattggaaatatagtatttaatgtgtcaccatcatcaaaagttgattgtatcacttgcagggtttttggacactgtgctattatgcaggtttttaaaaataatgtttgctataatcactttcagatgatgtcagcctctcttgctaaggtctcctttatgtactgattactgttgttatatatccatgctgtctgatagacatccagtagacatcatcacatcacactgtgaagatggaagtgttctaaatctgtgctgttcaataaatacagtagccactagccacacgtgcctgttgagcacttgaaatgtggctagtgtgactagggaactgaatttaaaattttattcaaacattaattaaggagccacatgtgactagtggctaccatattggacagcatagttataaaacgttattctgataggatgtgctaagtgttttattcaaattattttatgttgttattcatttaaattagtttggaataaagtattcaaccgaggaataagagttagctgagttgttccaagttcattattcattattataatttgaaatacatttttctttgacttccataagaataaaaatatgcagattgctatttccgaattgaaaagaaaatatattttagatgagtgtgccatgccagttatttggagtattttttgtgctgataagatattgaaagtcaaagcggaaggtgacagtgagcctctccagtgttttcttccatctttcaagagaaaggggaaatactgtttgagtcaaaccttgctattgttttagggtgtttacattattgaagatagtcatggtgatgttttggctttgcttttttttttttttttgcgtgatcatagcttacctttaattattggactcaagctatcctaccatagcttcctcgagtagctggtgctataggtgcctgccaccacatgctgctaatttttttgtttgttttgttttgttttttgttttttgagatggagtcttgctctgtcacctaggctggagtgcagtggtgcgacctcagctcactgcaacctctgcctcccgggttcaagtgattctcctgcctcacccttctgagtagctgggactacaggcacacaccaccacgcccggctaatttttgtattgttagtagagtcagggtttcaccatgttggccaggctggtctcaaactcctgagcttgtgatccacctgccttggcctcccaaagtgctgcgattataggcatgagccaaaaatttttaaaaatttttgtagagagaagctctcactatgtttcccaggctggtcgtgaactcttggcctcaagcaatgctccctcctcggcctctggaagcactgggactggcctgtttttgcatttttaaagtttggatgaaaatgctttgtgacatcaaacttttttgtgaactacagattaattgactaactagaattatgctatcagttgaggtctgtagtaagttgagtgtcatttaattggtaaaattgtcagttagtttttataaaaaaataaaaagcatgggactaagaagcatgggttttgggagttgaaggttgcattgagctgagattgtgccactgcactccagcctgggcgacagagtgaaattgtgtctcaaaaaaaaaagaagcataggtttgattgcagaacattacaattctgcttttattttaagtgaaatacagcattttggaatattaattagcatagttaccactacgcatgtagtttagcaaaatatactatatttactattttatacaatattattattaacagttgaatattattcaggcctttgagaagatatattaaacagttatttcaaactcttttttgttctactgaaggcctcaatcccttcttagtttttcattctcagcaaaagatttctccttctatttcgtaaaatatgagcactcacattcttgttctttcttatcaactttcagtcatcatcactgattccccaccacctcttgcattacagtggaaaaagtgtcctgttctgacaaaaacagatctctccagctaaggtcttacttcctccctttttacttattctttttttttttttttttgagacagggtcttgttgtattgcccaggctggagtgcagtggtgtgatcatggcttactgcagccttgacctcccaggttcaagcaatcttcccacctcagcctcttgagtagctgagactaaaggtgtgcaccaccatgcccagctaattctttaaactcttttgtaggaatgggttctccctatgttttctaagctggtcttgaactcctggcctcaagtggtccttttgccttggcctcctcaaaagtgctgagattacaggtgtgagccactgcttctggccacatggatcttgtatatcagttatttcacttgttttatgtaatttcagcctatctccattattttttttctctttgtgttttaataagctccactcttcttcatatgtaatagaagggaggcaactcttctcctcccttcttccttgttttcagatccaggctttttgaaagaactgtttatattcattttctctaattctttccatgcaagccatgctttgacatgattttgatgcatgctgaagtttgagaatcaccaccctaccctatctttgtgggtcagtcaggaagctcactattattgctatgaattggaatcactggttataggttttaaaggaccgttagtttccacttaaatagacacagaagaatcaacttctggtggggcaggatggtgtttaaacttagaaatcataactgtaggtgaattaattaagattggatttggcagtgagtgacagaaacccaatatagtggtagcttaaaaaggtagttcacttctcggacaaacacgggtaatccaggtttggtgactacatgattatcaagaacctgggcccctttactcttgttgctctaccatttctaacactcagctgctacttcatggttctgtttggctgctatagctatagccatcctttttacattctagtcaacagggaggaaaaagaggagatactttctccttttaaagaaacttcccagcagttgtccagaacttttagtccagttggccatacccagttgtaagggagcccggaaaataagtttttattttaggcagccttgtgtgcagatagtttctaccactgtagggaaaggagagaacatatgtggcagggataacagcctctaccaggataagctcttgggagctttgaatggctcaatcagtaaacaatattgcttattataagtagtgcactatgaaagatgaattgtgggaaaatgagggagattgggggaaggagaacagaattgaaaaaaaaaattaaaaatctcccccttgcttttctaagagatgccatttacttgaggagatcagacatgcatacataagttacagagcaatgtaagaatcagaggatgcaattagtgggggaatcagactcacgtgggatttatttttggaggcaggcatctctaaaggactggagttttgagaaaacagaagagaattgacatacttttgggtaaatggagttctttgtacaagatattaatcactgttttgtacccttaacacttaagagtcttaacacttatttctaatgtagagttgaggaaggaattataataaacctatgagaaatctctgttgagtaaaatgataaataatatccttgttaatttattaatttatcttatcttacttttgacagctatttatagtactttcaatttcaaaatagacaaaaggtttgtcttccaatttgtatgtggtaattagaaccattgtaacttatgacctccccaattgaataactgaattattttatagaaataacatagtaaattttgtgaatagagaaaaagaagccaagaagtcatagaagagagaacaaggggagtggactttgagtattgtaaaaaacagtgggtttggcagagttcactggtgtcttaaaaacatttaaaaatgaattagtgtgatctagtaatagagttttgcatttttttacttaatattataatgtgtacattttttcttgatgtaaaattttttctaaagcatgagttttaaaattgattgtgtatagcattccatagtttggatttactataatgatttaccccatacccttattattagacatttaaattgcttataacatttttgtaactatgagcaaagataaacaatttaagtctttaaaaagtgaattcgtgagcacagaaactacatgttggaatatagggtattactggagagaactttgaggtagcagagatagtattttgagttttcctctaaaatgaggaagatgatgatcctatagaaaatagtggaatgaagcaattaatagcttataaaatttggactttagtcatctacttaagaaaattaaagctatatatatagtattgctggtttacataaactaatacagtaacataaatgtggataatttacattttattccttaggtatacatacatactttaagtttcatgtatttactgatgtctaaatcatactgatttttaagtagtgacatgacatttttgtttggaaaacaaatccttcactttaaattggttcattgttttctattagagttttgtagtatgaaactattcagtttagaaaagaaatgcatacaaatttctgttcaaatatgcatatgctttttactgggcttattgtatgtatcttgatttacaggcctttttgcaaatgtgtaacttgcctatcaaagtagtttgtagggcaaatgcagaatatatgtctccatctggtaagtgtgtttttttttcttctctgttaatattatggagtgataaaattatagtgatagtccagtttgtatctacatgttaaaatgcctgattttttttgtttaccctttgaagaatctttccatggttttagaaagtaacaattgcaaatttgacaatcttggggttggcatatctattcatttcaactgtgatcagagatggttactgacgtgtggaaatggttttaatagtaagggaattgttttaaatagtaaatgttaaggaaatacatgatctcagatttccctagtcttaatgtacataagactttcctgttgagaaaacaaattttagtaataatgaatccatttattattccacacatctttcttaattatattctcccataatacagctggaagaagagagattgtagaaaaattaatttgtcgttagatcttgaagtcatcactgaatgtttttggtttctaattattttttctaatgcttaattttaacaggttttgagatgctttagcttcctattttttaaaatcagtattatctttatgtcagtagattaaattactgttttaaataaataattcaaaatttttaatataaaaatgtgctacaaagctgataaataaatgttatatataattatcatggatgattattgtaattatggttttgttggagcaataatacgtagaattactcctttttgaataaattattaagtataactgattggtataagtgtgtaacattgctttttagggagacatttttcattttgatatgataatttaggagtgacttgtgttaaattttttttttccaccttaagtttttaagggtggtagaaattgttaaaaggtatgaagacaccccttctgtacataatgttcttttatataaatacctggttttagaggtttatgaatatacatttagaaaacatttccataaaataatttctaggcttgtaaatgtaaacatattttagattcttggagggcattcattgactcatttttgtgttggttttatacgtagattttaggaactacagagttctggtgaaataagttatgttgtgttttgtccatccttttcctctatgtagtcatacaaacagtttgtatatttatgtaaaaaggttagaaggttagtaatctaatgctaaagttcagatctttggcaagtgagatatcaatatagtttatctacctgtttcctaaaattactatacttagtgtcatttaggtagatacctattttctttttattagattgcgcgaaagacaaacataaatattctagagacatacaaaaatatacattctttcataggagtctcctataggtagatgaaaatggcactttctactaagatatttaaactttatcatatctcagattggtattctctttcatttaatgatttgaggtgatagggaaatgttttttattgtatttgcttctttgatcttgcggtagatttttaaagcagagagcatggactagtcagaagaccagttgacttaaactcttatttcctaaagagttaggaaatctttaactaatccttctgtgactttgtcacatattaactatttccttgagaaatttcacttctctgagcctcagtgacttcatctgtaatataaggtagccggattagatgacatccaaggtcctatttcttgcattctttgaatctgccaacttgtttggcaacatattcttgctttctttagaataaaaattttaaaagtgattattctgtctaagacggtaaacaaagccctcagttttcttatatgacctttgattcgcaccagaaaataactgtcttactgtgtttttgcctgatacctgcaataataaggatataacattggctccattttcattaagcaggctagtgacagaaaacattattcacttctaatttgttgtgtttgtttttatatatctctttatatttagagatatataagattaatactcagttgactatccacacttctttttgcttcagaattgacaacgctcaatgtatttttaagaaaagaaaaaaaatacaaacccttttttccaagaacctgaaactggtcattaaaaacaaggaatatgctttgctctaaaaatattatacccccaaatactgtttgtctaggtactaaatagttttcattctcagatcatttgatctcaggggacctgtaataattctggtagtatagtagttacaaagattttatcccgagttaagaaaacaatgtggcctaatgcttaaccagataaaaaaatttttttttgcaagatttataaagcagtagaaggaaggaatgcagaattggcaacagggaaatatcttctcaatacatctattgagttgttgtgttccaaaaggcctgccttttctttgtaatgcatgttgtcctatggatgcagttgaagcttttgttaggcctctgtacttcatccattacccccaggctgacggagccagagaggagtgaatctattgaaaaggaacaggaagaagcctgctgttagtgtgaactctatttgaactaggtgtgacagcaggtttcattctttagcatttggagtagacccttcttgctatttggagattattttgttctctcatctctaataattccaagtattagtatttgttaaagtgaaatatttcttttttaatgtgacatttatctatagaagctagtttttataaacatactattattttttcccacatgttgggaacatactctgtattacaactcaccaactagcatgccttcaaagattgttaattcttttaattcttgctattttgagttaaagagatttattgatatacaattacttgcttaaaatgttgatctcaatgggtatcaaagacttaaaagatgtaaaaaggttttttaaatgtagtttacaatatagattgattcactgtactctgaaaagaaagcttacatttctttgaaatatatcagtggtcatgtaccagtgtcctggcttggttcatgtaatttggataattagtgtttgctgctatatggtgatatgtttgtgttggctctgaaaagagaatgttatgtgatctgttattatatctaagtgagaactctagaaatgaatttacctgttctttttttctaaagttggttagtaatcagtttaaaaacttacagaatttaatatacacatctgacaaaaattttcaaaagttacagttttatgaaatccctatttataaatacctgagttttgtgttaattttttttaattatcacaaactttaacatactggaagtatttttataaatactttttttttctctcaacaggtaaagtaccttttattcatgtgggaaatcaagtagtatcagaacttggtccaatagtccaatttgttaaagccaaggtaataaaaagatattaaatgtatttgatcagttaccaagtcattcatcattctttaatgtgtcttaacatttacattgatttcaacctagttttataaaatgccaatgcaaactactggaaaatatttctgaagtgtaagttagtattttttcatgatataatggcaaaagaggtagctttttttcctctattaatgtcaaatttattaaaggtatgtaattttaatatctagtctaaagagatggtttgatctttacaaaatggtagataattttctaacttatgcttactacaactgtggtcataaatgaaaaactattaggttttgaagtgtctggctgacctttgaaaagggagatacaggatttgtttgaagttgaatgtatttatccatttgaatgattctgcttttcatttattcagtttagattttaatagttattaaggaacaactcccattagtgtttctgaaaaatcattccagactttttgaatatatagaaaaacctagatcatactagtgtgtattattttgcaacataccttttaaaatcataaatatgtttggaaattcttccatattaatagctgtaggtatatatcatcctttcacattgttgtattctgctgtattggagatatatatatatctccaaaatatatatatatattattttttttttcttcaacaccctccccctgtattggataaattagaattttatttactcaagtttattgttgggcttttaggtcatggccaattttttgtttttatagagtactaagataaattttcttatatatacatctttgtataaattcctaaggttggtattggtaccttaggataaattcctgagagtggtattaggatgtcataggttatgtactttttaaatcttgtaatagattgccagattgaactaaaggttatatcattttatgtatctcctagtaactatagagtattagaattttaaaataagtgggtttctccccccatatctttacaaacgtatttttttcatctttgaccactttataaacagcacatgtcagtcttttggcatttcctttatttctaaataaggttaatctcttaaacaaggtttgctgaccattctgttttcttcttttgtgaagtagttgatagtgtaattttctctattgaaagatacatttgtataatgacaagtaagtacatactaatattttgtagtgatagcagagtattatttatgcttttatataaaataatttttagggggcattttggacgtttaattcattgtatagttgcatgttacgttatttgttagtgagataactgaaagtttttgtatatttaatatgatgttcttttaaatttttttaaattccctttagggccattctcttagtgatgggctggaggaagtccaaaaagcagaaatgaaagcttacatggaattagtcaacaatatgctgttgactgcagaggtaaaatactagatgatacggcttgaaaataagctttttctctcattctcataaaatataatctttcttatgggttaaagttattgagaaatgggaaaatagtcaagtaattctagagttgagttggctacctaaattatttgattattacctttgaacaagttacctgacattttcagttctagtttttctgtttataaaaaggagtgattcttgcctactcattattttactttggccttttgaaatttgcttaaataatatctgtaaaacactttaatggtatttagacatgtattgtgtgaataaaaaatatttttataacgtaccatcattacatttttgtggatagcagctaagaaaaacaaaccgctacatgtgtgacttatgaaattagcttataaaaaattgccttggcaaaaaataactttctttatccttttcctctttggtattctaaagtttagtgactgttcttttgttcctagctgtatcttcagtggtgtgatgaagctacagtaggggaggtgagtggttctgtaacatttatcttaattaaaatttaatgagaaaacacttttgctcagaatcgcaagtccctgctcataaatgaaacattgtggtttataccattagtgatatagtttttcacttactttaattttgcttgcacataacattttagggaagctatgtgtcattgtttgatataacgggttgcaaagtacataaaagtttatatatttttaaagggaatggcttaaaattttaattttttagattgcaggatgtgtatttttttcagattgctctatttatgttctctgaaaatatatttcttttagaattctatttgtaaaaacgggcattgtttttaggaaggatcaccttttttacaaaatctttttactttagatcactcatgctaggtatggatctccttacccttggcctctgaatcatattttggcctatcaaaaacagtgggaagtcaaacgtaagatgaaagctattggatggggaaagaagactctggaccaggtcagttcaggttgaagttgacaaaaccctcaacttttatgcattaaaagaatcattctttatattgatactcctttaaaaaaatatatataagatttgcaagaaaaccatttcctgtgattttcactaacatgaagtaattttatttctaaaaaatcatacatgcttgatgtaaagcaaacaatgcaatgcagatatgtgtaaaaaagcaataaaacttgcctgaaatctcatcacctagaaaataccacccttaactatttggagagccttcttctagatgtttcttagtaacattttctcaaatgggatcattatgcctgctactgtataacctgagggtttttttttttttttaattgaacaatacattgtgggcaccttttatgtaactaaatatagatctgcagcatcagggcttaaaaaaaaagccctgttaaatacagtactttgtccgtctgtctgtctatctatctgtctatctgtctatctatctgtctatctatatttttgctactaaagtagcaaaacttaaaaatacttatcttgtccacaagcatcattaagttaattaatgcccgtcttttccaaggctacccttaatactagccagccatctcactgatgtgtgccattggctacaagggggtttcagtaaatgaatagggatagaataaataaaaatctatctccactagtgggaaaataactcaaatgcttttactcatagtgggtcaatgttgttacctttattaagcagattttttggtatatgcaaagccatttgaatatatggattcaggaagacacttttgttcttgacaaaatccttataagtaacttaaatgtacttgtattttgaaggacattcactgagaatttcttcctatttcttgtatacaaagtattatatatatatacttatatagaaagtatttcttataagtatttcttatatagaaagtatttcttataagtatttcttatatagaaagtattatatatatatgtggtctatggtcttattaaaatatattataaaaggttaacttaaatttatatttttgttataaactgtgatacaagttacgttttagatactttttattgttttgctaattgaaatacttttccttggggttcattgcctgtgttaggtcttagaggatgtagaccagtgctgtcaagctctctctcaaagactgggaacacaaccgtatttcttcaataagcagtaagaaattttacttttttaaagttaattttctgtactgttaggttgcaaatttctttttttcataaaagaattgctttttcaagaaaatatttagctatttttataatttttgtactcaaatatttttgtggcactttactctcaggcacagtgctaggctctaggagactaagatttctaaaatatggtccttatcattaagaatttctcttaaaggcagtcatgtaaatcaatcattgtatgataaggttttaatgaggtagttcaaggtgctatacatggaactacaaaatcttaacaaaattctaaacttgtactattaaacatgaaggaaagtaagttactattaatgtaactatggttttctatatagaatgatagctggaggattagaagagtcaataaaactaaatattaaaaaatattgtttgatggacaagcactattatgaacttatcttttaaaatgttaatgaaaatatttgtaaaacacagaaattaatataaaggatataggttaaatatatgtgtatatatgtaagttgaataatgtttcattaatagatttgcttttgcagttttgaaaagactctaatgaaggcaaagaatgaattttccgttgttaaaaaattacaattttaatatatcagaatcagctgtcctgtgatccagtgtaagatgggcttaaagcattttaatctcaaaactttccctagaaagtctgaccttttcttgacattttaataaaaattatttgatttttagattaataatttctaaaaggctttatttgctattatgtgttatatcgtcataagcattcctcttctataaccatatcaaacatatttgggtaaagataatatttgtagtaaaaatggctatgatgatagtttggaaatatttaagttatattaatctataacacaagtaatatatacatatataattgatattaaaatctgggttctgttgatctttgaagcagaaaaatcttcagaattcaaactgtgaaattctggtgggtaaagcttctacaactctgttcctgtttctagtgatgtttgctctacagattctatttttcagtccctaacacaagagaaatgtatccaaatgtcaatattacgtgatttcttttctttctaacagaggaattcttaggaattgaaaagctcagaaggggtgtgttttattgaaatgcattattctattttagttttgttatgcacactgtctttagaggaggccaggagaatagatctaacttacttttcttctcagttaaactcattgtcattgtgttagtaaccagagtttggcatgtgactcagtggaaatatcaagatatcatttttcttcataagggcacaattacatttacacttgtgatgaaaacttctaacttagaacagttcaaacaccaaagccttgcttttgaggaactatttaattgatattatgatgtagagttttgacataattttcctttgcgtgatacttagataaacattttccctaaaaataagattaaagatagaagagatttgatttttaattttattcgatcatttaattaatactaaaatgcaaataaagtacatttagaaaaaagtaactggtatttcacttccttgtgccaacatttttctcattcctttatctgtagcaggagtcattactttgtgagatactatgttgaatagagctgtggcctaagtcaggtattatactgcaagtcagagggtctgaattctattcttggctctgacatatctctaagttactctaatttctctatgtgtatgccagtcctaaaattagaattaaccccctacaattagaattaatcccctaaaattagaattaactttccttctagctcaactactggggatgttgggaggactcgtgaaagaaaccaaataccgttacttgatgagagaaaaggaaaagggtagttaagggagatctcacagaaagaataataattgggaaaagaggccaaaaagcaaggggcttgatttacaaaacttgggtgacagccctaaagataagtgattaggatgtaaagaaaagataacgtagattatttctagtactataaagagatgaaaagttaatgggaaagaacaattaggaaacactcagacaaaattaatgcttttgaaagcattaatatagatgatactatgaaggtatcagagagaaataaatgtgaaataatgaataagcaaagcaaaaaatatgagtgccagaaaaatcttaaatggaaaatgttaggaaaatgttgaattttactgagtgccagaaaaatcttaaatggaaaatgttatgaaaacgttgaattttactgtttttgttttgatattcaaatgaaaaaatagtagataaccaacaggaatgtggaaagaataataatgtaagaaggcatcaaatttcttaggactttaaaaatatatttgtcaccctggaatatttttctaataaaaagtctataaagataaatgcaataatatatgaaacatcttagagctcataggaggggaattgctatctatatttgaattataatcacaaactatttggtaagcagaagggtagaaagttgtgttttctcttcacgtgatatagcaagataattaaaattggaggtatatgaagatcttgacttgattaaatagttcagtagaaatactggataaaatatgttacttgtctttttgttaagtcaggtttattgatgtgtaatttacatctagtaaaattggcacttttatgcgtgtagttctatgaattttaacaaaggcatacagttgtgtaactgtcacctatcaactaaaatattatttgtacttcttaaaaagacttgttggaatcagtaatttatatatgtcagagtcagtgtaaggagttgctcaaatttggaaaaattacaaaaaatatgctttaaaggttagtgtgtgtggatatatacagtcatgccctgtatggcaacctttcagtctgtgatggaccaaatatatgatgatggtcccttgagattgtaatatatttttacttaccttttctgtgtttagatatgtttaaatacacaagtatttgtgtaccataaatacacattatcattgtgttacagttgcctacagtattctgtttggcaatgtgctgtataggtttgtagcctattagcaatagggtgtaccatatactctaggtgtatagcaccatctaggtttgtgtaagtagactctatgatgttcacacagtgagaaaattgccaaacagtgcatttctcagaatgtattcctgttaagcaacacacaactgtatgtgctttggtttaatctgttgaattctacttctgttgatgttctaaagtaacttgccacaaagttgctgtctttatgtaaaatcagatcagtttttatatgctcatgcccatatataattcagtacctctggagttatgtggatatatatttgcaacaaaccacttcaggggtacttctggagcactctcatttgagcatacattgatagttgaactctttcagagccttcatttattaataaagggtgcccatctatactactggaagttgcatcagagaatatatgcaccttttttaggctctagtacaagaagtatagggtagctggcactaaacaaggattaggaaaataagttctaaattggtaagataagatgtacctcttaagaaatatgtttaaggatgtggaagaattggtgtttgtattattctcaccaagtgcctcagctcagctccccatttatccactctacatccttggttttttgcagggatctattcattattggttcattcctgtgatgataagattatggtgctgttgagtctaaggacccttgagatttttttttttaaaactatactgttggctacccatttaaacatggccatagattgcacatttgactttgattaacacttcatgaatgtcaaaagagtggaaggctttcaaagaatgtaagttactactattgagaaaattaaatattccacacatcttaggatgctttcttttttaattcatgtatttattcggcaagtgctacttcagttccttagatactgtgctaagaactgggaatataaagatatatacagcattgcctttgaagagcttggagtgtagtgagggaaacagttaagtgaacacagttataatatggtatgagaagtgtgtcacctttttattggttcattcaacacaaatttattgcacaattcctgctttgtgcaaggaattgttctaggtattggggttacagcaggaaccaagtaggtgaggtcctttctctacaggactttctggtagaggagatgcacaataagcaaaaaaaaaattatatggtattaattatcaaatgtagaattaaaaaaggaccacatgataaggagtgactacatgtccactttaatttgagtggtctgaggagactttaagatgtgccatttaaaccttattctaaaaaataaggagccagtgtgaagtcagaggaagagtattttaggcagcaggaatagttatagtcaaggttccctaattggcttgagtttgttacgttcaaatgcaagaaacaaggccagtttgggttgtatgctatgaatggtaggatatgaggctaaagaggcaggcagaggccagattatcaaggctctgtgtgcttagtgtaaggagtttggcattttagtataagtagaacagaaatccattagaatattttgtgcttggagttggtatgatctgctgacattagtcattctgaccatggtatggagaatgagtagaagcagtaagacactttaggaggctatctcagtggtctaggtgacagatgatggtaggttacactgtgaaatcataatgaagaataagtggtggcattcagggcatattttggaggtagtgtctcaccagacttgctaatggatataggagggtgaaagaaagaactcaagagtagcccctaaatttttggcctgaacagctggttggatagtggtgccttttattttgggaagtttgggggacaagcaggtttgggatactgtaaattactgctattgagaaaataaagtatcccacacatcttagtcaagatgctccacatcctgctccacagatactccacattgaagtggagatgttatgtaggcatttgaatgtatgaatccagagctcaggggagacattaggaccagagataaatatttaggagtcagtggcatcaagatggtatttaaagccatgcatctctaggagactacttatcaatagggttcaaggccacatagctagtaagtgatagtattggagttcaaatttggatttttaccaacccccaaatttattctgccaaaccagattactgcaacatattttcacatttatgtaggctagcacatattttctcaaaaactttatcactgtgggacacagtaataattagctcgtaattatgatgacattttcttgttttagtaatagtgcattagtaattattttaatataatgtaaattggtgatgccccatttatagatcattagtagtggggtagatttcattttgttgttagtaatatataattacagagaaaaaaattcctagaaatttttatgttgaagccatccttatgattttgtctccttcagaaatctaagttactttaaatgtggtaaaattaaagttgtgtcttgttgttgatttgtgattgggtatcatttttttggtcctatcaccacagcgaaatcctttgtgctttgacagcattttgtttatgcatctattaaaacacttaataaattgtatttattaaaacaactttataatttatgtttcatgtacatgtcttagagtatttttcttgtttttatgtctagcatttggtatggtttctggcacattggagatctgctatatttagtgagaaaagtaatgaattaaatgaatatgatcattacatctatattattttaacacacctaaatgttgttactaaagaaagcaagtcacacaactagcaaatcatattttttttccatatagcagaaactccaagaaaagttatatcaagttgtggtaggatttgtttcttacgtggcttttttcttttaagttgatgaataaaatgattttaaaaaacatatccacgggggtctttcaagtatccacaggacatttgttccgggacccccacagatactaaaatctgcagagttcaagtctcttatataaaatggcataattgcttacgtaaacttaatgtattgagaaagaaagaaaaaatggtgcagtgtttgcatgtaatctatgtacatccgtatattttaaatcatctttggattacttatagtacccaatacacacaatctaaatgatatgcagtagtgtgatctcagctcactgcaacctccacctcccgggcttaagccattctaccacctcagcctcccgtgtagctaggactatagccaagcaccaccatgcctggctaatttttgtattttttgtagagatgaggttttgccacattgttcaggctggttgtgaattcctgagttcaaacagtccgcccacctcagcctcccaaagtgctgggattacaggcatgagccaccatgcttggcctatattgttatttctaatcttttaaaatattttggatctgaggttagttgaacctacgagtatgggacctgtgggtgaagagggccaactgtgttttctattgtaaaagttaaatgctacttactcacattactctcatttctacttttaggcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttctaaggc

SEQ ID NO: 36426 - DNA, 10073 bp, Homo sapiens
gtctcctccctttggtccgctgcaggttggtggcgggaggaggggacagctgcgggcgcggggagggggcgccgcgccgcgggggccatggcggagccaggaagccgggagtccgagacccgggtaactgccgcggcgtggcggcttgcctttctggagggggagggagtggctctttgggggtgctcggcgcggggctcccgcgcgggacctgggcggaagagggggcttagtctaggagagaaggcgcgccgctacgttggcactaagggtgactgtccgcttggggcggcctgccgggtggggtcgtggcgagtggcgggtggggagccttgggtggaagtgggtgacctggtggcaccagagagggcgggggagagagaggaggacagggagacgagaccccgctgacccagaggccccaggaagagacactagccaataacttgttagtgagtgaaaggaactaacattgtccagccctgcttggtgtggcactttgctgggtactcccgtggtgtgacttaattcccacaataaccctgaggagtaggccagaaacttactaagacaggagagagcggcagagcgagttgctggaggacacacccagagttgaggccgggcctgatccctggtctgaagcccacgtggtaccagctgcctttgtttacctggctcttccctgaaggttcatgctttttaaaaaattgcctgttttgaacttagcccgtttaatcataagttgatgtaattcaatttttaataatagctgtatttaacaaccagttggcaaaattcctgaaaagctcgccatgggctcttgcaaactgggggacaccattgcccctccctagcttttgcagaggccagcctggaagctttccctgtttcccaaccctgaccttttgttttgttttgttttttgagacaggctgtggttctgtggcccagactggagtgcagtggcgccatctcagctcactgcaacctccgcctcccaggctcaagcgatcctcccaccttagcctcccaagtaggtgggaccacaggcatgtgccaccattcccggctaatttttaaatttttggtagagatggggtttcaccatgttgtccaggctggtcttgaactcctgggctcaagtgatctgcccatctcagcctcccaaagtgctgagattacaggcatgagccaccatccctggcctcatccctctttttaaaaaaaggttttgttctaaaatgctcacagcaatcctcaaagcctagtgtctggtggttgggggagggggtgggcaggagggaccaggctggggaggtccaagaggagctcccaagctctgctcctcaaggggtaccctggatccagcctgcggctcacgcttgcttcagtgcagctgtgtatccttctgacatgagcctggggcggttacgtcctggggtcctccactcccagggcaccctcacctacagtgatcccggcttctgaatcacacaggcacctggtttctacccctccctgacacccacagcctgccttcacaccctcctttatggcccacagacctttgtgagaagtgccaatcaagcagggagactggggcagggtgacctcagatctctgaagtcccaccaagccctgaaattctaagattttagatttgctgctggcagttccagggccaccaatgagagtaatggaagaaataatgcaatattattattattattattattttgagatggagtctcactctgttgcccaggctggagtgcagtggcgcgatctcggctcactgtaacctctgcctcccaggttcaagcgattctcctgcctcagcctcccgggtagctgggactacaggctcatgccaccatgcccagctaatttttgtatttttagtagagatgaggtttcaccatgttagtcaggctggtcttgaactcttgacctcgttatccgcccgccttggcctcccgaagtgctgggattgcaggtgtgagccaccacgcccgacctaaaccgtttttaatgattattaaaaccagccagatgtaatgcatggtggttgcccctctacatttattgtttaatcttggctctaagaggtggaggtgagaagctccattataaggaacagaaaccacccagagaccctacacacccacatcacacaaccagttaagcagtggagtggggtttacattgatttggggggctctctggctcctaaaccagggctctttctactgtaaatggatgattgggtgagggaaacaaggatcctcaagaataggggacagtgtttgggggtgcacaggggctgctgtggttcccacaatagggttcctcaggaaggaacctgcagcatctgccagcacagcgccccctagctgtgctgtaacgcagataatggggatcaccccttagccaaacaccccttggcagcctccctaccctaaagaccgtgctgaggcttcctgggcccctggaaaagtcagattagtctggacttcctcctactccaggaagccttcccacctcttctgctgccaccccaggcaaacataggggccctctgtgctcaacactgaattctaaactatcctcaatttcactctctcttgcctgcagcctgacgtttccccccagggcttggcaaaggcaagagtgcctcggtgtccggcacaaggcctgaccgcatgggtgaagtaggttcctaaaagccagctgcggccagactgtgggggtgggcacagggtgtcaccctagaactcattaggccctggtcatcatggcacctggggcaggggaagtccagcctgaggggtcaaattctggctgcaaatcctgaggctgcctcctgtgaccacgggcaaggcacttattcttctaattgccagtggcctcattcataaagcaggcgtcctaatacccgcccaaggctgcggtgcctagcatgtgacctggcccacagaggcactcggtccacagatgttgttctctacctgcccccttcatttcgctggcaggactgcatgcagtgggtgtcaaggttgggcctcacacaggggataagtgagggctgatctgcagcccatactccacacacccagccatgtgccctggtgggggctcagcctctgcctggcagaaggggccctttcctctcacctgcacaacggtggcttcccagcacaaagggcttaaagtgtttgggaagtttacacccaggaaggctgtgggctggcctggcatagtgggctggcgagctggtgcactgtctctggtatgcaggaaagatagagaggagagggagggaggtgcgaagtcactgttgctgctgctagaagggccagagagagcccaggctggacaggcaaaacctggcctcgccagactcctggagcctgcacagagtgtgtgtctgagaagtccggattctggtgccagactgactgcctagtgagaagcctggcaccgccgggtcaggctagtgcactttttcttgtttgttttttgtttttgagacagagttttgctcttgttccccaggctggattgcaatggcacgatctcggctcactgcaacctccgcctcctgggttcaagcagttctcctgcctcagcctcccgagtagctgggattacaggtgccctccactaagcccggctaattttttgtatttttggtagagacggggtttcaccatgttggccagactggtttcaaacttctgacctcaggtgatccacctgcctgggcctcccaaagtgctgggattacaagcgtgagccaccgcaccaggccaggttagtgcacttctgtgagcctgagtgtcctccttgaaacggtgacaataatataccaggcctcttaagatcactcattcaacacatactggagagtctactgtgtcaggcattgttctaggatattgttaggattcagtggtacccagcaaggactcagtaaattccagctactgttcctattaggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggtgaggggcgtggcctggggctctccgggaggtcatggtcattgggtcactcggagcttgtgtttatatgaggcctggcagagggaggcccctggctacccacctttgtgcccgggttcaccaccactggtttctgcgttccctggactctgccctgcacgggccgcacctcccccgccggccctcgcccatgctccagccccagccctagccccaacagcggcctctccctgcttcccttctgacatcctccctgtcgcccaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggtaacgcgggggaagggggcaggaggtcgtcgggggcgcggcctctacgccctgagcagtgccctggacttgacctttcttttatttttttaatttatcttgctttcatttcctttccttttttctttcctttccttccctttcccttccctcctttcccccttttccctacccttgccttcttttcacagggtctggctctaccgcccaggctggagtgcagtggcacaatcatggctcactgcagcctcaacctcctgggctcaggtgaccctccccgctcagcctgaccttgcctttaaaggccactgcatgaggtggggaaggagatttgacttccacttgcctcggtgactttgtctgttaagcagaaccataatactggcccttcccctcctgtgctttgggcagtgactctccctagctcattgggaaccctggttgcccaaacagctctcaatccaacactagaggtgtggggggtcactgtggaatgttggggggcaggccccagtatgagagaaaaacccagagggatggtcctgatcagggctacccatgcccctgaggatggtggaatgaaggcagagtcgggggctgcataaaggaaagtctcttccagggaccaaagcttggagaactgagggtggaagggggattaaacagaagtgggtagggcagagccttctgcctgtgggctggatttcctcaggcaagaagcctgtgggtaagctctgtataatgcgaggaggagtccccacaaagcaggctggtcagtggtcacgctagtgtgagtctttcaaacatcccgtgtaagtagatactgtcattgcacagaggaggaaatggaacctggcccaaggtctcaagaaacaacccagccgggattcagactcggcagcctgcgcacttaacagccgtgagcaaccaggaactccccagccctttctcttgtgccttcaagagtgcaagaaactgaccactgcccctagagagctctctgaagagcattcccatggctacagattgggtttggagccgcttgggctcaccatgggccagcattgttttggatggcctgagggcaaggactgtccctgctcttcatgcatcctgaagattagctcagtacctggcacagagtcgatgttccagagaggtttggtgaatacagaaggtccctgttgcatggaatcctgcaaagcaatgttggtgttaccggaaccataggaaacagctgatatccaaccatttttgaacctacacaggtgtcagtttcatgtggttcagcctaatgagagcaccaccttaatcctgttgggttctccatctcagccccaggggaatgagcaacacaggggagctagctggtggtgccagactggggttcagatccctgccacatttacatgggctttgtgacacacgacgggtcatctaatgtctctgaactgcagcttctgcctatgtagaatgggagcagtaacacagagcataaagacatgataggggcaaggagagcaagtgtgtaaagcactcagctccgggttttcatgcacaagtgtgctgcacacttgtgcctgacacttattcagtcgcactagctcatctatagaatgggaggtgatacacgcctagcaggcttgttgtcaaaacaaactaagctcactgcagctggatcagtgatgaatgtcactgtcgtcatcattcccactccacagcctgaggcctggccaagtgctcctgtgatgtgccacaccagtccagcaggcaggggaaacatgctttgcttggtgggattcaaggtgtagggatggccctccctttacagtcaccaccctgggttgagagtttgttcctcctccttgctctgggctggtctctatgtgatatctgaccaagcccggtaactgtgtctgttaggtgggatgcatgacccattccagcctctccacagactcgggagtgctgtctctatgccagggtctgagaatagataccgatacatgggtcagcagctcctgtgggggtgtcactccactgcggagggaaaccaaggcagaagctggacaagagtctgaatggctcagatttgaatcattcgtttttggggggttttttgtttgtgtttgtttctgttgttgttgttgttattgttttgagacggagttttgctcttgtttcccagctggagtacagtggcgcaatctcggctcaccacaacctccgcctcccgggttcaagtgattctcctgccttagcctcccgagtagctgggattacaggcatgtgccaccacgcccggctaatgtttgtattattagtagagacggggtttctccatgttggtcaggctggtctcgaactcccaacctcaggtaatctgcccccctcggcctcccaaagtgctgggattacaggcgtgagccaccgtgcccagcccaagcgttagttgtgaaggtttattttgttgcaaatcccagtcctgcatgaaaatgggaatgttagtaacccctgcctcaaggtggggcagtgaaaacaaaaaacaccctgggagtctgcagaggtgtgggcctttcccatcccattctttctgctacaatcaaaatgatcgtttaaaaatggaaatctaggttgggcaaggtaactcctacctataatcctcacactttggaaggctgaggtgggaggatcccttgagcccaggagttcaagaccatcctggacatgatggcaagccccttctcaataaaaaaaattaaaagtaacagtaaaaaagtaaacgcagaagcctgagttccccctgcagtcaggtcaaagcccccaagtcttactccaggcctgctaaggcgttcccatccccttcagcttcccctttgggcctctggcttctcactgtctgggctttcgtgacaatgacctttaacccctccgggcaacaggtggttccctcgcctttcagattccctctgcctgggatgctctaggcctccatccacccagacccctttatgtgactgaatcctactcatccttcggggcattctcagagaaacttcctccacccactgagcccccagccagtgtggcgtgaaggtgggaagcatagacttgcctgggtttactcctccctgccctctgctagcttgcacaagctagtctttgtacttcattctcttcatctttacaaaagagaggataataatttctttcccagagaattttggggtggattcaaggagaaagtatagctgaccgtctccaaacagtgcctggcagaaagtaagcattcaataacatcagctattggccaggcaaggtggcttactcctatattcccagcactttgggaagctgaggcagaaggattacttgaggccaggaattcaagaccatcctgagccacatactgagaccccatgtctataaaaaccaaattaggccaggcgtggtggttcacacctgtaatcccagcactttgggaggccaaggcaggtggatcatctgaggtcaggagttcgagaccaccctggccaatatggtgaaaccccgtctctactaaaaatacaaaaattagccaggtgtgatgggtgcctgtaatcccagctactcaggaggctgaggcaggagaatcacttgaacccaggaggtggaggttgcagtaagccaagatcatgccactgcactccagcctgggcaacaagagcaaaactccatctcaaaaaaaaaaaaaagaacaaaaaaaggaaattagctgagcatggtggcatgtgcctgtagtagtcccagcccctcggggggaagctgaggcaggaggattgcttgagcccaggaggttgaggctgcagtgagccttgatcatgccactgcacttcagcctgggcaacagaatgagaccctgtctcagtaataataatatcagctattgctgttactggcgttattttttttttacatgccccaggccacccagtagggcacttttggaacacccattatgcttgtaattattcagttgcctgtctgccctgccagattaaagctccttgcctgcaggtactgcacgttctagctaggcaggggtcttgtttattgctttgctgtccctagggtgcatagtcaggaaaccttggggcccagttcttaggttcaaagttcagtcagcaatttgctagatgtgttagcctcaggtggtacttaacctcagcatcaccgtgtataaaatgggggctcctctaaacagtgctcaggttttatggttgtgagaattaaatgagatggtggatataaaggatttagcaccatgcttgcatgggatgctctcaatatctcgagcaccacaaatacgaggtaccattcatagcatccttctatttgtcccctcctccctgctcccctgctgtaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgta

SEQ ID NO: 36427 - DNA, 29716 bp, Homo sapiens
tgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggttagcggcgtcgccctctcccccggagctctggggttagttaacctttggccaggcagcgttcctgggcgttcgggacactgcactcggccgaaagggtgcaaacatgttggataagatgcggtttaactctttaaataatttaaatgtgcattggcggaaagctcactctctccttaattgtccccggcctccgggagccacggagagccttaaactggcgggcagagcgagtgcggtgcgtggcttcgcggggagtggtgtccgcccctcccctgtcccgccccgcccccgggactctcccgcaccccgcgacggtggggccaccccacctgggagacgctggcagcggggaagtcagatggcgtatcttttatttaattctcttgtcgggttgcagagaagtggttgaaaccgaggggggacgcggcgcactttacttcgagccttttagggatgactaaggactcatttaactggatgcctgctacttttttgggcttgccaaggtggttttaaatttggctgggagtcccccgagaggtttaaaataacccggcttcaggcagcataggagtctgatcaagtaatggtggttaacttcactcatgagtcctcctgatgagccaggtttcagagctgacttttttttttttttttttttttttttttggccatgtgacttaggtcgcaccctccacccctgaatcgcggtttgcagggaggtgtggtccttgccggaggtcaaggcttggtaatgaatgttgggcggttctggaggcctcagggaatagttcctcccagggagggtgagaggcatggccgtacaaatgaatgtggccagaaagacatctatctgccttttaaaatgggctttggagacttccagggacctgggtcatccaattctgttggttgtgtttaacatgaacggtaaaagttggaaagcattcacatttggacatgctgtcttgaccatcttcggaatggttcttttacaagcgccattcagaggtagcggggcttggtcctctcagataagccttttgcctctgtcttgtgacaccgtgtttgagagggtattgttggagttagttggaaaagtgttgtcattttttggtgtaatacctcgatacttttaagatgaggtcttgggcctgtggtttaaaaatgatacatggaaaaaaatgatacttgattggggttttttgttttgttttgctttcctttttaaaagaaaggccacgtaactgcttctcattccatttcctttggaaacttgttcttgtggaggtggctgctggcaccggaatcagactgaatttcctccatggttaatgcaaaatcaggttctgtttggggtcatcatttaggttgccataaaacagcacattttaaggcttgtatctgtaaggttgctgaaaggcatgtgcctgtgttgggggatgtgacctttagtgtggctctgggggtgaagtaggggtatattaactggagggtgttactcaccaacagctgttgggcgggcctggctgtgtcagccatgttcccggagttcagttgttcccatcgacacccactgccaccttgagcaaaggcattttctccttcagggagctgcccagtcgtgcagccagggaggcctgcagttcctctgtgagctgccagagtctgtccgactcaggaatagggtttccagcgttctgggccattcggctgagtgatttttctcaggcatttatagaaatggctgcttctgtgtgcgtgcatgcgtgctgctccttaattctccataaggcaagtcattcggctcagctgtttcaggagaacctttttcccagtcaggagtggaaaacgaagtgagatgttcattcagctttaagtgctacagtcagtgctttgaacctagggatgtggtgattgcaggtgcctatgttttggggatctctaatcttagtgcatggttgaacaaaacctcagcctgggttaatattgtcggaagtgtattcctgctagaggaggtatgtgttaaggttactttaaataagagacttggaggtctcatgcatttggaagtttcagatacaacttcaatttaaattgactttagggtagggtaaggagcttttctaattttctttctgctggtgttaaatcaagaaggtgggcagagatggcatttggaatgtctgcattctgtgaagattttaggagctaaactccctgccacacccccttgcttagtgctgctaacattccctcaagaaaccctccagcttgctcacttccttatagagacacatacagctgccacttcatagaccacttctacaccagctttagaagttgaatcattcaaacagattttcttctaattcagtgctgctacttctgtagtgtgctgggaggaacgacacagttgaggccagctaagctgggttctgatttgtcctattgttttctcatttgagaccataaggaagttactttaattcagagtttgcaaactggaggcttgctgctgaatttgctttgcagatttgtttggcttggccaacacagggtttataaaaatttaattagttaccaacatctaaaaatcagaggattatagcatgaatccagatttctggcttgtctggaaaaatcaaaagatctggcaaaactgggcctgaattcttgcctagcaacaattggcttgaactgatcatgatatggggcagtacctcgtattttaatcatttacaggatctcttttggcatttaagtttgcaacctctgctttgtttaagcctcactttcttaatccacaaggtagggctactatcctcaagtcacaggttcttgtgcaaagataacatctataaagcacttggtagggttccacacacagtaaccccttgagaaatgctgggtcctgtggtttgtgtataatgtacagaacgtcaccttaaaaatcaggaaacactggataaacttatttttaagcagtatgttaatttacattttcaaatagtatgttcagtttgtttttcttcaaccagaccagatcttttcaggtgacatacctctaaagtttaagcagtggatccattgttaatctaaagaaaacaaaagatgcaacaaatatactatttttcctgtttccagactttttggacactttatgatgtatttatttgtactgtttcagattaattttagaactattagagtattttatatgaaaatatatcaagcatattatttgaaaatgtaattaacatgaagtttatcctaagtctcctgactttgtggatacctttcacatagagtatgggcagattttggggggcgggtggtaaaggcagtgttataaggaaacaactacattctaattccagctcggaagtcatcagaacaggctgatgttgaatcatgctgggttgatatctggatgacagaaaccttaggccttgtttctgtgccaggtgccatcttattctctttttggaggggcttaagtcagctatcgccaagtggtgacaatgggttgagtttgataacactggttataggattctgaagatcagaaaaccccaaattccaaccatgacaccccagttctatgaaaaaatatttttcagtatatatatatacatatatgtatatatatatacatatacatgtatatgtatacatatatatacatatatgtgtatatatatacatatacatatatatgtatacatatatacatatatgtatatatatacacatatatatacatatatgtgtatatatatacacatatatatacacatatatgtatatatatatacacatatatatatatacatatatgtgtatatatatatacacatatatatatatagtgcaaaaggaggctcacataaaaaaccaggagaggtgggggctacaaaagcccggagtggcggcttctgctccttagcctcttcgaacacattcttgggatccttggcatacttggtgtgagggacctggatagcctctgtagtagaagttgtcctccaatatggaaaacagatttttttggtccctctaggaatgtccatcactagccaactctaacttaggtgggaattttgcttaaaggcatgaggttgccctgagcttcttgcactcttctcccttaattactgtaaaaggttttggagtcaactgtttggtcaaggagagtctgatgtcatcggaggtatcaggaaaaactcacttcattgcctgggaggtggggccttagggacagagcaaggccttgccctagactaaggggccttagctcactgggctgcccattaagtaggccctgcccagcccttaccaccatctcttctcttcatgagtggaacggaagccctgtacctggatccttagggacacattctctctaccccattcttctttccagagggctccccagagtgatgtggaatggcatttcataacccaacttgcttcatccaacatagatgtacaactaggcctgagtggggcttgcacaggtaactgtttctctaccctttttccataattgtcccctccattactgatcctcctgcctcagcctccagagtagctgggattatgggtgtgtgccaccacactcggctaattttttgcatttttagtagagacagggtttcaccatgttggccgggctagtctcgaactcctgacttcaagtgatctgctcacctcggcctcacaaagttctgggattacaggtgtgagccactgcgcctggcctcccccattacattttaattccacagatacacttgagctgtttatggactatgccccattccgaaggcgacaaatcgttgtaatagctaagacttttttcacctgtcacagaaccaatttttgccccctgggagatgatactgcctcaccccactcagcaataggagtgatatcaagtatcctgttagggaagaataacaatctatgcaaaaggctgcatacacatggcttctagctatagaggatgggtttctaaggctgcaagggtttgctatagggtttgtttctgggttttagacaagagggtaaaactcccttgaatcaagtgaaagatgcccagactgttcttcagcccccagcccaagctctctgcagaaatctgaccctggggctggaggctgttaggaccctatagctcttattgctagtcacaaggtaggagccacccagttgcctttctttcctcatttcccatttgtcctgtgtcatcctccatctatctgccctagcaaagacagtcggggggcctctgagaatcttctgctggcaagattacagtttcacgatagaaaacataagtggagtcaaattacagagtacgcacactgtttcccttgattttcctctcacatcttctgtgcgtggtgagaagagagaggggaggggtataagtgggttcctgggtgagagagggaggtaccagagtaaatacagtgccacttggatggtgacaccccattaccttcagacacaaagatgtaagctgagggaaatgaattcttggattcagggaaatgaattcttggattctgaacatgagggtcagatttacattcctgtctcaattgttgacgcttatcccaaggactagtcattctgcaacatctgtgggaaattcccagattgaacttcccagggagaaacatcatatgacatattgggaaaatggctgacaatggttttccttagtaagttcattgagaagaaaagtgggcggatgatttcccagtcttcactctttcagaagcccctaaaacaatctgacatgctctagttggagcctgctttctatcccatcagtttgatttctgaatgccttatgatcattagcattcttcattaaaaaaaaaaaaagctttgtcgcatttgttagtcttgacttccaaatcttccgtgttctttttttttttttctctctctctctctctttccctttggctgttctcaggcttggagaaaaagcttgtagcatgccattccttcctccactgctagaatcctcccccacatccgaccctcccaccttttcctaatgtttctccagcaagcccagcgcccactgaagagcgtaaattagtgcctagtaattggtacaaaggcactttctgtttctatgcaacacacgcagaaaggaggggcaaaaggaagacgaagaaaaaaaccccacagatggttaaaaagggaaagaagtgagatcctctttcagtggtctttgagcaatcctggctctctttctccgccccactttttgttgaaagttagtcacaggcctaggcctaactcagagcacttggtggcagcagttgttagtatcaaaagaatagcacttggaggttggaagtgaccttgggaggtcatcacatccatcattttgtctttaagaaagcacatccccaccctttctcagagagatggggattgttctcttgaaatgttttggggggacttgaagggctttgaagcacaccaccaggtttcaaaagctgcctatctgccttgactagcatgtgagtggtcatactgtgtaatctcccagagcctcaccagctcatgagggtactaggtagttggaagcatttgtcagcagaaaatgctaaagcccctagcttcaagcttggctctgcgggtgcctaggaatttttccttcattttgaattctttgcagtactttcatttgaattctttccccccacttgctctcctgggacttcagtctatggttaacatttttctttttcaccttagtttaaagggctgcttcatggaattaaccaagtgaaagggcagaggtggagtgagctggggtggcctatgccctttttatgggagcagcactctctttaacagcccaaggcagagctgctgagaggtttcctaccactccctacctggaatcgtcctgaaactttaatacctttttgatgcattaaggccacgagtaaacatttgttttatcccagtgtcaagcagtcccctcagcaaataataggactaacattattattcataagaatgtgatcccccctgagggagtgagaagcacccattttttttttaaatacatgggaccttccaaggccattcattgccatgtgtgtccaaagcctttttgatggtgtgcccgaagccttctcttttaatctcagtttctagtgtggtataattgactttggaatcctgagatgagaattgaagaacctggatctgaaatctaaaggttctagagctgagagaaccagtttgctcacgatctaagccagagctgctgctgctgggcctttgaatttgtttattttttaatgaaactgagaatgatcacaaatttgaacaggagaaaggaatctaggagaatttgaacaggagaaaggccaatccttaactggccagattgagtctttttaaaaagtgaggacatttatttaaatagattaaagtaagagacgggagcttaagccatacaaaattagtgacaaggatttgaaatgcagtcagtggtgttatgtattcaatgaagtttgaacatttttccaagctgagcctccgtccttgtggaagggagtatctcccaaagggcctgacttgaaccaaagtgggaaccagtggaataggcaatggtcaaaaacacaaaagtctctcttgggagttttggacattttagaaccgggagcaaaattacagatcatcttggcccaaagaaatagagggagaagaaaatgtttcaccatctctgtcttccagagagctagctttcataagacaggcagttagaaatgaagagtaaggcctgacctatttcatattgaacagtcaaactgaggaactggaatgtgagggggcctttaccttcagtacagagacagtagatagagtcgtcagagcacaggcttttgggtccttctgacatgggtttttgaatcctgtctccaccattctatttatgacaactcaggctctacttaccttctctgagcctcaggtttctcatctgtaaaatggagctcagtaattatatatttatgaagttgttatgaagcttaattcagatgaggtgtttaaatcatttagcacaccattataattaaaaataaagaatttatgtgtgtgttccagaagcccttgattcctagaatttttgtttagaattccagattagtccagcactgcctcattcacttcaattatttattattattattattatgattttgagactgagtctcactctgtcaccgaggctggagtgcagtggcatgaaggatcttggctcactgcaacctctgcactctccccgcctacttccccctaccccctactcaagcaatcctcccacctcagcctcccaagtaactgggaccacagatgcacaccattttttgtagaggctgggtttcactatgttgcccaggctggtctcaaactcctgagctcaaaccatttgcctgcctcagcctcccagagtgttaggattacaggcatgagccactgcacccagccatctcattcacttaaattatttattgagtgacttacatgcaaaaagctgtgtaaaatgctggtaccaggcactttggattttgtggctaatagtgataataatgacaatttctaacatttattatatgtcaggttccaagctaaatggtttacatgcattgtcacatttaaactcacagcaatcctgtgagatagaaaggtgctgttcttctcatttaataggaggaatcagactgggagttagttaacgtagttcaaggttacactggaattttcctagtctgtctctaggtgggtggagttgggcatgaatgcttgctgatctggaccccttgagtttccgccagtgggaagagaccctgtgttttacgtggttctcttgggtttggtcccagagccaccagtcttcagctgtctactcttgttgttctgactctggcttatggttggttttcatgaacctcggttaggagtgtcagcagaaatcttggactctgaccatacctactctgtattttccatagttatccagaagctgcttccttcccattgaaaaataacctggttgtgggcccaaagctgtattagtcaggacaacagaatccaaacagggactggcttaataaaaaaaatgaaactttattggttcaggttacaaacacatctaggggtagctctcatttcggtgtctgtggatacaggcactcagtttctgcctctccatggctcagttttgctgccttttgctacagcctcattcatggggttggtgggggctgtctccaaatagtggtgagatggctgcccgcagttccagactcatatcctgccacttaagcaaaccccaaggaaagacagttttccattcccaaagattccagcaaaagttccaggctttaagctccatgactagttcagattgtgtgccccatccctgaaatgaatcactgtggcacgactgggtcacatccaatctctgggtctggaggtgtggggtcaccctccctggaactacatatatccagaatggggaaggagttgttgccaaaaggaaatttaatgtgttatttattatccagaagggaacaaatgccagacaggcaaaaccaacacccattctctctgtcatcccatttagttagttatttatttttatttgtatttttttgagacaaagtctcgccctgctgcccaggctggagtgcagcagcacaatctcggctcactgcaacctccacctccctggtttaagccattctggtgcctcagcctcccgaatagctgggattacagccacaccccaccatgccaggctaatttttgtatttttagtagagatgggttttcaccaggttggtcaggcttgtcttgaactcctgacctcaggtgatccacccgcctcggcctctcaaagtgttgggattacatgtgtgagccaccatgcccggctatcatcccatttataactaccaacaggattttccaaagaacagagtttgacaaaatgagaggcaaacagtacgatatttttttttctatatatttttcttccttttggtgggaaggagctccgaactatctctggagttcaacccgaaagataggccataagtgaatgtacagaagggtctttgcagaagatagatgattttgacaggtattacatacgcttaggcaaacacccactggccctcctgagtggatgttctagaagccaataataaaagcctcacatggaacaagtataacagcagcagggtgaacttcaaagccattgacttggttttaattccagtctgtccattttaatgtccagagaaacaaatcatgtttacaggaacatttattaccctatatgctaataggtaaaagcctagtctatgcaaagacgagctgtttatatggcagttcccactgggattcagaagtgtattcagtgtgcacaatgcccaagaaaaacactgtaataaatcataagaggcaaaaagtagagcttaaaaacaacttaacaaaaacacataaaagtgacttaactccctgtgctctgtaattctacagtagttttgtaccattaccattttaaggaaaataagcagaatgacaaccaaacagctggctttctctcgtattgtaatccatactcatggccagccccaaaatgcttgttcagtgagcattatcccactgaagcggggggttcccagtgtgaaaaacataggctattttctctaacctgaggcatttctttttctttttcttttctaattgattttattttattttatttttatttatttattttttttgagacagtctcgctctgttgcccaggctggagtgcagtggcatgatctcgctcactgcaacctccgcctcctagattcaagcaattctcctgcctcagcctcctgagtagctgggactacagggacatgccactacacccagctcatttttgtacttttagtagagacggggttttaccatgttggccaggctggtctcaaactcctggcctcatgtgatccacccaccttggcctcccaaagtgctgggattacaggcgtgagccactgcagccagcctaattttttttcttttcttttcttttctttttttttttttttttttgtgaaggagtcttgctctgttgcccagactagagtgcagtggtgcgatctcagctcactgcaccctctgcctcccaggttcatgtgattctcctgcctcagcctcctaagtagctgggattacaggtgcccgccaccacacccagctaatttgtgtatttttagtagttgatagggtttcaccatgttggccaggatggtctcgaacttctgacctgaagtgattcaccggcctcggccttccaaagtgctggattacaggcatgagccaccgcacccagctaatttttgtatttttagtagagacagggcttcactatgttggccaggctggttttcctgagatggggtctcactctgtcacccaggctggagtgcagtggtgcaatcacggcttattgcatcctcatgctccttggctcaagcagtctctcacctaggtctcctgaatagctgggaccacaggcacgcaccaccatgcccagctaatttaaaaaatttttttttttttttttttttggagatgggatctcgctatattgctcaggctggtctcgaactcctggcctcaagtgatcctcctgctccagtctcccaaactgttgggattacaggaatgagtcactaacacccagcctaacccgaggcatttcttcccaaagccctgcttgctcctaaatttcaaaacaccctctagaaatacatgcccaaagaggggactatattccttttctgagatctcagggggagggttgagtggggactgttttgtgaagggtggacagctctgacctgcagttctttgtggtctttggtgccaaacatcaagccatgtgacttagtggctcactccatcccaagagtagaagggttaaaagcttgaaaagctgctggtggcccatgtggcatgtatgagtaggatttatggccactgcagccatactgtggtgtgcatacagtgtgcagaggttgagcccagagggaaaaacctggatggaaacacttgctggagtggcatcacttttcaccatgagtccttatgaatgccacagcctagcaggtagagtacgtgttgactaatcaggcatcagtctctccatttctgctgctgggggacaatctttttcttggcatttcagggtctcagttacttctgcattaaattgtattctcttttggctaaatgtttgcaaaatcagggttctctctctaattcggggtcccttgcctttcctttccctgggagtgatcttctgtttggtgggcatggggctcatctcttgtttcagcctcgtgggagagccatccatgttgcatgctgtcctttgaccttgtggtgatgtccactgagacgtctgtcatgcacttgcctgtgtccccatcctcacaggctgacatcagtggctctgggtgttagatccttgcactgtgacccagtcctcctgtggatttctccaacagcacagttttgggctcaggaacacagtccttttccccaccctgcactttagaagggtgcgcacactgagacccctctcagctgtagctccccaactcctcaggtgttatggcctgtgtggggcttccaagaggaccttatttgtataaggcacttcctctaggcatgtctcgaaggctgtctctacaaggagaataaagacctggatatttcttagagacctctgtgtctctaatacagtcctaccagctctttctctttttctgcccctcatgtcttggttggaagatctggcaaattgagagtttttttaagctcaaggacttaggttttctaaatgctactttgaaaattaaagctcagtggcaacttatttatcctaaactatgtctgatccccctgaggcaatgcatttggaaggaagggcctggaaggcagagaattggaaaaaaaggcactgtgaaaggtcagtctctgtgcttttagtttgagtccaggctcttctttcacatctaatctcattttgtgcataaaactgaaggagcaatttgaaacctggttttaatctggtcacacactattgtgcagggcgtccttgggcacgtcatctgccctctgagttggcttcatctaaaacatgacaggtttgaattccatggtgataaaaatcaccaaaattgcaaagattcaaagaatctgttcttgggatagctttgccattaggcatttatatcttgttcaatatttaatgcctaggtagatatttattatctatgtttcccacaaatagctgaacaaaggcagcatagtctgggatggcaggaattacctagtctgggccagggtctggtctttgaagggctagctatgtggttgtggggaggttgcatcatctttctgggcctttggaggatccctaagatttcatccacctctaaattctgttactctgacttttatgatcttttatcacactacaccaagaggcagatcttcattgtgttaaaaatttatgtttagggtccacattttgcctctgcactatttttagttttcaggcagggccatataactgagacttcaagacagctcttggccaggtgcagtgtctcacggctgtaatcccagcactttgggaggctgagacaggaggatcacttgagcccaggagtttgagaccagcctggactacatagtaagacccctgactatacaaaaaataaacaaaattagttgggtgtggtggcatgcacctgtggtccagctacttgggaagctgaggtgggaggatcacttgagcctgggaggttgaggctgcagtgagccaagatcacgtcactgggtgacagagcaagaccttgcctcacagaaaaaaagaaaaagaaaatgtatagtttttgctgaatcaagaacctaaagaggcaagaatctgttgtcagctgggcacagtggctcatccttataatctcagcactttgggaggccaaggcaggaagatcacctgagctcaggagttcaagaccagcctggccaacatggtgaaaacctgtctctactaaaaatacaaaaattagctgggcatggtggcaggtgcctgttgtaatcccagctacttgggagactgagacacgagaattgcttgaacccgggaggcagaggttgcagtgagccgagatcgtgccactgcactccaacctgggtgacagagcaagactccatctcaaaaaaaaaaaaaaaaattctgttatctgctgtcttttgtttgaggtctgctggaactgcatgtgctgtctcacagatagctgaggttgggaatgtgtgcacgatatttggatatgcttgcttcttagactctgacatgcttaaatgaggaagtgctgcatacagatgtcagagacacacacccacttctcatttcagaacctaaagcataggacaagttgctttctacagataaacacagagatccggaagtaaaatctcacacctaagccctacactgtctctgttgtatcaacaaatacaatataaacggaagccaaatcacaagcaggattcagtgagaggtcagaagcaaatggtagtaatatgatgggatggcattcaggcaggattattctttcaaagcctatttaacatttttattcgttcagaacatctacatgcaaagcaatatttctgataaacaggagacttttgaatgaatgatttttgagttcagtgttcattgaaatgatgtatgcagaaaaatgtggacttctctgtacccaggaatggcctgcacacctcttccgtaatgtgtattggtggttctgcacatgagggtaatggagaatgggaaaaaagcaactgttcatgtttcgtacctgcatgttgacattgctttttggtgaggagagaagccagatggtgatggacaaatggggtgcttgaggcctagggtcagggcaggtctatgtggatgcattccccaccagtctggtccatgaatgctttcttagactcaaatctttgcacttcttcatgatctgactcctctcacctgctttctaacaaggacactcctttgttgggcaaccctactgttactgtttgtgcatttccacctctgaaggaaggttcctgtctgttcttataagagggccatgtccctttcacatatggaaaaagtaggagaggtggaaatagaggagtgagaagacagatgtagtatattcaggaagtttctgactttctccgttttgtttttttttttagtcagagtctcactctgtcacccaggctggagtgcagtggtgcaatctcagctcactgcaacctccacctccagggttcaagcgattctcctgcctcagcctcccgagtagctgggattacaggcatgtgccaccatgcctggctaatttttgtatttttagtagagacagggtttcaccatgttggccaggatggtctcaacctcctcacctcaagcgatccaccccccttggcctcccaaagtgctggattacaggtgtttacaagtgtgagccatcacaccgggccaggaagtttctgactttctgacaattagtttgagaagaagacaaaatgactcttctctctttggtcatggatcacttactgaagtgtcccagtaatttctcaatagaaagtaaatcacctactgccctccacttccatgcccatggaatatattccttttaaaatttttaagagatgaggtttcactatgttgcccatgctggtcttgaactctgggcctcaagcagtcctccctcctcagccttccaaagtgctgggattacaggcataaaccaccatgtctggcctggaatatattcttgatcaagccatttgtggaatggtttaaactcagatgtatcgctgttttctgtaagacttttaaaaaatattaaaataactttttctgactttttctcataaaagaaatttatactcactgtttaaaaaatcagaaaacatagggaaaaattacaaaaggaagtagaagttattctttatctcctcactggtagatagtaattgttcaaattttgtatatattctttttacttaatatttttttaattttaaattgtagtagagatggggtcttactgtgttgcccaagctggtcttgaactcctgacttcaaatagtcctcctgcctcagcctcccaaagtgttaggattacaggcatgaaccacctcagccagcccatattttgtgggcaacaggatttttttctctccatatatattcacacacttatgcagctgatcatacattgttcttctcagttagcagtgtatggctaacatctttccatttcattatataacagtctggtacctttttcacaggtacatattagtcccctgtaaggatatactttatgtattaaaccagccctttatttttgagcatttaagttaccaccttttagctctcataagcaatgctggtatcccttttcatgtctctatctaattattatcaaattaattgccaaaaataatctgcaggagaatattgccagatggccctggattaattataaatcccaccagtgtggtagagggcctgtttcctcatgcctccaccagtggtcggtatgaacagattttttaacgttttcactagcctcacagatatcttgctggtgtcttaattggcatgttttgattacttgtgagattgaatatatttttgtatgaaatattaaatattttcgtatttatttcttggtcattagtattttatttatgtatttatttatttatttattttgaggcagcgtctggctctgttacccagactggagtgcagtgacacaatctcagcttactgcaacctctgtctcactggttcaagtgatcctcccacctgagtagctgggactgtaggtgtgcaccacacagcctggataatatttgcatttttagtagagatgaggtttcgccatgttacccaggctggtctcaaactcctgggctcgagcaatctgcctgcctcgacttcccaaagtgctgagattacaggcatgaaccaccacgtctggccagtatttcttactttataaattatttatttgcatccttgcccacttttattaagttgggctgttcctttttgatttgcaagtcctttctgtgttacagattttaacattttgtcatatgcttcaatttcttttaatttattttgattcttaaatttttctacttatatatatttttaacatgcagaagtttaacatttttacgtattcaaaactatccttcaagtaggattttgcttttggtttcatgtttagaaagtctctattccaggattctaaaaatgctcacctatattttatcgttatggctttattttttacatttacatttatagcccatttggaaatcatttgagtgaaaagtatgaggtagggactaagatttaatttttttcttttacctgacatctaagccacttactgaattaaacattttctgtttcactgatttgaaataccccatttaccatgtacagaatccctatagattcttaaggttattttcagaccctactctgttccactgatttgtcttttcctgtgctgctatctcactatcttaattattacagctttaataatccattttaataactagtattgcaagtgctcacttattatttgttcttccgcaaaattttcttggcaagttgggcatgtttattcttccaaatgaacttcagaaataactttgtcaagttctagaaaaagaaattcttacggtgtgtgttaattccgtagatgaatttgtacagaattgccatattcacaccattgagccttaccatccaaaggcatggcaagcattttgtttgttcattttcttttatattgaggctttatgcatttcttcaccaaggtcctgaacttttattgttaggcttattctgactggttatggctggcatataagaaagccagtgctcttttgtacagttacatctgtgaatgcacctttaatttagattagatttttcagttatcttgaattttttcaaagagaaagttgtgtcaactgcaaataattcttattttataacccccccttcttctcaccatttacttcttattttatctaattgcactcattagtatttcctggaaaatgttaaattatagcaatgggagcgggtgtccatttatgctttgggctagactttagtagttatactacctttattttactgttgaccttgcagaggaaaggtttcagagctgatcttttatactgctgaggaattattttattttcctgaaagcttttattagggatggttgttcaattttatcatatactattttgtacacgataagagtgtgtatatgatattaaatgatactaaatgtgtgtgtgtgtgtgtgtgtatgagctgttaaatgggggaataatatcagtatgatttaataatatcaaattgtcctttttaaaattacatttcttttgtagagttggggtgttactgtgttgcccagattggttttgatctcctgggctcaagcagtcctcccatctcagcctcccaaagtgctgggattacaggcgtgagctaccacagccagcccaaattcttcttttatctatggaatcctagtgctgtttttgcaatcagaaaccactcttttttttttttttttttttgagacagggtctcagtctcactctcacccaggctgcagtgcagtggcacaatcatagctcactgcagcctcaacctttgggctcaagcaatcttcccgcctcagcctcccaagtatctgggaccacaggcaagcaccactacgcctggctaatttgttgtatttttggtagagatggggtttcaccacattgcccaggctggtcttgaacttctgtgttcaagtgatccatcttgagcggctgagcattatttttcttctagaagaagtcttgattttctacatctgcaagaaactttaattcttaattggcactgtttgagctctgttctgaaaaggaggcctaaatcccttagatttgttttttaccagattggtttacttttgctagatgcaatggaagcttttgattttgtatttttgactttcctgtctccattaaagttagacccatccctggacttgggtggggcagggaagatgagaagaaccaggtaggaaagagacgacattcagatggcaggcctccctgaccccaggcaggacttcagtggcagcctggacagctcagggagtctggggagggttgcctatgtccagtgagcaagcttggcacttggcaagtacccggtctctgtcttctctatggagaactcacctccattcgtttcaggactgcccacaaaaaaatgggcttcatttggcatcatcaactaatcagcagtcgaggaggctccctctcaaaagcagcaagtgtccttttgtgctaagtaggcaagcacatagccagggggccccagtccactgttcttgcaccctccgtaggcccaggagaattctggaggcctgatgactgtctctgcaaaggaagtcttttacacattgtgcgcagtgttcagtagcttttttgatcacatttattttatactctgagctgagtcagtcagcaagaggtgcttagcttgttactgaaaggggcggggagtggtatataaataatgagaactcagagaaacttgtgctgttaacagctctgctccagtaaagtggagtttattgtgtcactgcctctgggtgtgttttcctgtgaaggccagaaataatgcagtggtacaagtgtgttgggtatttttttccctatccccaggaggatggtaactctctcattaatactaaagacaggtttaaagattctctaattgatagttgcattgctgtgtgatttgttcagcgtgaaggctgaccattctcctttagaccttagcaccgagcctcaaagagagggcctgacttggtttcccccaggctgccagacgaaggtggagtgaccgtctctctaggccagtcctctcctcctctgtagatcatctctggtcccattcagccttaattctgttctcgtctacatgtgacttccccattccatgctttcttaagtgcaaaacatctatcattttctaaataataccttattatatgactgtcattaacttatatgctgggatgttagattcaacatcatggcatgttagatccaaactctccactgtattaaaaaggtgggagatttttcaaagggctacaaattgtaggtccctaagcagaatccagcctgcgtacacaccactgggtggcaccataatttataatgttgaaattgaatgcctctaagtaggggaagcaccctgttcagttcaccatggaatccattatgatccatgattgaatgcacctgctcccaccctgtccccgacctgtgtctggctcctgaagacatttgaatttacaaattctggtggccagttagaagttcaagtcctctgttatttgtttatttacttgagacagggtctcactctgttgcccagactggagtgcagtggcgtgatcttggctcaccacaacctccgcccctcgggttcaagcgattctcatgcctcatccccagtagctgggattataggtgtgcaacgccacacccagcttcaagtcttttgattgagatcaggaatcaaccaactttttgcaaaaggtcctgatagtaaatattttcagctttgcaggctgtacagtctctgtgggcaactgctcaacactgctgttttgagaatgcagctgtagataatacttaaaccaatgagcatggctgtttccaataaaactatatgcagacaaggaaattttaatttcatataactttctcctgtcatgaaatattcttttaatttttttcaaccacttggtaaaaaccgaatataagaatggtataagctattcttagctcatggcaggccagatttggccagtgggatgtggattgctagcccctgatttagatcactgaccaaaaagtttttaaagttttccaaaggatgccagataaatcaaaatgatcccgggccttttatactagcaactcacttccaagcagatcttttttaaatgcgtaaaaatggtaaacttgaattatacaagttacatgagtctaacgaagcttctatttgctcttgattttctcggggctctgtgggtgtccctctctgctctctgtgaaacacttcagggataaggacgctaggtcaatgacagcacttggattagaagcaaggagaaccatcacaaaatgacagctccaaggggcagtcaagagagtatcactgtcagctaggtcgaaagtgaattcagtgggaacaaaccctgattacacttgaaatatatgtaagtcacaagcatagaaacttaatagttctcctattctgatggcttcatgccagttttccatggtcacttctagaaagccatcttcctaacacagcgagagtatcttactccttttccagtcctagcccacagctgaatggtcttctggtccattttccccacagtggacacagatcccccaactaaatgaaccccctcctctcatgactcacttgaaagaaatgagtacacatgccagtgaggaggctaagccacattagcactcctccaagaaaaccacttctaatgagtttttgtcttaacaagcattgagaaaacactgagctcttcctttcattgttttcctcaccgccacatcagaagggagtggagaaagggctccaaaaaggaccgagcagagagggcgttttgttttggtttggtttggctttttgcaacttaaccattctatgagttctgaccccttgttatatttttcatagaacatgtttagaaaaacatttcccccataactgcttcactggggttaaagaggacttcactgcagtctaattctgcaatagctcaggtttctccagtagccagtaatatctgagcagatttcaatgtgagtgaccaggaggaggacgagagagagagagagagagtgtgtgtatgtgtgtgtgtgtgtgtaaagtttgagcatttaccaaatgcttggcaccatgagtaggacaaaagtcatacatgacattatttttgcctcaagaagctcagccttgatggggttgtaacaatctgtattttgacttttgctcaaaagtctgctgaagtgggttaaaatcctgtttatctaatggaagttgcagaagtgtagttttcaactccatgtctttattgagtttttcacgggaaactcttttttttttcctctttgcagccccatccccgagcatcaaaatgcatcaataaccctagctcttatccaccttgagtagggcccagcattcattggtttgctattgccttttgctgccgtagcttttcagctcagagctccataagggtttatacgtagatctgcacatagagaatcaactgctacagattcgttttacccacattgggtttcctcgaaaagtacgttgtacagggtgttgttatgactattgctctgcttagaaaacagcagagagccttcatcatgaatagattatcacaaaggtgatagatttggttgttttatcatatttctgcatctcatcagcacaggttaagagacgctggggaaaatagaatgaataattttggatgactcaaatgcaccacgctggacagctcccagcctctgcagtttctctatgggttctgggaaggccgggacaggagtgagaaaatattcactcctcacacctagccaaggagtgtctggagagttctgcggaaaccaggaggctgtgtgtcctctgtctatgcagcagctattgtcagctgtgcttggaaaggtgtgaagagtaggcagaggcaggctcttgggagccagggcgatggcagtcacttataagtggaacaagtgtggttctcatcttcaacagctcgtctgcttgtctgcctgtgtatgtcctccccaaacacagacatggccttcacctcccctgccttcatcttgtggggtggggagcagcaggaggttatggatgctggcctgataacatctggcaggcaggacttagctgcattttcagtgggacacagacattagtgtgaatccaaggaaagcaatcggaaagagggatgtggaaattgtcaagtccccaggacccccaggagtcaggacagccaagtggccaagagcacgggccttggtagacagggccagttcattactctgctttccagttatgtgaccctgagtacagagtttaaccctccaagtctcagttttctcatctgtgaaatggggcaaccttgtggagtgcttgtgaaaattcagtgagaagggcacgggaagcccttagctttatgcttagaacaatgttagttcatcttttatgaggaatatagaagaaactggaattgtttggaaatgggagaagagattaaagaaagacatatctgtctgcagatatttaaaggattatgatgtggcagaaggaacaaacatttcttttttttttttctttttgagacagagtctcactctgtcgcctaggctagagtgcagtggcatgatcttggctcactgcaaccttcgcttcctgggttcaagcaattctcctgtctcagcctcccaagtagctgggactacaggcgcacgccaccacacccagctaatttttgtatttttagtagaggtggggtttcaccatgttggtcaggctggtctcttaactcctgacctcaggtgatctgcccgcctcagcctcccaaagtgctgggattacaggcgtgagggattacacacctggcacaaacttacttctagtgttaagacaatatgacttaaagtatggcctttgcaggaaggcagattttatatcaataaaagatgtgacagagatgctcaggaacaaccagatgctgagtggcccctgcactcaggagctcagggagaaatgctcgttccaggtaggaggctggttggacccaatgccaattcttttccatcctacaacaccaagaaatttagcaaaaaggctcagcttttttactcttgaaagaatttatgaaaccagcaattgtgtggaataaaacagaaaaaatactttccaggggacccatagggtaccaaatggcaagctcatttgcttagagatgttagcaactttctcattgtattagtttgggctgccataacacacaaccacagactgggtggctgaaacaacagaactttatttcctcacagttctggagactgggagtccaaggtagaggcaggggacgggttcgtttcattggaggcctctctccttggcttgtagatggtggcttcatccctgtcttcccaaggtcttccctagtcttcacatgtctgtgtcctcatctcctcttataaagacaccagtcgtggattaaggcctgccctcatgaacttgtttaacatcagttgcctctttaaaggccttaacttcaaatgcagtcattttctgtggtgctgggggttaaggcttcaacatagggattttggggagggggacacataataatcatctccgagggatttatcctttgagtcgtagggactattgaccatgaccgcccttcggaatttttttcatgttctttgagctgtatcctttctgattcctttctcttaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggagaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactaggaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctctt

SEQ ID NO: 36428 - DNA, 6502 bp, Homo sapiens
cggggtgggattccaacccagaagcgggcatttggagccctcatgcttcaccctagctccctgaaacaagcacggaggatggctctgagcagcgaggaaagtgctggaagcaagcaggccgagcgcgtccctggctggggacgttaatcattaccggagggcggcccgagcgcggccccgccccgggacggcagcctgcgcgcccggccgccgcctgccctctccgctggccacctgctgccgcccgcgccatggtgagtccaggggtgcgcggccgcgatcggggcagcggggccggggcagccgcgggcgaggtgggagcgggaaggggcgggggaaagtcttttcgagtcccctgcggagccgccggggtccgaaagtggggtctctgcccggctctctgtcgctggcggcggggaggggaagctgaagccctgagaggggcggtggcgggttcgaatcccacccagttgggaggccaggcctgccctgaccccggccagtgcttgttccgggacccttccgggggcggggcctacgaccttcctgggccggggaagacagtcgtggaggagtccacggatctcgtccccttggtggcccgattctgctttatactggggtgggagcgagagggaggctgagtttgcgcgctcgtgtgcgtgcctgtccgctgccccttcccgctggcactctgggtacggggtctgcctgggactcacgctctgcgccggtatgctggccccagagccactccccgcgccggcttgaggcccgtgccaggccacgggggcttggtggcgctggagcagccctcctcccgtgagcttcccccacccacccccggggcgggggcgggggcggggcccttgctctgctgtaagctcgcgagcttcatcagaccatttctggtccacaggccttcggagcaggcaagactgggagggccttttgataggagagggacttgggggagggaggatgagtggggctgtttgtgaggggcgctgaggtcccagagatgcaggcttgggaaatcggtaaccactccccacacctcgccagaggaggcaaacggggcagcgtccccctctctgtctccagagccggcacctggaaggtttgtcagttcagccgcaggctgtgcgacctggggggttccagaaggctctaccgagaaagggaagcctcctaagagctcacctggactcacccacccctttaagagccaaggaagtaaacagtgggctctgatgctttggctgacttctggttgtctagatacacggaccaggcggtcagccacggggagaaggccagctctggagtagagacctacctactgggcagatgatgcaaatcgctgctgccattcaatccctatagtcatccagagccgaggggaagagaggggccaagctacatcagtccagagagagctcacgttttcaggagggaaaacagcagggaaaaaagacggacttaggaaagcactgcgatgcttcagctaccccaaatgctaccaggcccatcacaagcctgcttgccttaggaagttttttttttgtaatgcagatgacatttgctttatagcagtggagtttcctaaagtgtcccattggcacctcatgatgatctgtggaggtggaggttctgccaagagaggtacagccacctggctggtaaatggtgaaagcgggtctcaaaactcctgccaatcaacacatggtgtccagtctgcaggctgcctcataaaagctaaatcaacctccctcacattccctccccacccctaagggtatcttttcaattcagcactctatttctgccctggggtggtgctactctagaagcctaggttctgggatctgttaagctcctagacctggatcctcctaggatgaaactgacccttgcttccttgctttctctgaggttccactcatggcctgaattgtgccaatttgggctgccttgagggcacttcgcacattaggtaaataggatggggcactaggtttgccagctgcctttggccaagttccttccactttggcctgagcttcccaaccagccagaaaagcagacggaaaaccagagaaacctagccctggcggctcaggaccagaggctgcctgggagcatgactgaggacctactagaggtagtgccaacggcggtcagctgcagtgtggctaagaatgggatggacacttattttaaatgtagctccttcgtccagccccagcaatgctgacacacagacaacactgcgccatcactggctaggggtgggcgggaaagaacagcagacaagtcgtttcccctctctaggcctgtttcctcttcaatacacgtgaaagttacggtagggacgtggggtgcatatgatgaagtacataataggaaaaggaaggggggagagtcatgggtactcttcctgagaggttgtggagtaacatatttgcatctgggatttattttgcttttacgccctcactgatgtaataatctcatggagggaaggtccgtaaggctttgagggcagggtgggggaagagtgcttctctgtccccgtcatatgaattacattgcttttgtgatttcccttgtgtgtgtgtggagtgttaaaacccaagacctgagggcctatcggcagacgagcctggaccccacctcctgggcagggtgccacccttgaggcctcccagcctattgctcaaagacctgctgccctttggtcacccacgtccaaagcagccagtggaagctaagttcccctaaaggttggagcccctctgttttgacctataaagagaaatgcccttgggcctctgtttttttccctcttctaggctggcaaagcacacaggctgagcgctgaggagagggaccagctgctgccaaacctgagggctgtggggtggaatgagctggaaggccgtgatgccatcttcaagcagtttcatttcaaagacttcaacagggtatggcaccagggtgggacagagttttctgagacgggctgatggggtcaccttacaaagcatgttctctcccttcacgtcttgttagccaagactctcagacaccacactcatccagttatttgggcactgtgccagtggggaaattaattttcctgtctaactcagaaagtatcatctttggggattggagagccataggaggatgtgtcttgggctctcccttcctggaacttttagcagcagtcttctgaggagatagttcaagtggaaaccatgcacatctgaagacatttgaacagacggccaagactggccaggccaaaagcctgttgtggtgtttccaccttgttgacatcctaaatagcaagactttcttcctactgcaaggacaatctctaactcaagcctgagaaccagtgacaggatgtcaagggggaaatgattatagaggagtctcctggggggaagctaattcatcctcctgcgtctaggccttgaattggtgatgtccagaagtcctttctcttagaacactaacctggctctcactccacttaaataggcctttgggttcatgacaagagtggccctgcaggctgagaaactggaccaccatcctgaatggtttaacgtgtacaacaaggtgagtgatgctgtgtgcctctgttgtgctctgcccccatccaaatactgcgaactctgacacattctgaaggcttttggacttaacaatgagccttcctgacccataggtcatccactcatctcatttccaatctcactgagattgcacatgcctagaatcaacataaatacccctgggaaaaaaaaatcagtcttactataaagaaatgcaaattaaaagatgcatgagatagttgtggttaaagtagacatttaagtagacattaagaaggcaaaacccaagaaaggaaaggctgtgggaatcaggcatacttattcagtgttcatagctctaaatggctttaatcttgctggaggtatggaagaatgaaaaagtaataaacttgaactaagaatacacacatatttgggaggccgaggtgggcagatcacgaggtcaggagatcaagaccctcctggctaacatggtgaaaccctgtctctactaaaaacacaaaaaaattaggcgggcgcggtggtggacgcctgtagtcccagctactggggaggctgaggcaggagaatggtgggaacccgggaggcggagcttgcagtgagcagagattgagccactgcactccagcctgggagacagagcaagactccgtctcaaaaaaaaaaaaaaaaaaaaatacagacacatagccaacctatcaaattatttgcttaatgaatagaaacagtcattaaatgtctaccatgtgccaaaagctctgctggtctctgtttataaaaacagtaagggtggaagaggtcgtctatgaatggatagtgtttaggagttggcattggtttttggttttgtctttagcttttaggttgctcttgacattcagatattaagcttttattctatagctgaagtcatgattatttttgagagacagcaaaggggagatgtagaagatgttgttacagacatgtcaggaaggagtccccaggagagatcgtactggccagctgctattctggagctcctagcagggctgagcccagcagctagtgactccctcctgttcttaagtgaagtcagtggaagcagaatttctggtttcatttcaggtccacatcacgctgagcacccatgagtgtgccggcctttcagaacgggacataaacctggccagcttcatcgaacaagtagcagtgtccatgacatagaccctgcccttcctctttgaattcttccgggggaaggggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttggtctcaggctctagaaacttcttttccacaggtcaatccaaattggagtcaataggcatttaaatgaaagcacttcctctgtgctaggcacttcctctgttcaaggtactggaaaatgacagggaccagaccaccttgccttcagattcattatcatctaggggataccatttgattatcatcaaacaggaacacaattaactattaccaattaccaattaactagtactaattaactattactagagtgaattaatgctaggtggcaggataagaaatgagctaaagggaacgcaagtgattaatggtgaaaagggcaaatctggaggctttgagttatgccttgaagacctgggtaggattcttgggaggcagagatggctgagagaacaccatgaacacagataagggtgtgaagggcacaggtattatatgcattgtggaacctatgtctagaaaggcagtctggggccatattacaggttgaacatccctaatttgaaaattggaaatccaaaatctgaaactttttgaatgccaacatgatgcccaaaggaaatactcattggatcattttagatttctgattttcagattagagatgctcaacttgtcagtataatgcaaatattccaaaatccaaaatctgaaacacttctggtctcacacctttcagataagggatactcaacctatattttcttcctggctgtgatggctaatgttaggtgtcaacttgattgggccatggggtgcccaggcatttggtcaaacattccgggtgtgtctgtgagggtgtttctgaatgaggataacatttgaatcagtagactgagtaaagccgactgtcttccctaacatgggtggcctcattcaaccaggtgaaggcctgtacagaaaaaaagggctaaaaagggctgaccctcttccaaataaaagggaagtcctcctgcctgactgccttgaggtgggacattggtcttttcctgctttcggacttaaactgaaacatccactctccttaggtctcaaggctacaagcctccggtgtgcaacaataccatctgctttcctggttctccagcttgccaactacagatcttgggacttgtcagcctccataatcacatgagccaattccttataagaaatctctttgtgtgtattggttctgtttctctggagaatcataatacacaggcctatcatatcagatatggcagatccc

SEQ ID NO: 36429 - DNA, 50474 bp, Homo sapiens
ctggctctccgctgcgctgcgctgcgctccggccgctcccgcggcccgtggatgggggtgtccggctgagccccgggatccgcctccctccgccaggacccgcacaggtgccgtcgcgggggttgactttagttaggacccgactcactgctgggggtggggtctggtgggggtggtaaggaggccccgggattctctgacaggacggtctggggtcgccgcagctcccctcacctggtcccattctgggattagaaaggaacaacgggaggccgtcgccttcctgcccagcccttcagggagcgcagctgggacgccgcgccaggccctggagatgtgggatgatgggcacttccagtatcatctcagcatcggccctccagccaggcctggtgtgtgtgtgtgtgtgtgtgtgtgtgtgtgtgtgtccgcgtgtgtgtgcccgcgtgtgtgcgcgcgtgtgaaggcagggcggcgaggtatgggggctgggggaagaagggaacgccgcccgatcgcgctggggcagtgggtcggtacctcgtcccgggaccgttatctggtccagtcaccgtaaacgccccaagatcatctttgtccctaaaaacttacccccgaccccgctcgtgcccctccccagagtgcggagccttccccagaccgcgcattcctgcagtgtcagaaccgctggcagcggccgcagacgccgggagagcgattgttttactacagacgggcgggagaagggaccggggcggctgcgcggtggcggggcgcgctgccgtcgggtgggccccgggctctggaatgcggggagcagtgtttgacggcgtcgaggaggtatcacagcccgctcttcttcccttttgcctatcccttctctcctcgccgctaggcatccccgactctcatccctctcccgtgtccgggcttgtttggccggaagggcagtggagtgtgtatgcggcctgcacgggatgagtccggcttcctcagagtgccagccattgtgctgcctggaggaggctttctttaccccaccggactggggggaggagggggatctgagatggaggtgaatggagcagcgggaggagggggaggggagcaagcagaaccgcgaaggggttgctgatccatatgcaacgaaatactttttctgtcaaaatgtgcacaaacatgcacactgggtgggttctgcggaggagcagtgggaaatctgaaggtggatcagtgcagggtaggttttagggacggatatgggggacgaggcacggaatcagttgatctatggaccaagtgatgggaagaaggagatggaatggggcttgtgtggaggtgccgaggcccagcggggttagcgtggtgaaatctccaccgctccgctccactcgggtcagctcagcaaagcagggactgagcatttgtaccgcagccccgagatgcagcgagtgcatcattgtgctgcagggagacgtttatgcgtttcctactgggtctctgttaagccccgtgagtgtcttttcttttccaaattacaccatctattgggagtgaaaataaatggaatagattgtaggacaatcagactatagtcctgcgctctgttctgtggtaaagagaaaaagaaaaggcgaccctcccatggttccttctttctgccattttcatgtatgtacgtatttatttttgatcttggaagtctaaagggaataagctatcgcttgtattaatcctactttaaggaaaagaaggctcccagatgagctatgaatgaggatggtgcaagcttgccaggatggaaaataaggttgtttcagacattttagttgaaggatgaaagcactccgtgaagagaggagggcgaaagaaagtgggctaaaggaaggaaggcagggtcaccatctaaggaagtgctgccaaccccaatccacagagccctcctggaggctatagtggggccagtcagaacgcctgactctcatctgtgccacagcctgaggtctttccacaaatgctggattcagtttgggtgttgagtgactagtttcccagcactggctttcactttaacttcatctccagatggtcattcatgcagcacttcttggctcttggataatgagttgacaaaaaacaatcagtctatattatggactgtttcaaatgagcatgtgtctgaaccctagagctgtgatattcatttcgtcttttataattttctagatgaatccattttctctacactctgcctgggcagagtgctttcagcacactcttcctgttgccaacactcaaaactcagtcttagtcctagattctggttggattggcctcttgttgctggttaatcatatagactgtgtcatttcaaatcagaaaccccactggtgtcaccatctgcttctcccctgtcattcccagagaaaagtacaaatttaaaggcagtgtaaatacctgcaacactatcggattggctttcatatctctgtaaaatggaacccacgatccaggaacctttgaacaaataaattgaaaaaagaagccttagtaaaaaagatgctaaaattctttcagcaatagttctcttgtttgataagcatattgaagcattgcacagagaatatcatggcagggataatttttcttttacttgaagcactcccacatcacctttctttctttctttctttctttctttctttctttctttctttctctctttctttctttctttccttctttccttctttccttctttccttctttccttctttccttctttccttctttccttctttccttctttctttctttctttctttctttctttctttctttctttctttctttctttctttcttttctctctttctttctttctttctttcttgagatggagtttcgctcttgttgcccaggctggagtgcaatggcatgatctcggctcactgcaacctctgcctcttgggctcaagcgattctcctgcctcagcctcccaagtagctgggattacaggcacctgccaccatgctcagctaattttttttttttgtatttttagtagagacagggttttgccatgttggccaggctggtcttgaactcctgacctcaggtgatccacgcacctcagcctcccaaagtgctgggattacaggcatgagccactgtgcccagcccccacatcacatttctatgtaagttagctatcctggttttcctagaattatttttaacttttttttttttttttttaaagatagggtctcactttgtcacccaggctggcatacagtagtgtgatcatagctcactatagcctcaaactcatgggctcaaccaatcctcctgcctcagcctctccagttgctgggattacaggtgtgagccaccgtgcccagctttgatttttctagaatgattgatatttattggatgctttctatattctgcacattgtacttaacacttcaaagatgatctcatttagtccaaaaagtaatcttcaagggaagcactgttttaaactccattttatagatgatgaaattgaggcacagtgaggttgataacttgcccaaagtctcccaactaggagtgacaggaccaggacaggaacccaaagcctatgctcttagccatcacagagtactgccttaatcaacacaaatccctgggctgtgaaaactgttttactctctactgcattctgccatcttttctaatctcacttttttgttgctcagggattcttaatcttttttgcactatgacctcctttggtggtatggagaagcctgtgggctccttctccaaataatgtttttaaatgcataaaataaaatacttagtcttgtaaaggaaaccaatttcattgaaatatagttaccttcaaagagcctgcaggggtctatgtactgaagatgaagaacccctgactggcaattacttgtgtttgctttagagctgtgttgtcccttgcggtagccacaggccacatttgactgttgagcacttgcaatgtggctagtccaaagtgagatgtactgtaaatggaaaatatacactggatttcaaagggcttagtataaaaaaagaataaaaactgcctcattagtttttttgtggattacattttgaaatggtaacactttggatatattggattaaataaacatattacttcaatcaaaatgattaattaaattattgatttattaaaaataactcctaaagatgttaactctgtaccaacaccttccttataacaaatgaggaaatcaggaccaatgatgcttgtcactcagccagccattggcagatctgttggctctcgagcctgtcttctttccaagatatggtactacttgtatatatttttgtattcaaaggtcctatcatgttgcctttgcaaactgtaaatgctccaaatatgttttaaagcaacggtaatcaacttaatcccagcaaaatcccggtacaaactggcagtgttcttgcctggcatgtcctttgccttgcttatttagagttttagttttgtaggtagagatggagaatgggcactcctagggcaaaatccatgaattttgctgtctggttcccctcaggaagcgcctccaatttgagcacctaactatatcaataaccctatagaccgaagagaaaagcttggtagcctttctgttgagcgtgtagagaagggtatgatagtcagcaatgcttgtgctgcctgaaactgaaaatggaaaactgtatgtgggagatagatcattttttcaacgagcacatattgattgactgcctagccacagggtaggcagtgtatatttggagccagggaagatatccagaggatttctgtgtcctcgaggaatttaagttaaaattgaatggggcccagatgtacacacagatggataaatcacagttggaagcagtgcatgaagatggcccgatgaggggtagaggtcccacagttggtgggaactgaagggagttctgtgtgtgcagcgttccagggtgcagtgcccaagatggttatggagtatggctttggagcacatgggtagttgggtctgtttcttacaggatacaggataatagatcatttagtctattcctctgctcctaggcatatgctctatgtgtgggaaaaccttgggtgcttgtctgggcacggtggctcatgcctgtaatcccagaactttgggaggctgaggcaggtagatcacctgaggtcaggagttcgagaccagcctggccaacatggtgaaaccccatctctactaataatacaaaaattagctgggtgtggtggcacacgcagctacttgggaggccaaggcatgaggattggtggaacccagaggtgtaggttgcagtgagctgagatcacaccactgcactccagcctgggccacagagtgaagctatgtctcaaaagcgaaacgaaacaaaaacaactcaggcatttattggaaggtctctattgatgttttattagtttttttaaaaaaataaaaatagagatgggaccttactatgttgcccaggctggtcttgaactcctgagtgagctcaaatgatcctcccacctcaacctcccaaagtgctgggattacaagcatgagccaccacatccagccaatgttttattagtttctactatttattgataagggtagtaatatctaggtatacaaacccttatccaaaacccctggggccaggcatttggaattcagattatttcagattttggaaagtagtaatagagtgtacattccgcatttcatccagtgggatctgggatagcaatctttgtaattaaaaagttaatatttctgcagcaaaacacacaaaatgggataaattaaagccatgaacagctttatattcatgttggtcatgtttagttgccagatgagtttagatcatgtcacattttgctgccaaacaagtcatggagaattttcagctttcagatcacatagttaaggatatggatctgtggtaatagtaatagtaataaaaataataatactaaaacaccaacagaaagtattcaataatattggcacttattatcttccaggtactgttttaagcactcacctgtgtttactcctttagtcttctaacagccctttgaggtgggttcagtattatatctgtcttgagaagaataagaagcacagagcaattaatcacttgcccaaggtcacagctggtaggacagaacagaatgcaaacctagacgatcttgtccaggagcttcgtacttaaccagtgccttgttttttggagtagggaattggaagcaggtgtgtctctaaagttaactctattatttagattagcctggtctaaactcacattacgctgttcatttcttttagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggagtaagaagtcttaattgccctctcctgcttcagtcgagagccctgtagtccttgtctccttgacatagtgctggtttctgtctataggtttatgggctattactttcattttcgtgttgccagcggagcagtgccctggtacttgctgtcatagctctatatatgtccctttacagtcccctgaggagaactttcttaaattgaaaccttagaggaatgaaggttttcctagatacaaaatggaatttcaggagcacagtaaatttcagggtctgtctatcttaagctttctttatatcagtggaaatccagcgagatattagaaataaaggccagaaaaaattaattaaccatgatggatgaatctatgttattggactaatttgcttcaagaaacaccagaattttgaaaatcccgaatttttgacagcccctcaggcctggagagttatctacagatgttaggatatgtccacataagaaagcatctaaactgaactgagagcacagcgggctaccctggacaaagtaaaggtggaaactaggtgatgtggcctttgagtatgcagattccttgtatcacttgctcgctactttctagggtcttaatagtagtcaagaaaagggatctgagaaaagtactctttcaggagggactagaaagagaagggggtgatatgttacacaaattaaagaaggatgtcttaggcatttagtaaaaattcagtggttccccgctatcctcgggggatgtgtttttttgttttgttttgttttgtttttttttgagatgaagtttcattctatcgcccaggctggagtgcaatggcacaattttggctcactgcaacctccacctcccaggttcaagctattctcctgcctcagcctcctgagtagctgggactacaggtgtgcgccaccatgcccgactaatttttgtattttgagtagagatgggagtttcaccatgttggccaggctggtctcgaactcctgacctggtgatttgcccgccttggcctcccaaagtgctgggattacaggcgtgagtcaccacacctggcccatggtgggggatatgttttaagacccccagttaatgcctgaaaccgctgctagtaccaaaccctaatgttttttcctgtatgtacgtacatatgataaagttcagtttataagttaggcacagtaagagactaacaacagctcacagcaaaatagagcaattataacaatatattgtaataaaaattatgtgaatgtggtctctctttctctctctctttcaaaatatttcattgtactgtacagcagataaccgagccctgggaaagcaaaaccacagataaggggggactactgtctacatgagttccctgcagagatacaatatgcatccattgttcttagctatcacacaagaaatgtcaaacgtcagggaagtctgaagcacctgtgcttttgtttccctttttgtggatttgagtgggaagaatggcccacaaataatggggtaagaggcacgtcctagaggattggaacctgactgtatttgggagagggttgcttatttgatgactactgtaagactctacttttacacatagaggggccaaatatctgtctgattcactcttacagccccactgtctaatacagtgcaatgtgcaaataatatttttgaatgaaatattgaatatcaaataaactagatgagtgataatagctagtagccttgtatgtacatgtaatatatttctaagcccacaccatttccttcttttctttttaattaatgctggccggaaggtatgatcacagagaacatttcattctgctgactagtactatagctgtgggctatgtgtttaaattttaagtttcaaacagattctttttagattctgagcctgttatctgctcaacatttataagtcaaaaaagaatggctctgggggtttattatgccgaatattttttcgttctagtgcaccagccaatgaactagaaatacaaagactatgaattctaattttggtactctctctaactcgctgtgtgaccttgggcaagtcatttaaccctggttgactgtgtaggtcctcatctatgaaacctccagagctcaatcttgatgaagtgaggctaaggacttgtaaagaacctaatttcttacctcacccaggatgcccaggtgctctgaaaatgacatttcaagatgcgtcccattccttttgcttccaacaaatcatttcccccctatcaaaacccctcctctgcctcattaaggatgaaggcccaatgagcagattcttactgtcttctagcacattagaagaggccactcaatgttaattaccatcacatgggattattggcctcctcagcctgatttttctgacttgactgcctcattgactgcctcagttaagagaccaaagattgaataattccttcgagataaggtataatttggggacagtgtagcgggaggaagctgggaagagaaaaattaacacaacactttctaggcattcagttctaacccctctttataatttaaaataaaaatcagaattctgttacacactttgtttcatagacactatccagatatttcaactgtgaaattatggctaagtaaaggaaaagggtgacttaatatctcacctgactacacttctcctgaacatagctctaatgttattgttataaacttgttccggtttagtatttagagggctgtttcatccacaaatgagtgaaaagtgctgtggatgggttagaggtaaataatagaagcttaaaacaaaagcagggaaatacttggttaaactgcctccttaaagacagcacaaatcatagagcaaatgtagtgattcccttagaagctttctttagtcttcatttggaactatttagccaagaggggagttggctaagatttgtcaacttatctctgatctgtcagggcatggaagttctaggcattaaaggagagtcagatttgaatacacattttttggttttgcattcaagaaatatcccagaatctcttctttgtgtatatgtgaccaccctcttcctttgccataagagattgggcctggaggtcacagcctcttaggggtcactacaaaatggaaattgacggccctcagcttacctcctacgtcactggggatccctatcagccctcttacgagtaccctgaagacagaggggctaaccatgcaatggctgtttcttcagatagaattgttataggtgatgttaaaaataaagtgcacacaataaactgcctgtcatcagatatactacatgttgaagacaagtaaataccaaatagtcagctagggaaaactacacataattgtgatttttagaaaatttaattctctttttagaggttatagaaagcggatatagtattgattctatttaaacatttgaggacatctagaaagttgagcaaacgcattaatgtgctgctaataatttctactttctttctttttgagacagagtctcactctgttgcccaggctggagtgcagtggcatgatctcggctcgctgcaagctccgcttccttgtttcaagcaattctcctgcctcagcctcccgagtagctgggattacaggcaaacgctgccacgccggactaattttttttttttttttgtcttttagtagacatgggttttcaccatgttgtccaagctggtctcgaactcctgagctcaggcaatccacccgcctcagcctcccaaagtgctaggattacaggcgtgagccaccacgcccagccactaatttctactttctaaacataaagtgcaaaggtgtactcaaattaatacacatttgggtgtggatattggcatgactgcacaccagcaaaacactagacaagggaagtagccaggcttgagggaaatgtcagcaagttagaattctaataagccctttaagctgcctgccatattgtcagaaataggtatataagggtttacgtgtgcatcaggactgagagaaccctgatggctatgttgccagttccaggccctggagttctttgtacacgtgtcctggcaccccccagtctccaccctcctccactgggtttgctcatactctgccagcagcctttcccaaagcccctgctctctgtggcgaaagatacttaagtcaattctacaggcacctaagcccaagctataaaatatgcacctgaaaaagccttttctgttatacagggatggagagagcaaattgaatctcaggtgtcatggcagcataatgataggaactgaggcaacctgtttaatcttagttctctgatgaatgatagaggagatagctttcaaagtcttctttccccaaggtaagagtaaatagcaggatgcttctcagggaagtaaaactttacagtccacctccgggtactcacaaaaggggtgatgcacactcccaagaaccctgcttatgatgggatatatgatgggatagacagcccttccctttctcttcctcacagaaagctgtttccccctgccctggctgcattggctcctctgttgctgaggctgctggctgccagcatctgcctgtgccttccttgtgcccttccctgggctggagatctacatagaaagtggccatgcacccctgctacctttgccattcctccttctgtagatccatgaaaacacaatgttcaggatcatcgtacgtatgggtttctcacgcagagccagtttctttttttttttcttttcttcttttttttttttgagacagagtttcactcttgttgcccaggatggagtgcaatggcgccatctcggctcactgcaacctccgcctcccaggttcaagtgattctcctgcctcagcctcccaagtagctgagattacaggtgtgggccaccacgcccagctaattttcacgcagagccagtttctaaactgctctcctaggttatgattaggaacttggtatgttattctgatgcccataccgatgccaattacagaattcataaagacttggaattgttaagtggttaggaatatgggctctgtagccgtgctgcccaagttcaaatcccacttttaccattactggcagtgtgagctgagacaagtgaattaaattcactatgtttcaatttttttctcattagcatctgccttgtataattgttgtgaagaatgaatgaattaatccatgtttcgaatctggtttagagtactacctggctcatagtaagtgctcagcaagtgttgactgctattgttattgttaaatgggcactgggtaagtatggaaagggtatacaactgattataaagagaagaaagctgctttatcttaaagcttgtttataaacttcaaaggataaaaagtatgtcagcaaggaaaaaggaaacctggacaaaatgtgaaagagaatgaggatggcttgaaatcctgagaagataaaagtttagggaattgtcgctaaaaatgtagaatcagaagataaaattcaaagcttatcagcaaaggctcagatgagaaaagcgggcactctaaatgatcccgagagagcccctgcttatcactttaaggatgtaaatagtctcaaggtcattggaaagtgtgtagctcgttaaagttctcagcttccctccagcctgggagagatacaaaaggctcctgcctattttgggctttgctgaatttcatttctgtgggcacttcctgcagggacaaatctgaaggtcagtgcctgtatgcatgttcattcttgcagcagagaatgtaatgcagtgatgtaaagagtagtcctgcagtgacctttccagcgggtgtggtgccttggagttttgtcttggagaaagcaaatcctatttgcttcttggctctagaatgctaatggcacttggatttagaattagcctggattaatgcagctctaatagtgcctgatggagattagggtatcacccatggtttaagaagtctgctctgaaatcctgctgagtagatggctaacgagtacttgatgagttctcttcaaagtgttttcttgtaatggtaggaaaataatgaataagcagatgccccaagcactgccattacattgtgttttcttgggttccttctatttgttccatcaccaattatatgcattgtgcactaagaaagtctttttgcttttaaaacccatatatcacgtcgcattcctgatacaaacaaaatcaggaatgtgatgtgatatatgggcattttgtttagttaatagtgccctcattactttctgatttcaagtgtctgtgccctggtgtatatatacatacttgcttatttttgaaatcttgctgtcacgggtatcatttgtgtttgacatgcataggcacctgaaggagagtgcagcatagagccctaatttatcattatctaatattttagttttttttttttttttttttttttttttttacagtgtcttgttctgtcacccaggctggagagcagtgacacaatcatggctcactgcagcctcgacttcctaaggttcttcccatggatcaggctatcctcccacttcaagcctctcaagtagctgggactataggcccatgctaccatgcctggttaatttttgtattttttgtagagacagggtttcaccatgttggccagtctcatcttgaactcctggagtcaagcgatctgcccatcttggccttccaaagtgctggatttcaggcgtgagccatcgcgcccggcctcattaatattaattcaggtgccattggcttccatggcggtcattatcttaagggctttgtttactgatttacattaatctcttggtgttgaataatttatgtatcttcctgatgtgtgtttgtgactttgaaattttccccaacctccctcctctttttttgtaagaaatctttctgaaataagttaaggaataagaattgtagaaatcctttcttataatgtacatatcagaattttaaaaagaaatgtaataaatgtagctccatctttccccactaaaaacaaattgtgtagacagaggtgtatttattggtttcttttatatacagtatttacctgagagtgtccgtgatgttggaatgacacaatgcaggatttagattctacattgttagagggcaggatcttgcaacccgtgggttcgatagaacattttgggtagtaagtaagcactcactgtattggcattattcccttacctacattagatgtcaaggagggaattcctgatcatttagattgtaggcctctgaaactgaaacggttataaactagataatgattctgatcttaatgagattcagccagaaaaactgcccagatctctctttctctgtgttcctctctctctctctccctttctctctctctctctttctctctctctctctctgcccataggaaaagaaacatgggcatctcttagattcagaaacatgagctatttggatgaggggcagatttattttcagagccagaggcagtttgattatagatgctgccatttgtatctcaatggtaggaaattcctcttccctcaagcaaacacctttcacactgaagcccctggccaagctccatgcactttctcccctggatgtgcctctgattcagtttttaagctgctttgcccctgcatgctggaaggcagatgatctcagcctggcacacacagaagcctctctcctctcccggcccagctcttccttcctccaggcggggccaggccacagatgtgtgttaatgagagcttctctttgtttacagggtttgggatgctctgacagacaattacatcccttcactctcagaagactggagggatccaaacatcgaggctctgaatggcaactgctctgacactgaggtacctctccggggcccctggtttagcagggcttgagatgtggaatccagttagaaaaacattcagtaactcaacagtcttcctcaaaattgttgatggaggctcatgcctgtaatctcagctttgggagaccgaggtgggtgattgcttgagttcagtaatttaagaccagcctgggccacgtggtgaaacccccatttctaccaaaaatacaaaaaattagccaggcatggtggcgcatgcttgtggtcccagctactcaggagactgaggtgggaggattgcttgagcctaggaggttcaattaaaaaaaaaattattgttgggaaggaggagttgtagaggagggtgaaaaataaggaagacatccagtatatctgaaatgataggaatggtcatctatagaaaagcagaaacacagatcacttctattaggttggtgcaaaagtaattttttttctgccattactttcctttttttttttttctttttttgagatggaatctcgctctgttgcccaggctggagtgcagtggcacgatctcggctcactgcaaccttcgcctcccgggttcaagggagtctcctgcctcagcatcccgagtagctgggactacaggtgcatgccactatgcctggctaattttttgtatttttagtagagatgtggtttcactgtgttagccaggatggtcttgatctcctgaccccgtgatccgcccgccttggccttccaaagtgctgggattacaggcgtgagccaccacacccagcctgccattactatcaatatttctaacctgtgtactacaacatgaaaaataaagtggcctgaaataagaggaggaaactgtcatggcttctcttgggttcaaataatggtggtttaaaaaaatcaggttttctcatcttaaatgaacagttcaggccggaaataagaggaggaaactgtcatgggcttctcttgggttcaaataatgatggtttaaaaaaattagattttcccatcttaaatgaatagttcaggcccacaaaaacagtgctgagaacaagtgctgacggatcttgcacttgacaatggccagaggtggggcccagatattagcaatgtagccacacagtggggaagaagtctctctttttttctcagacagggtctcactgtgtcgcctaggctggagtgcagtggcacagtctcggctcactacagccttgacctcctgggctcaagtgatcctccagccttacccaccaccccctccccgagtagctgggactacaggcatacgccaccatgcccggctaatttttgtattttttgtagagatgggattttgccatgttaccaaggctggtttcaaactcctgagctcaagcaatccacccaactcggactctcaaagtgttgggattacaggtgtgagccaccatgctggcctagaattgtttatgaaactcaaccaaggggacgtttatgtgtctggaccagagtcacactccatgagttactgactccaagggagaaagtagcttaggggcttctgaaaaataaagatgatatttattttgagttgatttgcaaaggccataaagggggtgacctttcagaagatccaaattgcccctcctatctgaatctacatatggaatggtttcttagtcagtttgggctgctgtaacaggatacgttagactaagtaatttattaacaacagaagttgattttcacagctctggtggcagggaagtccaagatcaaggcactggcagattcaatatctggtgaggacctgctttctggttcacagacggcaccttctcactgtgtccccacatggtagaagggtctaaagtgctcccttgggcctcttttagaaagatacttgtgggcatcccacctccatgatatcatcacctccacaaggtctcactgtctaataccatcactttgggcattaggattttagcatataaatttggggggtgggacataaacattcagagcacagcaaaagataaaatcatttaatggctctatgttaaaagcaaatttctgcctcacttggttttctagtttcagttgtgaaggaaatttgacaatttatcgtcaggaagggctgtcacagccctgcaggctcagcaagtgatagagttggatgggtctaatctttctaagtgtttcagaattgagtccaagtaaaagagcaagaaacagattccccttactcggcaatatatttgtagattattgctcaaaatagcacagcaaagagatcagcagttgactgatttgttgaaaatgtagccatatatatccttctccatttttctagtaattagcaatctaaggtactcaaaacctcaaggcttcattgacgggagcaagtgagatgatgactttgagactaagatttcctgcaagcctcctcagcacagacataggaggctgtgtctcaggtcctgttttgaactctcggctgtgcatgttctcttgtaatgcttacaggtatgatgcttagtacttacccaaaccgcaaagaagatggaggcaataatggaataaatctagttactgaaattaaatcaggtccgtcatggtacaaaaggcagattttgctttgttatctcttttgacacctttccaactcattttgtgaattaagccaaaggatatataagatagcctgcccttcaaaagggctttaatttatcctcatttccagatttccctcaagagggttaatatttcagggcaaactgaatgaccctgagaaggatgatcttgagctctgttccttgtagtatttcttctatctaacccatgggaaaaggacagggtagcaaaagtagatggattaaggctgttttatttcatcctcttttattatctggattaattacagtaggagctctattaactgccctaagtttaaacgatttaccagattaaccagtgctctgtattccttctgtaaaacatacgaccaaaagcgtttggcatgctgaatgtgcacagctgtgatgcttctctctagtgagcactcatacctccacttaagtggtccatttaaaacaattttttttattttttgagatggtgtctctctctgttgcccaggctggagtgcaatggcgcgatcttggctcactgcaacctccgcctcccaggttcaagcaattctcctgcctcagtttcctgagtagctgggattacaggcatgtgccatcatgctcagctaatttttgtatttttgtagagatggggtttcactatgttgcccaggctggtcttgaactcccaacctcaggtgatccacccgccttggcctcccaaagtgctgggattataggtgtgagccgccacacctggccaagtggtccatttttaagaatcagttgtccccaaacctgtttgtgctgtccttgtgactgcactaagaaatttaattaaatattgtaccaactattgaattgtgactgcaaagagtgtcattttttgttaaaatcaaagtaacacgtctacatagtttaaaaagttaattaatgctttgaaagtaatgcactgtaagtgcaagacaaaacaaccacccaaaacagtagacccctgccttcttgtctttccctactccatacaggcaactgcttgcatttcttttagctgcctttttttttttttgcataaagctccacttttatagtggggccatgcggggccacatggggaagctccagtgtcccctggaggcagaaggagccaggggagagccaggccagtgcctcaggaatggcgagatggggtaaacagtttaggactggctagtttgagtaatttctgcaagctgtaaacactagggatggtccttagtgcctagtacctgactctgggatgactaaggaagaggactctgcctcctgggatgtaaaggtcaggtagaggcggcagggcttggctttggttagtttgcatatagaaggcttgctgagccctttgctatctctaagaattggctaattttttgtgtgtgtgtgtgatggagtcacactctgtcactcaggctggagtgcagtggcacgatctcggctcactgcaacatccacctcccaggttcaagcaattctcctgccccaccctcccaggtagctggaattacaggaatgcaccatgacgctcagctaattttttttttttttttgtatttttggtagaaacagggttttgcatattggccaggctagtcttgaacttctgatctcaagtgagccgcctgccttggcctcccaaagtgctgggattacaggtgtgaggcactgtacccagccagaattggctaatcttgaaggtacagtctatccccaccagaaagatctttaaaatgttaaaaatcataattttcagaaaattaaaaagtataaataacacaatgcttaaataaatcagatactatattgtgtcaattccatgtttttttcttgaaaacatcccagttagtacctttcatctttctgctacaaactggtctggtcattcgctagatcagctgcacagctgctgtcctgagaacgtccttcccttcatgctggggattcttttgtcttccactcctgtcttctggttaccatattttaaaaatctttctagatatagttccttgttttggtgaaaaaaaccaacaacaaaccaaactattcagcatatttttgagaaaggagtacagaggaaatggtttttaggatatataagaatattattatttagcattctgagggctttgttctcttctagcattaggtcgtgttgagaaaccccaaatctgttccgattcccagtccttctttttaggctgactctgttctccatctttagattcctgctcctttattatatgacttttttggttctttctggaagcttttaggatgttcttttcctttctcatttgaaattttacaataatgtgctttagaatgaattttttccttcattatgttgtcctcagtgagtcctttcaacatagaagctcatgacttcaaattgtgacgttttcttattattttttctgaagatttattatttctatttactgcctctgtggagatgattatatagcttttctcctttatgatgttaatgtgatgaatttcataaattaatttgcaaatgtcaactcaaccatgcattcttgagatacacacaacttcatcatgatatattatcattttattttattctgtttttccccccatatcgtaattgaaaggtaattggcatataatgagctgcacatattaaagtgagcaatgcggtaaattttgacatctgcatatatctgcgaaaccatcaccacaatcaagatattcaacatattcctcatccctctctctcaccgcccaatctctgggcaaccacttatctgctttctgtcgttgtagattagttttcattttctagaattttgcatgaatggaatcatgcaatatgtacattttcttttgtctggcttattaaactcaatgtaattaggtattcatccatgtttttaagtatagcaacagttcatttctttttattgttgagtagtattctgttgtatggatatatcaccagcggcttattcattcgcttatagatgaacagttttttttctactttttgcatatttcaaatgaagctgctgtgaacatttttctgtaggtctttgtgtgaacatatgcttccatttctcttagataaaaacctatgtgtggaatggctgagtcatatggtaggtgtatgttcaactttttttttttagcttttattttaagttcaggggtacatgtgcaggtttgttacataggtaaattgtgtcatgggggtttgttgtacagattatttcatcacccaggtattaaacctagtatacattggttatttttcctgatcctctccctcctcccacccttcatcctccagtagggcccagtgtgtattgttcccttccgtgtgtccatttgttctcatcatttaactcccatgtctaaatttttaaggaactaccaaactgttgcccagtttgagagctgtaattgtcccatattctcactaacacttgttatggacaatctttaaaatttagacatcttcatgggtagtaacaaaattgataccttatttcagttctaatttgcttttctctagtgacatagaatattgagcatcttttcaagtgattatttacaatgtgtgtgtgtgtgtgtgtgtgtgtgtgtgtgtgtgtatttttgagacagggtcttgctgtgttgcccagtctggagggcagtggctcaatctcagctcacagcaacctccacctcccggactcaagcaatcttcacacctcagctccccaagtagctgggaccataggtgcacacctccacacccagctaatttttgtatttttagaagagatgagatttcaccatgttgcctaggatggtcttgaattcctgagctcaagtgatccacctgccccggcctcccaaagtgctgggattacaggcgtgactgtgcccggcctgtatgttttctttggtgaaatgcctcttcaaatcttttgtgcatttttttagtacattgtttgtgttcttagtattgagttgtaagagtttctttttttctttgagttggagtcttgctctgtcacccaggctggagtgcagtggtgcaatctcagctcactgcaacctctgcctcccaggttcaagtgattctcctgccttagccttctgagtagctgggattacagatgcacaccaccatgactggctaatttttgtatttttagtagagacggggtttcaccatgttggtcaggctagtctcgaactcctgaccttgtgatccgcctgccttggcctcccaaagtgctgggattacaggcatgagccaccgtgcttggccataagagtttcttataaattctagataaaaattatttgttgaatgtatgttttacaaatattttctcctagtctataggttgccttttaattttcttaacattatcttttgaagagcaaatgttttttaaatgtgatgaaggctgagtgtggtggctcaagcttgtaatcccagcattttgggagactaaggtgggcagattgcttgaggccaggagttaaagaccagactgggcaacatagtgagatcccctctcaaaaagaaaaattaggccgggcgtggtagctcatgtctgtaatcccagcactttgggaggccaaggtgggtggatcacgaggtcagcagattgagaccatgctggctaacacggtgaaaccctgtctctactaaaaatacaaaaaaaaaaaaaaaaaaaattagcctggcatggtggcacgtgcctgtaatcccagctactcaggaggctgaagcaagagaattgcttgaacccgggaggcagaggttgcagtgggttgagattgcaccattgcactccagtctgggcaacagagtgagactccatctcaaaaaaaaaaagaaaaggaaaattaaatgtgatgaggtccaatttattgatattttcctttttatactttgtgtttatgttgtatttaagaaatctttgttaaacccaaggtcactaagatttttttcttaagttttcttctagaagttttataattttagctcttgtatttaggtctatgatccatctcaaatcagtttctttctgtttttttttttttttttgaaatggagtcttgctctgttgcccaggctggagtgcagtgactcaatattggctcactgcagcctccacctcccaggttcaagcaattcttctgtctgtgcctcctgagtagctgggattacaggtgcctgcaaccatgcccagctaatttttgtatttttagtagaggcagagttctactattttggccagactggtcttgaactcctgacctcaagtgatccacccgtcttggcctcccaaagtgctgggattacaggtatgagccactgtgcccagccttcaaattagttttgtatatagtatggagtaagggtcagggctcattttttaaaatttttgattcccaggttgctgtttcccaggttggtcttgagctccttggctcaagccatccacctgcttcagcctccccaattgctgggactaccgaggcactccacagtgctgggcttcaaggtttatttttctgcatatggctattcaattattccagtaccattcattgaaaatcttattccttccccattaaattgttttggcatctttgttgaaaatcaattgatcatgtatgtgcggatctacttctgaattcttttttctgtttcaatgatatatatatgtgtgtgtctttttttatcatccctaatttattttaaaatgtgtctatctttatgccaatcccacactgtattgattgctgtagctttatggtaagtcttgaaataaagtaatataagttctccaactgtgtcctttttttttctttccaaatttgttttagttattttaggttatttacatttccatataaatcttggaatcagcagatgaatttttgcaaaaaatcttgctggaaatttgactttgattgtgtagaatctacagaccaatttatatatgtagatcaatttatcatgttaatgtgatgaattacattaattggttttcaaatattaaaccagcattttattttaaaataaaccccacttagttatgatattttatcttttttatataatgtgggatttgatttgccgatattttattaaagatttttgcatcatgttctttttctgaaattttattttgttctaatgtcataaaataagttggaaattatcctctctatctctactttgtgaaagaatttgtattacattggtattatttcttccctgaatgtttgatagactatactagtgaaagcatctgggcctagggttttctctgtggaagattttcagttacaaattcaattttactgagtcaggtttgataagttacatttctcaaggaatttatctatttaatcattgaatgtattgaacattcatttgtttataattttgttttgttattgaaaatgtctgtaagatttatagtgatgttcccttttctattcctgacattgttaatttgtgttctctctccctccatccctctctcactctctcttgtcagctggtctgtgggattatcacctttattaatcttttcagagaaccactttttatttctttgatttcctttattgtttgttaactttttagtttattgattccctctcttagctttattacttccttccttctacttagtaggagtttaatttgccctcatttttttagcttcttaaggtaggaaatttgattatattttaaacttaaaaaaacttaaagctataaaattccctttaagcactgttttagctgaattctacatattttgattgggtatgttttcatcattcaattaaaaacatagtttctaattttttcttgcaatttcttctttaacccataggttatttggcagtttgctgctgaatttcaaagtgcttgggaggttttatagctatcttgttaaaaattgatttctaatttaattttgtcagagaacatactttgtatgacttaaatcttttaaaatacgttcagactgatttagggtccagcatatggtacgtcttagtgaatgtaatatatgccattggaaatgatgcacattctgcaattgttggttgtaatgtgctataaatgtcaaccaggttaacttggttgatagtattgttgaattcctgtgttccaaatgatattttttgtctgtttattctatcaattaatgagaaaggtttattaaaatctccaaccattgttgtgcatttatttctatttctttagttctgttgatttttgttttatatattttgaagctctgagtacatctccctgatgagttgacccttttatcattatgaaatgtcattctttctctgtaatgcttatcttaaaatctactttgtttgatatgaatgtagccacttaagctttcttatgcatactgtttgcaaagtgtgtgtgtgtgtgtgtgtgtgtgtgtgtgtatctatctcaatccttttagtttctgcctatctctgtctttttatttaaagtgtgtttttgcaggtagtgtatacttggatcttgtttttatattcagtctgacaatttatgcttcttgattattgtgtttagtttatttgcatagtgtgtagtccattgacatttggcataatattgataatttgtgttggagcgtattgtcttcatttctgattgtcccatctggttttgttgctgttttgttgttcctctgttccacactttttgtcttcttttgggttaatcaaatattctttggctttgcatcttatgtcttctgttggatttttatctataccttgtcgtatttttctttagtggtttctctaggggttacactatacattattaattaatcatagtccatttagaattaatattgtacactttacataaaatgtaaaacatttgtcacagtataaagtctattccttccatcttttgtgctataattgtcatatattttatttcaatctacattatatactccacaacacaaagttattatttttgctttagacagttagttgtcttttaagaaaatcaaaagaaggaaaaaaaagatacttttaaaatatttacctatgtatttatcatttctggcattccttattttttcctgaagattctgattttctatcatttcctttcaacccaaaatgctttttatagcatttcttttggtgtagagccacaggtgacagattcctttagccttcatttatttatctcatttatttcatgtttttcccttctttcaaaacacacagccttgcactgcctgtgtccagtgcctgaaaacaattggctcatagattttgtccagattgtagttgtttatggtaggagggataagtccaataccagttactctgtcatggctgaaaggggccatctcttctgtttttgctttctagaattccttttattcaagtattggacttctgaagctgatcttctgaatatttttccccgcccataattctatctgcttattttgtttcactctccagggaactttctcagccttcagctcgatggaaaagtctaaattttctatcatacctttaatttctaagagccctttccagtttttacagaatttgtgtgtttttaaaatttttttctggtcttagtaagtgtacatctttgtagtttttaaatgaattctgataaataggacacattttgaggaagcaaggtgttctgttatccttctgaaggcaggtatagcagtttcttagaagaggtttcttctgctctctctgttgcttttgatttctcttctctatacattttcatctttcatgttgggggctattctcaaatgtctggcaatccttgagcatcttttcatatttaaaagtgaggctttatggccaggcatggtggtttactcctataatcctagcactttgggaggacaaggcagggggatcccttgatcctaggagtttgtgaccagccccatctctacaactctaccaaaaaacaaaaacaaaaaaaacaaaaaggtagccaggggatggagtgcacttgcagtcccaactacttgggaggccaaggcaggaggatcacttgagcccagaattttcaataccagcctggccaacacagtaagaccctgtctctacaaaaaattaaaaaaaaaaaaaaaagcattagctgggcctggtggcatgcacctgtagtcccagctacttgggaggctgaggctagagaatcgcttgagcttaggagtttgaggctacagtgagctatgattacaccatttcacaccagcctgggcaacagagcaagcccctgtctctaaaaacattaattttaaaaaaaatggctggtgatagctcacgcctgtaatctcaacactttaggaggccgaggcaggtgaattgcttgtgctcaggagtttgagaccagcctaggaaacatggcaagttccccatctctacaaaaaatacaaaagttagttgggcatggtggcatgcgccagtagtcccaactactcaggaggctgaggtgggaggattgcttgagccggggaggcagaggttgcagtgagctgagatcaagccactccccttcagtctaggtgacagagggaaacccttggaaaaaaagaaagtgaggccctagaaggctatggggtcagggcttgtttcctgctggatcacagtgccagtaaggacctatgcgtcttgttcggagatcttgacagttggcatgtatttgtagacttatagcatccatagagaggtgttctccaatggcttgatggacagaataaaccagctgccagtgtccttggagcctactcagggaaggaggccagaggtctgtctggtgagtcattctgtagagtcttacatcctctctctgtttttggtgagaaccctcaccctcacttttaggtggcctggtgctctgagtccagaacctccagttcaacctgctcagagtgaagtctacagtccttttgagctgagaggatgcagtccctttttatctgggttggaagaagacacttgggtctcattattcttgatgaagaataccagcaaatcttccttacatagccccgccatgctgcccctcggggtctgcaattcctgagccattcagtatctgctgtgtgaccccctttaccttgggcagcctgctctcgccaagtttaaccctgctgagcctgctgggccggcgtctgttttctggcatttctcttgctgttgccttttctcctgttcactttgtcccttttgggttattcttttttgatcccttgactctcattttagtagggtttgaggaggaagggctgataaatttgtgcccaatctcctgtgtacccaccttctactataaagaaatggaaacaggaaatcattttaaaaattatgttatgggctgggtgtggtggctcacacctgtaagcacagcactttgggaggctgaagtaggaagatcacttgagcctaggagttagaagccagcctgggtaaagataaagagggagtattggactcaatctttacaaaaaaatgaaaaagtttgccatgagtggtggtgtgcacctatgttcctagctacttgggaggctgaggtggaagaattgcctgatcccaggaaagggaggctgcagtggactttgatcatgtcattggactccagcctgggtgatattgtgagactctgtttaaaaaaagaaaaaaaaaagttattatgtggatgatgcaagagagactgtggaactctactcagagtttcattgtaagcttggtcctacactaggaacttggtgaataaataaatgtacatttacatttttaggtcaaaataatttgcttgagttaatatgtctgtaggaggcattattatttttttcacaatttaccacttttactggggctttcgattcatcaatctattctattcctgtgatgtaaaacacagtctccttttaccttataacctttatttaatagcagatagtggttgtctggataagaggaaattggaagtccaggatagtgaattatgtctttcatatttttgagacaggatctcactatgtcacccaggctagagtacagtggcaacagtcatggctcactacagcctccacctccctggctcaagcaatcctcccacctccatctcctgagtagctgggactacaggtgtgcaccaccatgcctggctaattttgttcattttttttgtagagacagagtttcactatgttgcccaggctgggctcaagtgaccctcccaccctggcctcccaaattgctggaattacaggcatgagacaccatgcccagtcacatcttcctcttttccaggtgactaaatagctaagttacctgtggaagtggactgaatctagatgatagtactgctctcagtcctctctttttcaattgttcattaattctttcaacaaatatgtgttggctgcatgccctagtgcatctccctatgggaatgcacagccattgacttaatccacgcagatgtttcctggttgttcataagcataaaagggacatagttaccaggcacagtggctcacacctgtaatcccactcgggaggctgaggtgggaggattgcttgaggccaggagtttgagaccagcctgggcaacacagtgagacccctatctctaaaaaaattcaaaacaaaaaaaatcttagtcaggtgtggtggcacctgcctgtagtcccagctacttgggaggctgaggcaggaggatcactcgagcaaaggagttagaggctgcattgagccatgattgtgccactgcattccagcttgtgtgacacagcgagatcctgtgtctaaaaaaaaaaaaaatgggacacagttgttgtgaatttctttttttttttttactttttgtctgaaggtaaaaatgtatctttgttctcttaatttttgtcaggggggcaaccactcatgtcaaacaatagtggtaaggggaggaaaatattatgcaaagggctaaatatgctgtaaaaattaccttttctatgaatggggtcatttgaaacactttaataaaatacactggttaatagtcattattggaatcaagggctccacataattttaatcatcattcagaatacttcactgtgcagcaagatttagcaatgttataggccttggggaaagttttctgcatttcttttcaagtttcaagctttcatgttatagtcctagagacacactcttcccaaaagcaggaggaagaaacagcttgctgaatggtatagccagacccctttctggattcaaatcttctcaattctgggaataaatcatttggaagaatgacttttcttggaaaagcatagttcacgtcaatagtatccaaacagctagcaaggtgtttttttttttagacaggatctcactttgtcatccaggctggagtgcagtggcataatcacggctcactgcagcctcactgcagcctccatctccatggctcaattgatcctcccacctcagcctcctgagtagttgggactacaggtgtgccatcatgcctgactaatttttctatttttttagagacggagtcttgccatgttgcccaggttggtctcgaactcctggactcaagcaatcctctcatctcggcctcccaaagtgctgggattacaggtgtaagccaccacatctggtaacaactagcagttttagctgacaaagaaattcagccctaaatgacctggcctgaagttatttttgacatgtatcttccccactgctgcacaaggggctaaaggaactctctaccgtgatatctatgtcagtgtcttatgctaggattaagagtatttatatgcacaagggctgtcatttttcaaaaacctttctttcttcctctgtcattgtttcccctccagctctccaccctgtgcacaagatactgtcctggtcaaggaggggagggaaggagtctgtaaacagtgcccgtaaagaggcaagggcttgtgaagtgatggatgctgttggaacagagcaaagtctggcaggatggacagaaaatgtgggaaccaggcctagggagggtgggaagggtgagaggatcagaatcaaacgctggagagggaggtgaagaggctggggcacgatggaggtggggaagcccaaggattagggggtaacccgcacatagagggaaggagccagggttttcttggccgtattttatgtctgcctctccttttattttattttttagtggcagacttctgagaaataagaaaataagggatgagtatggttcccataagagtaggaactcacagtacctttcataagcttataattgattttcccatctctgttttcccaagcctgacaattcagacctggaggctttgcgcctgagagggggaggggagagaaactctactagtgcatcattccggccacagcccaggcttattagcatttgagcagcaagaaggatctatccctagaagcttcctccctgccttcttcctggaactccccaaggagtgaggaacttggggagggaggagatgatatagttgaaagaagcaatattaacagtcagggagttaaacccactacaatcagccacatttcagaaaaggtaaacatgccatttttatatagacttagtgcccaccaccccctaccccctgccaaatcctggttatagactaacagttgctgttagatgcttatgaaaaataaccctgtttcccaggatgagcctaacttgggctcacactaacttgggctgggttcatattgatacatttcttcctttttctcccctaatttttgtctggaggaaaaaatgtatcttcgttctcttaattttgggctaacttctactgcaggattttctggcctgaagaaagttcttccatatgagtgtagttgtgaacaaagcgtagctccaggagttttgttctgcatagtggggagcggtggaaaccacgaggctatcgcaggtggtggacttggcagagagaggagcatatgggtttgacagcggaaatagatgtcaccatctggtacccgggcccttcagatgattccattacctccctgtcctaccccatatctaggttgagtgcggatggcatttgagatatatttgcttaattttttttttcttttttaatgacatagtcctggttttaagcaaatggagataaaaggtgatgtgctctgttagggatgtctgccaaggcaaagctcacagaagacgggagaagtttctgaggatagactacctctgacattattgcttggattggagctgggctgtttcctgttagaaaaggcagaatacaagccccagggaaggggccaatcggtgtgccagctactggagcgcaaggaggattcattcctggatgagaggtgactcagcagagagatttcctagagacacctcctgcctcctccttgtatgacgttcaaatcagacttctagacatacagcttgttaggtgtttagtgattaacttttctgtgggacttgaatgtaaatgccagactatggcagtttgggatatggtcagttaagccagatatgctttgaatagcttgttagatttaaacatctagaattttgatggctgtgaactttgaggatcttacttgggattatggaattatagagacacagggcaaatgagataaatggggttctcttttgtagttttgttgttgtttagttcatgtggtcaggttattcagtggcatgtcccatgcagatttcttacatctgccatcagctatgacatcatgcctggattccagtaacaggatggcatttcatcaaattctgaaagtcatcattatttggactagaacaacctattccttaaaatgcctagtaagacgaaatctggaaacaaccccccaggttggaactccttaacaaaatcagggcacctttgctgcagttggctgcagtgtcacttacctggagaaggcgccttgttcaccccaggatgacctgtctgtgggttaaaaaacggtgctgtcccctttgagtcagaatggtgctggccattcccctgtcgtcttttcctgccaagttggattcagtgctgcatgctggatttctggcatgctggagttagtgatggggcaaagatatgtttggaattggatgaaactctggacacctcttcagctccactgtttagacagcagctggctggagtggcctcccagtcagtatcatccattctcgagactagaggcaatcccacttctgctgatggtcacccagaattccatctccccacctcctctccagatccatgagaaagaagaggaagagttcaatgagaagagtgaaaatgattccggtatcaacgaggagcctctgctcacagcagatcaggtataagtatctctccaggttatcgggaccttttgttcttttgatggagaaaaagtccaagagaacacacttgccacatccatttaaggcagaagaaagatatgtggtcatgtggtgcctgtgctcatgactcagagtattttttgtttcttttttttctttatatatatatacttttgagacagagtcttgctctgttgcccaggctggagtgcagtggcgtgatcttggctcattgcaacctctgcctcccggattcaagtgactttcctgcctcagcctcccgagtagctgggactacaggcatgcaccaccatgcctggctaattcttataaaaaattttttggtagagatgtgatttcaccatgttggccaggctggtctcaaactcctaacctcaagtgatctgcccacctcaacctcccaaagtgctgggattataggcatgagccactgtgcctgaccttttttttttttcattttgagacagggtctcactttgtcacccaggccagagtgcagtggcaaaatcagggttcactatagcctcaacctccttggctcaagcgatcctcccgcctcaggcccctaagtagctgggactacaggcatgcatcactatgcccagctaattttctgtacttttagtggagatgaggtttcaccatgctgcccaggctggtctcaaactcctggactcaagcagtccacccgccttggcctcccaaagtgctgggattacaggcatgagccacggtgactgtccaactcagagtatttttgataagggatttcatctctctttctgcctcaggttgcccacctgcagtgaacatgaatgtcattcttgacacttgggatagttggggtcagtctctgataggagccagagacaggcatagtgtttagtagctacaatcctgctaagccttcttattgaaattcgttgtactcggagtcaagacactcaaacaagggtcccaaatacctgttttcccaaaaagagaagtgacagatgaggcttttgtgtgatggatattttcttacatttcatagaacactcaaaattttgggccttccgaaaggagtcttagagccacttcgactttgtgaaaaaagatagagtgcttcgcattcaattgagatcatcatagctttaataatttattacttagagaggataatgttcagtttctggattccttatttaatgttttagtcaacaaatatttatgggtgcttattttgagctaaacactacataagtttccacaaagtctttctgcaaagctccactggcagccttcggtgccagaaagtgcttttttagcagcaatggtgctttttcatatctgtgatagaaaggtgggaattgaaacacgtgaggattaggagactgaagagaaccagatttttaaaaataggggctaatagctattcttgtgacttgtaggaggatctacaattcaatgatatgaactcaattataactcctcttagagaaaaggacattcagccataagaccctgacagggacttgtgtcatttggttgcattctgtaaaatggctttcagtagtcaaagactgggtatttcctaagtttgtgagtagaggtgaaaaggtttgggaataagaatggaaattattctaaaggaggagaccctgaaaccccttacctttggtccagcccactgtgaagaaaccacctcaaagagtacaatgctggcctcggggactttagtccatccatggagaacagacaaaggtgaaggttgggacaaaactcatctaaagacctgctttcagcagcagtcttctttatttgtaaataattaatgtacaaagtaagtcactcttttttttgttgttgttgttgaaacaggatctggctctattgcccaggctggagtccagtggcccagtctcggttcactgcaacctctacctcttgggctcaagccatcctcccacctcaacctcccaagtaacatggactacagacacacgtcaccacaactggctaatttttctgctttttgcagagatggggtttcgccatgttgctcaggctggtcttgaactcctgagctcaagtgatccacctgcctcggcttcccaaagtgctgggattacaggcatgagacaccatgcccagctagtaattcacttttgttccttttggcagatatctaattttccctccacttctgggagctggctcctgtcaatagtctagattagagctggggttcttatctatttgctgctctctagactccacctatccttctattatttcattatctctattttcatttgttgctgggcagcttcagttcctgtctaggtgaattctggagaaatagttgttttcctccccattttgtgttgttctaggagcacgctattttttacagtcacgtgtattatgtcaattaatggactgggttttgtgttaaagttgggtgaatgaaatattttcccacttagaaatagctcagcacattgaagtaaatgttcccttccaggcagctctgccttgcttcctgaaagagcagcttatttccaataagtcatttatctaaaaggagctcttggaagaggttttacattaaagagtgccttacattaaagaaagagtgtatgcaagcctttggttggaactatttttattattcagtatttatgtaaaaacaatattgctttagaaattttcagatagctaattaggaacatccttaactgatcaaaattcaagccagaatgcccctctagcagagaacagagttagcactctctcgtgtaccttcttcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaaggtgagggccctgggcgctgggctggccgaggaggaagcacctgctcggggccaggctctgggctgtgtgctttgtacatggctaatagaaccctgactgcctcagagcagagccttgcagatctaggtggtcagcaatacctttcttactcggcatcaggagagaagtttgcatttttgagaaaagaacaaggtagtcgagcaaaatttaaatgttaaaactaaccaaagaacaagactaaggcagaataagcagaagaaatctgaactactatataaaagcaatgaatgatgctaccataaaatcaatgaataaaaaaggtaatagtaacagctcatatttctgaagtgctttctatgtgccagaccttattctaagactttctttcttttttttttgagacagagtctctctctgtctgtcacccaggctggagtgtagcggcatggtcttagctcactgcaacctccacctcccaggttgaagtgattctcaagcctcagcctcctgagtagttgggactacaggcacgtgccaccacgccctgctaatttgtgtatttttgtagagacgaggtttcgccatgttggcaaggctggtctcaaactcctggcctcaagtgatctgcctgcctcagcctcccaaagtgctgggattacaagtgtgagccactgcgcctggccttattctaagacttcctatgcctaatctcatttcatcttcacaccaaccccatttggatcaagctaaccgagtctttcagaggttacatgacttgtccaaggccactgttagggaaatatgattagaaatgagatttccttcctgttcagaaaacctctccacaaagacaggtgagaaagaaaactattttgttactatttttatttatttatttattttttagagatagaatctcgctctgtcgcccaggctagagtgcagtggcatgatcttggctcactgcagcctctgcctcccagcttcacgcgattctcctgcctcagccccctgagtagccgggattacaggcatgcatcaccatgcccagctactttttgtgtttttagtagagatggggtttctccacgttggccaggctgttctcaaactcctgacctcaggttatccgcctgcctcggtctcccaaagtgctgggattacaggtgtgagccaccatgcccggcctagaaaactattttattattgaataagcactaaaccaggatgggagccacatcacagacaactctctgaagagactgcaaagacagaaagcagtctcactcttgtgtagctaagtggatgaatggaacccattacattgagtaggttttgcaatttggagtcggaagggagttaggcccctctgctcagaacaatgagagatgattatgtttctttttcttttctttctttccttcttttttttgagacagagtcttgctctgttgcccaggctggagtgcagtggcatgatctctgctcactgcaacctccgcctcccaggttcaagcagttctcctgcctcatcctcccgagtagctgggattacaggcatgcaccactacgcctggctaatttttatattcttagtagagatgaggtttcacatgttggccaaggtggtctcgaactcttgacctcgtgatccgactgcctcggcctcccaaagtgctgggattacaggcatgacccactgcgcccggcccgatgattatatttcaaagcagtaacctccaggcccttgaagaaagcctcctgaattataagaatgacaagaggcttattttagccatgacaataatttaatgtaaatgtaacatatgtttattttaaagatttaatctaaatctttgagagattgaaaaggataggtagaagaaattctgaaagaaaagggaggtgggggagaggaaaagtctcttcccttattttcaacggggagaatcaagcctctcatttaaaatttgtatttgtgcttagtccatgcagaagccataaggggtgaagctaacatttgaagccaggtaggttaactccagaggccatcctcttaactctctgacacaggtttatagtaattatgactgtgcacaagaaacggctggatgaagcatgaaatgaaaaagtgtaacacagcaaaggcagaacaattcaccagccgtagggtatcaaatgcccacgctgcagaaggggccccatcctaggagttgatccacccatggggagatgggaacttagaaacaggggagggagaaggtgggttggtcagggttcaaaggtcaactgcgggttagaagtggtgaaagcagaggcagaatctggaggcctgcatcctgcaagtcagactttggctttgaatagcagcggcaggaggtggccggcagagagtctgctcggtgctgaactggacttggctgcctcgctgcattcccgactgcccttgtcaggcccttcccagccacacaaaggtcccaaagatagacgcgttcagcaaaagacttgtgaaaacagctgaaatgcagagtgaaatggcaaaaaaacagaagggggagagggcagctccaaagagcagaataaggggaaagcccaaccaagtcagcaaatatccgggcaaagcagaaacaaagaggaagagggaaatggattctgaggtgaaagtgaaggacaccattagacgctgtacatttgaaaataactaaaagagtataattggattgtttgtgacataaaggaaaaatgccttagggagtggatacctcattctccatgatgtgattattatgcattgcatgtctgcatccaaacatctcatgtgctccataaacacatacaccccctatgtacccacaaaaattaaaaattaaaaaccagtcaatcaattaattcttcctcccctgccgcaaaaagataccattagatggagacacattttaaaagatgtttcccaagtatattttattttttcaaattatatatatgtgtatatatatacatatatacacatatatgtgtatatatacatatatatgtgtatatatacatatatatatatatatatatatttttttttttttttttttttttttttaaagtagaaacagtttcaccatgttggccaggctggtctcgaactcctggcctcaggtgacccacccacctcagcctctcaaagtgctgggattacaggtgtgagccactgcacctggcctaaatttttttttaagtgtttaaaagaatttttaatcagaaaatgcttaaagggtataaagtttttatttatttatttatttatttatttttattttaagatagagttttgctcttgttgttgcccaggctagagtacagtggtgtgatctctgctcactgcaacctccgcctctcaggttcaagcggttctcctgcctcactctgccgaatagctggaattatagtcaggcaccaccatgcctggctaattttgtattttaagtagaggcagggtttcactatgctggccaggctgttttcgaactcctgacctcaggtgatccgcacatcgcagccttccaatatgctgggattacaggcatgagccactgctcctggcctaaagtgtataaagttttaaagcatgatttagacctgtatacaagtataatctcaactatgaaaatatataacatgtaaacagaaaaatttggaataaaatatccaaatctattttaaatgaaagaagtcttaggagacttcttaaagttatatatttcccatgatctcagcttcccttttctttcctttgaaagtagctgactgccgtatgctaacccgctaggctttattttttcatgcatagtcaccaatcttccaggtttcacatatttttgaatacatgcactgcgacacaggaccagagatgtaaagaagggctcagatggtcggcttttttgttgttgttgccgtatgctatatcttgatcagttcttgggaataagcaccaacgtctctattgctcttcagtatggatgacaaaaacctccctcccatcacttttccatccccaattcttgacccatttcacacaaggaatcttatggacacagatagaaaatagaaggaacaaaccatccccatttttgagaatagagtccacagacttcctcgtgggctgtttcttcttcctcctttgtttcctgagaggggtgttctcttctgcagtcagtacacaggcccccgccttcctggcgtgctcgtaaattgtgaaggtctttcttggatctttaaggagttggaagggatctcctctgaggggcagtcccatcttgattggtggtggccccaggagcctccccagcgggctctggtgtggatgcaggtgttatgcgggagacggtcttcccctgcagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaaggtaggtgaacaaccaggtggaagactgggtgcctccaacctccaaccctgcccgtttcagtgccctaccaaccctgcaggggactcatcaacgtttaccgagcagtggtggtgagcagcacactgtgacagacagggggtcagaaagggagaagatatcacctatctcctccactcccccaaagggctcacagtctaacccaggaagacagtgtgtacattaggaaataattgaatttggcttgtgttctctgtaggcaagaccttaaagaaagtggagtgagggtatttcgtgttgggagtcttgagatgggcctcagaattctgggtccaaatccctccttgtgtcccaggttccagtcctgactggtctctttagggcgtgctaaggtgtttcagtgattgaaaatgatcaggtgccttattattattgttattattttttgagacagagtctcactcttttgcccaggctggagtgcaatggtaccatctcggctcactgcaacctccgcctcctgggctcaagcaattctcctgtctcagcctccctagtagctgggattacaggttcatgccaccactcctggattatttttgtatttttagtagagatggggtttcaccatgttggccaggctggtctcaaactcctgatctcaggtgatttgcccatcttggcctcccaaagtgttgggattacgggcatgagccaccgtgcctggccccagatgccttattgttctattgttctatttttgggtttaacccaaacccctggttctcatggttcattttttttttcttttttttttttttggtgagatggagtctcactctgttgcccaggctggagtgcagtggtgcgatctcggttcactgcaatctctgcttcccgggttcaagcgattctcctgtctcaacctcctgagtcgccgggattacaggttcacaccaccacgcctggctaatttttgtatttttagtagagacggagtttcaccatgttggtcaggctggtctcaaactcctcacctcgtgatctccccgcctcggcctcccaaagtgctgggattacaggtgtgagccactgcgcccagccactcatgcttcttaatcaggggagctcagtagaattatctaaggagtttttttcaaaatgcctttccctaggctctatcacagacctatggaattagttctccgcatgtacattttgaaaaaaacttcccccatcaggacagttgctttaagacagcctcttctgatagctgaacattttgttttcccctaagatctttgcatcatggttcatttaagtttgactgaactgctttatttttctatttgcatgatggaggataaaaggaggaaaactgggggatgcagaggggtcttgtagccctgagggacttactaagataagagttcttgagactctgtttattcttgcaaagctcaggcttcaattctggcctgtctctgtaagccagtgtcttacacttactgtctagtcacagaaccctggggcgttatctgggacagcctggtagctgagaggtccctgggtgtggtgacagtgtagcaagaagcatttgcccttcttgagtctctctcccccacagcgcttcagcatggaaggcatctccaacattctgcagagtggcatccgccagacctttggctcctcaggaactgacaaacaggtacgcgtagtctccctgctccaagctctcttcctagactcctgcagcttggcctccccagcaacgcagggggacagtgactcaccagaattatcccagcatttatttagggggttaggggtcctaacacttttttctcctcttaaggaggaacagagaatatctttttaaaaggcaaactttttttttttttttttttttgagctctagtgttctaggacatgggcaagacttaaaactcaacactgcttgtaggtctaagaattaagttgttttaaggatgaaatgcattaagagggagtccatttgatgatagatcccatcctagagtttagttaactttccaccacactggatcacctgccaagccattcccactaagactgcctctgcagcttcccagctctggttggaacccatgctgtggctttttgttggctcagtaatttccctgtgacatagcttgcatttctggttattaagacagcattcacaacttttatcaagcgcctgctatgtgctaagctctgttgttaagccctcaggtgcaaaggtgaaaagtcctgacccctgtcctcatggagtgtataatctaatagacatggctggcacgtgaacagaaagtttgagatggtggaatgagtgtacatgaaagtgtatatgttttaaacatatttgtagctgaattctaagtgctagaattctagaactctagaattctagagagtctagagaaggggaagagattttagcagcatcgatcccagtcctcttgttttatggcagtgagaactatggcctggagattcaaggcatttttccaaagccacacacactgtcagtggcaaagccaagactaaaatgtgagcttctggccgggcgcggtggctcacgcctgtaatcccagcactttgggaggccgaggtgggcaaatcacccaaagtcaggaattcgagaccagcctggccaacatggtgaaacctcatctctactaaaaatacaaaactagccaggtgtggtggcaggcacctgtaatcccagctacttgggaggctgaggcaggagaatcgcttaaacccgggaggtggaggttgcagtgagccgagatcaagccactgcactccagcttgggtgacagagcgagactctgtctcaaaaaaaaaaaaaaaagtgagcttcttagctttgatctagagctctggcactcaccacctcaggcttccttgagactcctttgacagcccactaggccctgatgctggttttgttgtaggagcacctgacatccagcagagggagcaaatctgacatcagagaccctgggcggggttgaggttctcttgcatatcttttttgacaaaagacaaacaattccttctcaaattgcactgcaaagaataagaaaatataatccccttggatttattctctgctttcagtctaaaggagaaaaagctccccaggattcctaaataacagagaagtttgtagtgtaggaagaatctagaagttgggatggagagaaatgtgggaaagtcttacttttaaagagacattccctaaagaggggtaagaagttctgaaacagtgacgtaccagtgaccatgaatgtttcagagaaggtcagatttgcagtgtgtgtcttagagaaaggctaaatctcaacccagaggaagcatgtcttctgtctcaagccccctgcatgctgtttgtcttgcagtatctgaacacagtcattccttacgagaagaaagcctctcctccctcagtggaagacctgcagatgctgacaaacagtgagttcctcttgttctcagccagatcagtggctcctttttctcccttcctgcctgtacgttgtacctccgtgccgcaggcccgagactcctcaaagcaggtttacatgggccaaaataccctccaaattactgcgtcacatcctcccgcacagtgtaaaattaaaatactctgcagtgataaccagagctgttttttctttctcctggttcccataagggaagaggcctgctgggggaaaaaaaaatgagctggtgaaagaggttggggtgctggtgcaggggactttttgttttcccctgcagttcccaaggcttggcatcctctgcctccctgttctctctctccctgcaacttgaggttgcctggtcggcacttgtgccccttgaagcagggcgcctggtctctgggtctggctgtatttttaatgagaagcaaggtttcttgggtggggtaaggctgactggaaaaaatagagtccagctttccttccaggaagtgactgcctcctctcctccactttgctctattgtcaaatattaataaacattctgaactatgagggaaaacagtgtgtaacaaagagccttttgtagacagtaactgtttatatacatcaaacagtacgacccccaaagggctggggggcacatggtgttagccatcagtgtcagcttggccctcttaggacgagaaaaatcctaggctgagatgtggtgacaggcccagaggatcacgagggaaattccatttccttggcaaccgtgccctgcagagagtgacagctaacgaggccccgcccactgcagcctgttctggagggaaggggccagtgcggggctactggatacccaaggagaggggaagttgagcttctgttcagctgaggaggatggatacctgctggggcctggtgctgaaggtgaccaaacgtttcattttttgtcaatttggagagtgaaagcaggaggttctggcaaacagaaatcctgcctacatcatgcctgcatcaatagacactgtgtccttgagaatcaggaattttaaaatcaaagtacagtgacttgtccttaactcattgtaaactcctttatttgcataaatatgcactaagtttctttttttttaagggagaaaatagagatgaactgacatttatagatgtttgtgttttcacacaagttacatttggaaagtaatttggacaaattatgaaggttgatatatgtaaagtattctatcatagctcaaaaaaataaatagctattaatttgttgcagatacccattcaggaattcagtgtgaaatcttttcattttaattaagaaacagacttttttctattttgagtggttttgtttacattttttaagttcattaaaaaaattatagctagagtatatccatcatttagactactttggaaataaggaaaagcaaacaaagaaaaataaataactcattgtctactccactatggttaccattttggtgcttttcagacttaatattttgtatcttttctatatagttgagattatactggctgtaaaattttgtgtcatgattttagtcacattagttaacactttgttaatgttctttttatggctatctcttctatcatgtggatatactaccttccaacattttattgcttttagaaaaaaaacctgccatcttttctgaataccaattctcctgtaggttatgaagcctctcttttttggcagatcctcatatgaatttgtgaacaatgcctcttctctcttctactctttgaactaagtacataggccaaagaccagctcctgcgactagccaatccttgtaaattttagattttggagattaatttagatacgtattggcaagagcaattattgtatttttacgtgatcttcgtggtgtggcatttagtctgcttatgctcagttgcaaagtgttcttgacaactaagctgaaatgaaggcatgtctaaaaatgcagaaaaaaataaaacaggccgagtatggtggctcacgcctgtaatcccagcactttgggaggccgaggcgggtggatcacctgaggtcaggagtttgagaccagcctggccaacatggtgaaacccccatctctactaaaaatacaaaaaattagccagatgtggtggtgcacgcctgtaatcccagctacttgggaggctgaggcaggagaatcgcttgaacccgggaggcggaggttgcagtgagctgagatcgcaccactgcactccagcctggatgacaagagtgaaactccgtctcaaaaaaaaaaaaaaacccagaagaaaccaggaccccctagaatccacttaagctgagatgaatacatgtctaaagatacagaagaaataaaacagaaacaaaccaacccctcaatggcctcaggttgagtctctttttctggacctggctgctgactcacgccaccattggattttcttcctcactcactcctaattcttggattcaagtttcattaccctgtcttgaaactagtcaaggtaatcaatcaaaggaggacaaggatatcgaaatgaagtggcaatcccactgttgcagctgccttctgaccctagctatcagtgccagttgatctttagtgttttcttggcttacaaaagtaatacatgctcattgagaaaagccagaccccacagaaatgcagcatagaaaagaacatcccctattgtcttacactcagagataactacttaacagtttcatgtattattgttctagattttttttctatgaacattagcatttaattataaagttaataaatgttctgtaacctttcttcactgataactatgtcttgtacatatagctctctcttatttttcttttcttcctcttcttcttttttttttttttttttttttttttatagagacaaagtcttgctatgttgtccaggatggtctttttcttgtttttgagacagagtctcactctgttgcccaggttggagtgcagtggcatgatcacaggtcactttgggaggccaagtggggaagattgcttgagcccaggagttcaagaccagcctgggcaacatggcaaaacctcatctttactaaaaaaaaaaaaaaaattagctgggcatagtggcacgtgcctgtaagtctcagctacttgggaggctgagagggggaggattacttgaacccaggagtttgaggctgtagtgagctgagaacacgccactgcacttcagcctgtgtggcagggcgagatcctgtctcaaaaataaaaaagaaaagaaagtcaccagtaggtccactacctagagacaaacactgtggctcttgctgtgttctcgtctatcaccatgtgcaggtttgttacgggggcatattgcgtgatgcctctcaagtactttggactacaggcgtgtgccaccacacccagctatcttttttttttttaattagaaatgaggttctgccatattgcccaggctggtcttgaatgcctgggctcaaggtctgggttacaactgaaactaaacctgtcacccaggtagtgaacatagtaccggataggtagttttttagcccttgcccctgaaatgctgacccctgatagagccttctagacttttgctcaatactcaataaatgtctggttcttttgaatcatttctctctcactctgggctggtgggtcatgtggccctagaagtgaacctctgaccagatggtatcttagttcctctctctgtctcctttcctagttctctttgccatgaaggaggataatgagaaggtgcctactttgctaacggactacattttaaaaggtaagagcagccccaggcctcctggagcagaaggggttctctggagctcctgctccagttagggaaccttcccagcttgcccatgccagaccagaccaggcaggggccagggaaatcagggacaattgaaaggctttggagtaataggttttccctttgggtgttgccaggaggccgcaggaggagattccatcacccccgagtcaccagtgactttccttggagcaacaaaccaacaaaggacttattgtgaaaattctgcagagtttgggctacttagtatttagttgggaaaaacaaaacctgatgataatttaatacttttcaagcacttgaaaggaagctggagacataattgactacaccctttcataactttttaaccttgtcttatggaaactggttgtacatacaagagtagaggaaatggcataatacactctcaggtactgatgagctggcatcaacagttattaagtcccggccaggcttatttcatttacgcctctacccaacttctcccctcccatgttattttaaagcaaatctctgtcatagttttcatgcataactatttcggtatgcatttctaaaacataggaactcttgaggaaaacatagccataataccatttcacaactaaaacaaatgaagagtttctttctttttttttttttttgagatggaatctcgctctgtcacccagtctggagtgcaatggcgtgatctcagctcactacaacctccgcctcctggattcaagcaattctcctgcctcagcctcctaagtagctgggattacaggcgcctgccaccatgctcaactaatttttgtatttttagtagagacggggtttcaccatgttggccagggtggtctcaaactcctgacttcaggtgatccactcgccttggcctcccaaagtgctgggattacaggaatgagccactgtgcccagccaagagtttcttagtactgactatccaatcagtattccctgtttttcccataaagtatttttcagtttatttgtttgaatcaggggccaataaagatcagtaggttgcaattagataataatatgtctcttacatctctttgatgtatataggttccccttttctttctctcttccatttcttgaaatgcatttgttggagaaactaggttgtttgtgccatagaatttcctcattgtggatttttgctaatttcatccccatggtgtaatttaatatgttctcctgtcttctttattgcctgtgaactgatagaactggaagcctgatcagatacagcttccgattttttgataagcactacattataggtggttataggtttccagacttccatggggtgacatatattgtctgattgtctttccttttgtgatgttaatagtccttgaggattgctcactgtctagatctattattttattgttttttgtcctgcatgcacacaaaactatgtacggttgcagagggaccatatttgtgggacctatagctaagaaatcctgagatatattgtttctataaggatcagaaggactaatcttaaatttcagcaggaggaacttagagtaaacattaaaaataacttgtccagcctgggcaacatggtgagaccgcgtctcaattaaaaaaaaaatcagccaggtgtagtggtgcgcgcctgtagtcccaactactcaggaggctgaggtgagaggatcacttgaacccaggagctgagactgcagtgggggctgtgatcacaccactgcatccagcctgggtgacacagcaagaccctgtctcaaaaaaacaaacaaacaaaccacaaaacaaaacaacaacaacaacaacaacaaaacacaaaaaaccacagaaagggtttgtgactcaaagattttaaaagagcagcacatttctcaaaggaggttctcaaaggaggattatagaaacaggttatataaatttggtagtcggagggctggactttacccctcacgagccactgagttgtcactgaatttgtacaagtgattaatatttactcagcacttgccacatgcctctcaacaaccctgcggggtaggcgcaggtacgttctattgtattgatgaagaaacaagcatggaaaggtgaagttaatttccctaaggtcatgtagttagtaatggctggatccaggatttgaactcaggccccggagactacacgcttagttattataaccagcaaccacctgccattgtctctcccttattctaggcactaagtgggggctgtcaccactcaggagctggtgtgactgctctcagctagggctatccagggctcggaggtccccacctgcaactgtgttctgaccgctctcccctcctctcttctcgttgcagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaatt

SEQ ID NO: 36430 - DNA, 73937 bp, Homo sapiens
cccggaagtgggccagaggtacggtccgctcccacctggggcgagtgcgcgcacggccaggttgggtaccgggtgcgcccaggaacccgcgcgaggcgaagtcgctgagactctgcctgcttctcacccagctgcctcggcgctgccccggtcgctcgccgcccctccctttgcccttcacggcgcccggccctccttgggctgcggcttctgtgcgaggctgggcagccagcccttccccttctgtttctccccgtcccctccccccgaccgtagcaccagagtcgcgggtcctgcagtgccccagaagccgcacgtataactccctcggcgtaagtgctaggaatgccgctggcctcgcggggaaacgcattctttctatctatagctcgctctgtacatcttctgtctacggcagctattccagaggcaacaactgcttccctctgttctcatctccccattggtggctggcgacccgaatttgggaatggggagattgcccacctgttatctttgagcagactaatctcttgtaagcagaagtgccattcggagtctccagagccctgtggcttggggctgggaatgtccccctgacttcaggctttcctaagtgtattgcttttctctgagaatggtctaggtttttaattttttaattgtaagaatctgtaatacagcatttttatttcggtcttattcgttgtgctcaaaggcaggaaacaactattaatttgccttctcgaatcttaatagttataagattcattctctttcattgctctgctaggcataaaacacacttcgaacatgtaagtgccgctgtcagctctggagagtttaaggcaatagttattttcgatattttaactcctttttgtttcataggggtaactcattcgactgtggagttcttttaattcttatgaaagatttcaaatcctctagaagccaaaatgggacacagtaaacagattcgaattttacttctgaacgaaatggagaaactggaaaagaccctcttcagacttgaacaaggtcagtagcaagttgttttgatttgctcatttgcgtcttttaaacttttaattcattggcagtcctgttaaatgttttaaagctctaagataaatattatttccaagggtctaaaacttgatttgtgcaaagatggtgctgtgttctccatatatcactaattaatgttgatttgaattaaaaatattttatatccctcgtgttaggataaggataaaatagttctcttttctctgcgtactaattcccacttaagattgaagttaaatatatgatcagaagattgcccatattatttctaataacatttactattaaaacttggtaaattacttcatatgtaattttgctttgggtatgcatgtagttttgcctttgtataactgtctcttttcctttgttgaacctttgaattgacaaaatagattgcagcaaaaagtatagtaaactattgtttatgtatatcaaaaacttctcaaatgtggagtaggtaaaagctgaaaatattttcttagcaaataaaaagtgcaataactcatctggttatgttgaactatatatagttgatctgtatttaaaagatcaaattacttttctacaaggctagttaatagatgttttattttcttagcctttgtaatttttcaacattgaagaagtgtaatatatgaaaaatccagtcccccttattaatgtaccaaatggatgttgctagtcataaacatttcaaaggaatttttaaatttcgctaatgttttaagaattaaatttttgaaaaaaatttcacacatacaatgtgatatcttcatgccaaatccgcgcctttttccaactttggcatttaaaatcactgagtacctactccatttttggctttcctgactctgcacttttctggttttgatttttttttccccctcccctgttgcatattcttgtcaacttggtgtctcttactaggctctcttcctttcactttttaattaattatgggtatctgctaggaattctttttctgttctccttcaaagaattagttacacagtctcatggcctcaactgttgcctctgtgctaatgactacttttggaggaaaagccttgagctttcttcttcttggaagctttcagcatttgatgacgggtagatctagagccagaattctcctggctctgctgctaacaagctgacttggggcaagttacattaattctgagcattcatttctttttttttttttttttttttccttttctctttttctgagacagggtcttactctgttgcccaagctgagtgttgtggcatgatcatggctcagtgctgcctcaacttcctgggctcaagcagttctcctgcctcagcctcccaagtagctgggactgcaggcatacatcactatgccccgctaattttttttttttttttttttgtagaaactgggtctcactatgttgcccaggttgatattgaactcctggactcaagcaaccctccctctttggcctctgaaagtactgggattacaagcataagccaccgggcatggccccaattctgagcattaatttatttattggtgagatgaaagtggtaatttctgttcttctacctttctaggttttgagactcaaaattaataatacatgaattttttgtgataaagccctaaataaatataaggcattgatatgaatcactccatgtattcccaccctggaccttggcttcaacctgatattatgcaatagaatagtattaggatagctcaacttggatatgcttaaatctagcatgtccaaaaatatcccctgcccattctcgatcctttatttctcagcttccctgtttatttcgtggcatctccatttttatagttcccagggtagaaaccttatattctttgatgatttcttctcttttcctgcagtctctttttaagcttgcagtttctttccaaatatctctgattgcctgtctattctgtatggctgaatatagatgccagaataatcttatgcagtctcttccctttgttattaagtggtatgtataaaatcaaatttaaatacctctgtctgacttctaagacattctgtaatgagactacaccttccttagccaagattgtatctcattctccatcattaatgtcatagatctttacagttgcccaagtcattcctgttaattcccttctcagcaggttttctcatgcctgtccttatacccgtactcccatcagattcctttatatctgttaaatctcatttactgtcagtctatgtgttgcctaagtttcaactttcagctagaatatcacctcctttgtgaagtctttccctaatttttcactgtctgcttcctttgatttccaattacacaatgagcacagaactattaagtgctgaataatgaagcagtgtctaaaggcttgttagtcttacagtgtcagactagggtttaaaatctgtgagaattgatgagggcaggtgactcacacttgtaatctcagtgctttgggaggctgaggctggaggaccacttgaggccaggagttcatggtcagcctggacaacatagtaagactttatctccacaaaaaagaaacaaaattagctgggcatgatggtgcttgcctgtggtccccagctacctaggaggttgaggctggaggatctcttgagcccaggagttaaaggctgtagtgagctatgatcccaccattgcactccagcctgggtgacagagtgagaccctgtctttaaaaaacaaaaataaagggccgggcgcagtggctcacacctataatcccagcactttgggaggccgaggcatgtgggtcaccccaggtcaggattttgagaccatccagcctgatcaacatggtgaaaccccttctctactaaaaatacaaaaattagccaggcgtggtggcgcatgcctataatcccagctacctgggaggctgaggcaggagaatcgcttgaacctgggatgcagaggttgcagtgagctgagatcacaccattgcactccagcctgggcaacaagagcaaaactctatcttaaaaaaaaataaaaaataaaataaaatctgtgaggatagggacagccttacaaacttagtgcagtgtactgctgattgattactagaactctagttaaaactagcaaaaattgtaaaagctaacctatttgaagagggaaattgaaggatttatgaaaaaagaatgatgtggttgactttataactctggttaaaaccggtaaatgtatccaaatgttataaatgagaatgtgccacctttttttgcagtaatggtgtgatcattttgttttagaagataatttgaagccgggtgcggtggctcacgcctgtaatcctagcactttgggaggccgaggcgggcggatcacgaggtcaggagatcgagactatcctggctaacatagtgaaaccccgtctctactaaaaatacaaaaaaaattagccgggcctggtggcgggcgcctctagtcccagctactcgggaggctgaggcaggagaaaggcgtgaacccaggaggcggagcttgcagtgagctgagattgcgccactgcactccagcctgggtgacagagcaagatgccgtctcaaaaaaaaaaaaaaagataatttgaaatgtgaaagatgagtggaagagtggtagagaagggacattggagacaagaagcattgagaaggctattttaaaaacacatctgattaaagaaaaggattgaacagcctgagttgaaaaagagaggacaaggccaggcgcggtggctcacacctgtaatcttggcactttgggaggccaaggcaggcggatcacctgagttcaggagtttgagacctgcctggccaacatggtgaaaccctgtctctcctaaaaatataaaaattagccaggcgtgctggcgggtgcctgtaatcccagctacttgggaggctgaggcaggagaattgcttgaatccaggatgcggaggtttcagtaagccaagatcgtgccaatgcactccagcccgggcaacagagcgagactccgactcaaaaaaaaagaaaaaagaaaaagagaggacaaagtatgagttattttcaagttcagaggacttggtaaccaatcaaatgtgaggaaaaactctggcagtttttggctgtttcatatttaattggtcatcaaagccctcatatttctttccttctctcttttctacaagaaggaattcctcctcgtttttaagactgatatttctatagattcttccagttcaacaagtacaagaataaataatgatcttttctagacaaatcatagctttttcgcttatttcctatctcatttagtggtagaataatgaataaaatcaggccgagcacggtggcttactcctgtaatcccggcactttgggaggccgaggcgggtagttgacctgagatcaggagttcaagaccagcctggccaacatggtgaaaccccatctctaccaaaaatacaaaaattagccagatgtggtgacatgcacctgtagtcccagctattcaggaggctaaggcaggagaatcgcttgaacccaggaggcagaggttgcagtgagccaagatcacaccactgtactccagcctgggcaacagagcgagactcggtctcaaaaaaaaaaaagaataatgaacaaaataagtacttcccaaatctgaaattcttccatcttttaagtaggttgatgaaatttataatttttactattttttaaagaaaatatttagacataaaggttctttgattagaagactgagtttctataaattgagtggaggggaaaagatagaacatatttatttacaataatagtttaatcactcattatgctagttgcctacaagagagacatggctaatgcaagttaagtatcctagcattagtatgaggaataagatagccacaccatgtactgctatgacctcagctaattttagcaaactgagtcatggaatctgacctactgtaggctctctgatgtttcatttactgtatataaaaattttagtttcagtgatttgcattagaggtctacagagtggctatgtatcccttggggtatgcgctgatatatctattgggctacagaaagaaaatataacatcccttccttccttcctccctccctcccttccttcctccctccctccctccctccctccctccctccctcccttccttcctcccttcctccctccctccctccttccttctttccttccttcttccctttcttttcttttcttgtatttatttatttatttatttatttttattgatcattcttgggtgtttctcgcagagggggatttggcagggtcataagacaatagtggagggaaggtcagcagataaacaagtgaacagaggtctctggttttcctaggcaaaggaccctgcggccttccacagtgtttgtgtccctgggtacttgagattagggagtggtgatgactcttagggagcatgctgcctccaagcatctgtttaacaaagcacatcttgcaccacccttaatccatttaaccctgagtgaacacagcacatgtttcagagagcacagggttgggggtaaggtcatagatcaacagcatcccaaggcagaatttttcttagtacagaacaaaatagagtctcccatgtctacttctttctacacagacacagcaacaatctgatttctctatcttttccccacctctcccccttttctattccacaaaaccgccgtcgtcatcatggcccgttctcaatgagctgttgggtacacctcccagacggggtggtggctaggcagaggggctcctcacttcccagtaggggcggccaggcagaggcgcccctcacctcccggatggggcggctggccgggcagggggctgacccccccacctccctcccggacggggcggctggccgggcagaggggctcttcacttcccagtaggggcggccgggcagaggcgcccctcacctcccggacggggtcgcagccgggcagaggcgctcctcacatcccagacggggcggcgggacaaaggcgctccccacatctcagacgatgggcggccgggcagagacgctcctcacttcctagatgggatggcggccgggaagaggtgctcctcacttcccagactgggcagccgggcagaggggctcctcacatcccagacgaagggtggccgggcagagacgcttctcacttcccagacggggtggcggccgggcagaggctgcagtctcggcactttgggaggccaaggcaggcggctgggaggtggaggttgtagtgagccgagatcacgccactgcactccagcctgggcaacattgagcactgagtgaatgagactccgtctgcaatcccggcacctcaggaggccgaggctggtggatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcggcagtacagtccagccttggctcggcatcagagggagaccgtggggagggggaggggggagagggagaccgtggggagggggagggggaggggggaagagggagagggctcttttcttttctctctacctgttttagttttttaagtctgttatatgttagcaacattgaattacgttaatatatgaattatgctctcagtttgtatgtcagataagttacaaacaaaaaaggcatactcagaagaaaacgtagaggttgtaggtctggaaggggttgacaatcacaccctcatttgtttgcagtatgttgccatgcattgcacttttacttaagctaggttaagtagctttacgggttatattatcttaaataacagtctctatattactttgtaaggagaggtagagtaaccaagaatagttcttttacctcacaggagtgatcgaacttaaaagatgagttagaaagtgtttgagattcgtccttttcagaaataacaagtagcattagatagtatgatacttagaaaatattttcagaaaaaataaaaacttaagtctttgatgtaaacatgagtgagaaagttaagtgcttttttgaaggaaattgatgcttggagcagagtttggcacatattttcctgcaaaagttcagatcgcaaatctttgcagcttttcaggcaatgcactccctattggagcgactcaactcccattgtagcaggaaagcagccataggcaaacatacatgaatggatgtggctgtgttccagtaaaacttcatttacagaaatggggattaggctggatatactttgccaacccttgctatagtgaaagcattttgaatatatatttttagaaatgcttctttcatcattatatgattttacccaaaataagtagaacttgaaatctttgaatcactttattacaaaatattaaaaccaagactttttaaaataatgaaatttatttagttacattttcactgagagatattatcaatattaatttttagtgagagccaaaaggttttttctacccactaataaataaaatgtattatttaaatattatttatttcatttatatcttatcccattaagttaacttttatattttataatttacataatctatgagaacatcatacatatatattatataaataaatgacttagcttgggaattattggggttttttcctgaaggtagagcactgatccaaatactgttttggagattttagatgagttttaacctttgctctgcaagttctctgaatacttgtgtaattataaaaacagtatttgtataaacttaacaggggacaggttgtacacatatacccagacagctaatctctgctgtttgtacttgttcaaaatgacactatttctcctaaagataaatttagtcattcttgtgagatgtaaatgtttatgcttctcagtcactaagtattttacttcatgttttaattctttctgtaattatttcttagtctatcccttcataattgtagctctaattttaaaatgttttccctaattataaaattatgcaaatgtataaaaagcattttttctgtgttttttttttaattaggattatactatctaaacaattttgtaacctgcctttttcccgtttgtagtagtattatggtgtatgtactctacctccctgcctactgccatgtttcagccatacttttttccagaagatattttaaaagctctacataaatgtgtacaatgtaacaaaatagaataaattaaaagtggttattacattttttttttaatggagtcttgctctgtcacccatgctggagtgcagtggtgcgatcctagctcactgcaacctctgcctcctgggttgaagcaattctgccccagcctcctgagtagttgggattacaggtgcacaccaccacacccagctatttttgcgtttagtagagatggggtttcaccatgttggtcaggctggtctcaaacttctgacctcaggtgatcctctcgcctcggcctcccagagtgttgagattacaggcgtgagctactgtgcctggccaaatgtcttttgataacatgatttataatggctttacaatatgccagcttgtagatttaccataatttatttaatcactgccaatcattagatatttaggttgttgtcagtttatttcatttcaataaatgaggctgtgataaatatccttatacataatctctgtttacatcactgatacttttctcaaaaaatctatataaaattcctagatcaaaaaatataaacattcttaatatattaatgccaaattgtattatagaaaaagtacatttagttgcttagagaagaaattcttagtttcactatagagcattctcttagtgtcttttactgaaatcttttgttcacagaaaatatccctgttagtatatcctcttttattactttgttggatgtttaataagtcaaggattataaattataaataatatatattaaataggtaaatattagtttttttcctctcaaagaaattccttagatattaaagattttactcagtggaactaaactttcctgcctcatcagttattattgcccattattaattgaaagttatattcgtgtttaaaatttatatgtattatatttctaatagacttgaccatagtcagtatttttgtattctaataattataaagaaggtttaaagtctgctttaaaccaaccaaaatgtttctttcacagtacagttttaactgtaatgtgcttatttgttttcgcttatggcaaaatatttgtaacacattgcacaagtctaaggtatgtttttttaaaaataacctaacttgggcaaaagtagaaatgcattggctctcaggattacaagacagctttagtaactaaaccatgaagcatagggatataggcagtagtgtgttggaggtgcttttgctggctcacaagagctgattgtgcacatcccttcccacttccacgttcaatgttgtcgtgttggtagcttaagattgcccatgtcgggattatttccaccagaaagtcagcaaacactccaagtcagaggttcccaccaccctagtcagttgctaaatctttattagcacatcactggacttgagcagatatcagtcgggttcagttgccttcagaactcctgttagaatcctgaattctgcctctatagaggttgacttctgtcagtgaagactagctttctcagtatggtgagataatagtcccatggtagctcccaagttttacagactatcacatactttctgacaccatagagaaactagctttctctgttgcagttagaaaaatactagagaaggtctctcctcagatgcctgccattgggtacttaattcaggggtgaggatgggggatcatggtaaatggggttgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaagggtaagtcaggtgttttgtttgtgagaaaaaaagttaatttgttctgtaatttgaagtcacctaacttgtaaatgttactgtatgaaccatggcagtgcaatttttatagtgcttccttgagatgcaaatagaatattctttgatttctaggaggtaattttatggtccattgcagagctaaagtatcaagtaaatgtattttaagtaacatcttaaaatgtagtaatttcatgcaacctgattataggttgctgtttatttgcgtgcccttgttattactgataggttttagtatacttatatttcattaaaccaacattcttggatattttgtgtattatacatgtaattatgtagattgtgaaagggtaaaagtagcttttccattaagttttgttgcaacttttaaaatgattttatgtgcttagaaataaatacattttatttgggacaattaaccttttagttagagtcagactatattatatgaggattttttttctatcactgactgaaaagtttttgttttgttttttcccttagaaatgagaaaagtggtggaggttacatagttgtggaccccattttacgtgttggtgctgataatcatgtgctacccttggactgtgttactcttcagacatttttagctaagtgtttgggaccttttgatgaatgggaaagcagacttagggttgcaaaagaatcaggtaatgtcagcttgctttctttttcttatttaaaaaaataaatgtaattatcctctgtgatatagatttcaaaagttttgtgtattagtccattctctcattgcagtaaagaactacctgagactgggtaatttataaagaaaagaggtttgactcacagttccgcaggctatacaggaagcatggctggggaggcctcaagaaacttacagtcatggcagaaggcaaaggggaagcaggcatgtcttacatggccagagaaggaggaagagaacaaagtgggaggtgctacgtgcttttaaacaaccagatcttgtgaaaactcactcactatcatgagaacaagggggaaatccacctctgtgatcaaacacctctcaccaggcccctcctccaacatcggggattacaattcgaatgagatttgggcagggacacaaatccaaaccatatctttttgcctctatgtttaattttgtttcttattatttagtaatataagtagatagaaccatattaaaaaaaaattttttttttttgagacggagtatcaccctgtcacgtaggctgcaatggtgcgatctcagctcactacaacctccacctcccgggttcaaacgattttcctgcctcagcctcctgagtagctgggattataggcacctgccaccatgcctcactaatttttgtatttttagtagagacggggtttcaccatgttggccaggctggtctcaaacttctgacctcgtgatctgcccaccttggcctcccaaagtgctgggattataggcatgagctgctgtgcttggcccatattacatttttgatacttaaccatttttaacctataaaaatggcaaattttgtggttcagcttaagaaatgaaggaactccataatgaaacacttatcatttctaagactttaccatataaaaatcagaaataagctattgaaaagtgaaggaaaatgtattatcattatgtatcattttaattcaacaaacattggttaaccatcttttgtgtagaagacatgtgctaccataaataccaagagcaaaatgaaacttgtgtttcattttggcgcaatctcggctcactgcaagctccgcctcctgggttcacaccattcttctgcctcagcctcccgagtagcttgggactgcaggcgcctgccaccacgcctggctaatattttgtatttttagtagagacagggtttcacggtgttaggatggtctcgatctcctgacctcatgatccacctgcctcagcctcccaaagtgctgggattacaggcatgagccactgcgcctggccttttttttttttttttttttaagacagtgtctctgtcacccagactggagtgcagtggcctgatctattttttgtagagacaaaagtctcactgtgttgcccaagctggtcttgaactcctgggctcaagtagtcctcttgccttggcctcccaaagtgctgggattacaggtgcaaaccactgcacctgatctcaatattaattttctgcttttaagttggataatacatgaagaaaggaatgagaagttcactgacataactaaaacagaatacaagtactatggaacattaaaagtagtagaaacacgtgttgatatactcgtagaagataaatttactacatgttaagtatataaattttctaataggcagtgtgtgtgaattttttcaaatattatctcattatctctgtcttgtatatgaggacacatatcttgaaagatttaaataaacttgcttaaagtctcttgtggtacagttaggatttgaacccaagtgtttgacctcttttccagtagcatgcttgccttgctatttataattacttaagaaagtttaaatttatattttcttcattttaggctggttttgtttgtttgtttttacagtggtctttcctttatttgctttgcaggctacaacatgattcattttaccccattgcagactcttggactatctaggtcatgctactcccttgccaatcagttagaattaaatcctgacttttcaagacctaatagaaagtatacctggaatgatgttggacagctagtggaaaaattaaaaaaggaatggaatgttatttgtattactgatgttgtctacaatcatactggtatgagcttcattgactgccttcattaattttgatgagaatttatgcacacacacatatacacacaaataagagaaaggaagaaagaaagagaaaggaaaggggctaacataaattttaaaaacacaaatgatgattaggtgtccttctgtttaaaaaattaatatttttcctttcaaagaaaacattcttaattgaggattaagtcaatatataagtatcttgcatctgttgcttataaatacaggagagtgatcatagaaggaacataatgatcacatatttcaacttacagtacagtagtccccccttattcgcagttttgctttctgaggtttcagttacctgcagtcaatcacatttcaaaaatattgaatattccagaaatcagcaattcataagttttaattttcatgctgttttaagtaacatgacaaactctcatgccatcctgctctatcccacctggaatgtgactcatccttttgtccagtgcatccatgctgtaaatactacctgtccaccagttacttaatagcctgctcagttatcagataaaaaaacacaaaatatcaaaatatatatatatatagggtttcatactatctatagttttacacatccacttgaggtcttggaaggtacccctaaggataagaggggactactctattaatcctttcccaagtaactcatggatcctatattagcaggagctctggtactatagtactatagcatatatgaaaaaactgaatgacttctattatttggagagaaacttattagtaaactctcagaagttgtatttggaaattatgtcttctacatgttaaaagagcttattaaatttagtctgttttggttcctaagattccttagtggtatataattctattaaaatagatcagatttttccagctagtgatccttgaggaaatggttgctcccctcacctgtcagaggagctgagcctggcctggcctagcctgacaaagcgtggccatcagcagctttgggtttaacccagtttaccttacaaatgttatcttgtgtgtatgctacaatgtagaaaagtttggaaaccactgatttgcatatgtaaagaacaagaattctagttggtacaaacatttaaaagatacaatctgctgtttcataaaacagttctccaagtaaccatagaaactatgaagatatttaaaagctcatagatctggttcatcaatataaataaaaatctctaatcataatggcaaagttaggtaaagaaataggtacattctaaaatttggtgtttctgcatgtacctagaaaccaagcctccagttctacggtgaaaacttcataatacctaagaactcagtattcttcatttgaaaatttgacattattaagccaggtgctgtggcttgcacctgtaatcccagctgcttgagaggctgaagtgggaggatgacttgaggccaggagtttgaaaccagccttggcaacataatgagacccccatctcttacaaaataatgtaaaaaaattgtaaaggaaaatttgacagtcttgataatcactttgagatctataatattattgaaatcagatttatcaaaccacataagggcattttatgagttataaattgtatgagttaggatatggcataagcagctataacagaaaaacatagggactaaaggctaaaattgtatttatttcttacaaaagattagataggcattcctggactaggatggtagttcagtggtgatagggaactagtttctctcatgttgctctgcagtctccaacactttgcttcaaattcttagtcagatatggctattccagctcctgctaccacattctccccagtggaaatgaggaaagggcaggcatgtctttttgggtatgatatgatatatattactgtgttcatattgcatcacaggaatttgtctcttgccatacctaccttaaaggagacctgcagcgtagtcttgagtttgtcagctatgtgtaaagttgaaccttgggaattttattactaaagaaagaaagggaggataaaactgagtacagcagcagtctctaccacagactgtatttctgagacatttgggagattctgtgcaatgtaaaagaagtaaaccttgccacagccttacttgaaaagtgttgcaaatcgtaatatcctttctgtgaaacaagttttcttttatttatttattttatttattttatttttttttgagatggagtttcactcttgttgcccaggctggagtgcaatggcgcgatctcggctcaccgcaacctccaccttccaggttcaagtgattctcccgcctcagcctcccaagtagctgggattacaggcatgcaccaacacacccagctaatttttgtatttttagtagagatggggtttcttcatgttggtcaggctgttcttgaactcccgacctcaagtgatccgcccaccttggcctcccaaagtgctgggattacaggcgtgagccactgtgcccagccagttttcttttaaaaaagtattatctagcagaattcaacctccagaatggttatgtgaaggcttcacacactctttacgtagtgaaacaaccctaactggtgaaaattattttaagacaatcacttaaatccccttgaaattgtcctacggatatttagcatatggagaaacatatgaagatctactacatcttagtaagaacaggagtccttggtgattgaaccaagacctgctccattatcttacacaaatgcctctgttatggaagctgtatcacaggtgctccactcctggtaggtgtggccaagagggagacattctctcctcccaactcccagcctggggttatagtttcatgctaagaggcacagtctatgagtgtttttaattctccctgccggccctgtcttgcagaagttctttttttttaatttttttttctctttttttttttgagacggagtctccttctgtcgcccaggctggagtgcagtggcgcagtcttggctcactgcagcctccacctcccgggttcaagcgattcttgtgcctcagcctcccgagtagttggaattacaggtatgagccaccatgcctggctaatttttatatttttagtagagttggagtcccgccatattggccaggttcgtctcaatccaccctgccttggcctcccaaagcgtgagccaccgcacccggccgtgttgcagaagttctattccaagcaggcaggtggagaaaaatctccttttctccacccagcccctacttgcagagctgacatcctttcccacaagtagcaggccaagaacactgggaacccatttgccctggaaaaggtcttggttcaaatgccaagactcttgctgttcttatcttaaataaatgtttcttcttatgctgaatgccctaggataatttccagggactaaatgattgtttttaaaattattttcaccagttaaattgttttgctagggacagtgtttgttgagtttcttactgtatcactccagaagtccatatttattttttaatgttgatgtgtgttaaaacatagtttggagtttgactcttctttcatgtagaattagaaaaaaatattttcactacctattgtttagaattctttcattttacagttgatttttgtttcaaaatattgaaaaaagaaacagttttaggattttgctattttaaaaattggggacgggtggagtggctcacacctgtaatcccagcactttgggaggccgtggcggatgggtcacctgaggtcaggagtttgagaccagcctgggcatcatggtgaaaccccatctctactaaaaatacaaaaattagccgggcatggtggtgggcgcctgtaatcccagctactccagaggctgaggcaggagaatcacttgaacccaggaggtggaggttacagtgagccgagactgtgccactgtactccagcctgggtgacaaagcaagactctgtctcaaaaaaagggaaaaatttaaattagctgtgtgtgttggcatacacttgtcgtcctgactacttgggaggctgaggcaggaggatcacttcagctctagagttcaaggctgcagtgagctatgattgcaccactgcactcctgcactcctgggtgatggagaaagacctttctcaaaaataaatggatgaatgagagcagcattggtatttactctttttttttttttttttgagacagggtctcattctgtcacccaggctgtagtgcagtggcacaatctcagttcattgcaacctccacttattggggtcaagcagccctcccaccttagcctcctgagtagctgggactttaggcacatgccaccatgctcagctaattttttaaaaattttgtagagatgaggtctcactatgttgcccaggctgtctccagctcctggactcaggtgatactccctcctcagcctcccaaagtgctgagattacaggcgtgagccactgcacctagccccaatatttattttttatacgtgaaaatcctatttggacataagttattactacattttgtcattttgaaaaataccttgaatttcagtgattgtgttgatgaatctcggaggaactacttaatgcaagttttgagaattaccaatttaacttttattacaacttctctgctccttacatagcctttcttcatctgagtgcttattatgggtatgaataaatactaagtaaataaatgacttactaaataaatgactgaaactggaaataataatgattctaaaattatataagggtgctcagctgagtaaatgaagcacaaacaattcatttcagcagcagagcaatgtggttaagattgcatattctgaagagagacttggccaagttaattcctgactgtatgacttgggctgagttacttaactctctgtgcttcagtttctcttttgttaagggaacataacagtatgtcctaatttgtgtggtaggaagtgaggaataataaattagtgtatttaactgcttagaacaatttctggtatgtggtaaatattcagtaattgttactactttttattttatacacattaatcactcatgctcttcaatatgaattcagggataattattagtccattttaaagatcaaacaaattccatgtaactttcattcgtttattttaaattaaaacaaattatctgtttttaaataggtagatataaggtttcactgtgttgcccaagctggtcttgaactcctgcaggctatccaacctccactcccacaaagtgctggggttgagctaccgtgcctggccaaaacaaattatcttcaatgttgtaaatatttggaatactgtgccaaactcctgattctgattctgaactataagctacattcgtattccttgagcgtatttattttagcactttctcaacctcgcttttatccaacttatcaaaacaacgtatttcattaacactttaggatgagccatacaaaagtgttacctatgagagagttgctttttgtttcatcggattttctaagcagaattaaagttagaaaaaaaaaaagtatgctgaagcgaatgataggataccataaccaaagaaaaaacttttcctgtaacagtatcatcgtaaaattgatgtccaatatagaaaaaaatgagtggtagatctttatattttatttcacctctaaacttaacatagatacagtttcaatttaattatgagatactcctttgtgtctcctttttccttcagctgctaatagtaaatggatccaggaacatccagaatgtgcctataatcttgtgaattctccacacttaaaacctgcctgggtcttagacagagcactttggcgtttctcctgtgatgttgcagaagggaaatacaaagaaaagggaatacctgctttgattgaaaatgatcaccatatgaatgtcagtatgtacagaggagtatcacactaaaacagaaaaaatttctaaagcacacattaaatatatggttgaaaattacttagaacctgtattttaatatgataaacagtatttgcttaactgattttaaataagtatatgtatatatgtattttttaactattgacatttttcagtccatccgaaaaataatttgggaggatatttttccaaagcttaaactctgggaatttttccaagtagatgtcaacaaagcggttgagcaatttagaagacttcttacacaaggtaaaggatacatactagaatgttcctatcgattttaagaaatgtaatattataaagggaaaactctcttttgggtaacgtcattattaaatatgtcattgtattatatttgtgttattgttgatattataaaactgtgattctgtaagctgagagttagcagaaacatctaaagggcacgtcataataatacataacacaattatttcccctgggtactgtatcttactgttagttccatagaatgctcagaatattgtggaacccagtatatagttgttaaatgtatgaatgggaagtaggttgaacaggttatttcagctgagaaaggcttgaaacaagttttgaaattgagagatgtgatagtctcctgttgtctatagtaagaaccttaactgacgtagaggggctcccagctgattttgcgcactattaaggccacctaaccactagtgatattgaagccagatattgacgagataacaaaaggtaacgaagtgagtcttctattaaggacataactaatcaagcagttaatgtgcccccccccccccaacaaaatagggtaggaaaaaataggtgaaatgagaaagtagggtttgtaggagacaaattagaaaggattattaagagtctatctgcatttcatataggacaacctagcagtgaggatttggggaagatcttaaaatactttttttctcttgcagaaaacagaactagagtaggactcagaaatagtgcctttgaagtagacgtcaatatggcttgagctctaggatactcagtcagcttcatgcatcaacttttgcaattgtgtaacaccttaatacaggaatttttaatattaacttttctccctgtttcattttactaaagggcctctatcttcccttcccccaataacctgtattatttacatgaaataatatgtgctcattgtaaagagaaaaagcccaatagtttaaatgtgtaagaaaatagaatgtatgacctcttctttcccaaaacccacatctcagctactacatattgtttcttgtacttaagactctttgtgaaaaaaaattcaattttatatataattttatataattctatatatggtaagtacataaattttatatttatttttattttttacacatgcaaataagaacataaattgtcaacaacttgttcttttagttgacaatatgaatttattatagctaattatttcttttaacctctgtatagcaatatgctatttttaaagtacttgaatttatttagcctttttgataggttgtttccagttttttcatttttcattcattcattcaatgcatattcattgaaccacctactactgtgtgctagacatgaggattcagtggtaaacagaacaaagtcctttccctggataaacttccagtctcataagctgtactgcagaaaatacatccccgtacaccttatgtttacttgcttatgtgagtcaatctgaaggatacattgttaaacatggaattattgagtcaaagggtatacagatttcaaatataataaatttattttcacagcaagttataccaacttaatattatcactaacattagatatcattaacctttatcatgtttgtcaattaggcaaaacataccttattttaatttacatttctttttttttttttgagactgagtctcactctgtcaccaggctagagtgcagtggtgtgatcttggctcactgcaacctctgcctcccaggttcaagtgattctcctgcctcagcctcccaagtagctgaaactacatgcatgcaccaccacacccagctaatttttgtatttttagtagagacggggtttcaccatgttggccaggatggtctcgatctcttgacctcgtgatctgcctgcctcagcctcccaaagtactgggattacaggcgtgagccaccgcgcccagccttttaagttacatttctttgcttattaatgaagtatatttttacaccttgattagctatttatatttcttccattaattgcctgttaatgtttcttctcatttttctattgagttgtctctttttttatatcgacattattgattattacacaggcctcaaatatatcccctagtatgctcttgatcttttaactcttgtttatggtgacattttttttcaatgtagtcaaacttttcaatctctgatggcttccaatttcatatcatgcttagaaaagaccttccatcaacattctcttttcttctaatttgtatttttacatttgaatatttaatatacctgaaatttatttttgtgtattatataaagaagatatttaacttgatttgtatttttaaaattatattgagttgaaaatccatccttttatactgatttgaagtaccaccataatacttcatagtgtatggtaatatacaaaatatacatctgttatctgtgctcttccactgatccgtctcttttattctatcaatactaaagattattagtttatactgatggcatagctttttctctttttcaaacatttcttggcagtgttcttttttttttttttttttgagacagagtttcactcttgtcgcctaggctaaagtgcagtggtgtaatctccactcaccacaacctccgcttcctgggttcaagcgattctcctgcctcagcctcccgagtagctgggattacaggcatgtgccaccacacccagctaattctgtatttttagtagagatggagtttctcaatgttggtcaggctggtctcgatctcttgacctcaggtgatccacccacctcagcctcccaaaatgctgggattacaggtgcaagccaccatgcccggcggcagttttcatatatttactcttccagatgaaccttagaaactggattttaagaattgatttgtattttatgctgttttgtgaggctaacgtgaataaccactacactatgaaacccattattttgtttttttgttcgtgtttttataagtcatttcaaagtctctttagaataagccagacacaaattaattagttaatataaaatcaagttcaatggaggcaatcctgtaccagttcttaattttattacaaacaagttccagaaaaagagtgaaaatttccccaaaaaccatttatttcctttttaatttttaagttattatctaaggaatatggttgatgaaaagggaaaaaaagtattaaacctgtgtgcttcttttagagaattcaaagaaagtcaggttgttaataagacttcaggaagcaaactttgaaagcaatcttgaaaaagaactcctgaggttagaatatttggtagcaccggggaggaaaacgggttccactaaagtccttaaagtgtttaaaaaaaaaaaaggtacatgtatacatgtataacaaacctgcaagttgtgcacatgtaccctagaacttaaagtataataaaatatatatataaaaaaataaaaaaagaatagaataagtgaatgctgatgtaggcagaaaagtgggggctgagattgaattgataggaatccttgtgtctttcttttatgttatttttgtctctgtttctttctcccccacacccctcgtgtgtgtttgcgcgtgcacgcacgtgcacacacgtgcacacagcaggatgagaaggggaggaggtaggaggatacctgtgaaataaatatttgttttattttcagtgaaaaaattataggccaaaaattagaaaatagtgacagttataatctctttgtagatatttgcatttaaggtatcgtcttttctttcttttagaaaataggcgagtaaccaagtctgatccaaaccaacaccttacgattattcaagatcctgaatacagacggtttggctgtactgtagatatgaacattgcactaacgactttcataccacatgagtatgtaatgtgtttttttctgtgaaataataatattacttacaaacctttatggctagtatgattttcatactacttattaaaaacgcttaatagaaaatgaaataaagtaattcactgtaattctactatttcagcacatgacattttcccactttttctgtgtgtgggccatgtttctatatgtgtatataaacatttttacaattggaaaacatcatcagccataattgaaatcccgatgaatatatttaaggtttctgtgacctttgttagaaagtttttaaatgtagaatctgtaaagccattaaatattatatctgcatttctccatctgctctagcaaggggccagcagcaattgaagaatgctgtaattggtttcataaaagaatggaggaattaaattcagagaagcatcgactcattaactatcatcaggaacaggttttacttatttttgaactgctgcttttccttgcatcttactactatttttttgttgtcttgaggatggtgatgatctaacacaatttaatgtttttcaggcagttaattgccttttgggaaatgtgttttatgaacgactggctggccatggtccaaaactaggacctgtcactagaaagcatcctttagttaccaggtgttgcatttttgttttttttcttattgatggttgaaaactgaaaattgtatttaacttttgaaattaacctaaatgttttctttaacatgtgagttcagtacatttcttaaattgaaatagaagttttgatttggacataggcttaatattaactaattttgttaggcaaatattttgttagagaaactgtcatcagtataaaccaattcatagttattatttaatgtttctggaggactgcatacttagtaataaattcaatattaatcaaattaagcaagcatctggctccttactttgtaagtgacataaagcataggttgggcaactagagtgcagtaaaagcctttgcatatctttacttagagtcttttttaaaaatatctttgcaaagtaacatcaatgcctcaattatgtatttattttttttctttgagatggagtcttgttctgtcacccaggctggagtgcagtggcacgatctcagctcattgcaacctccgcctccagggttcaagcgattctcctgcctcagcctcccaagtagccaggactacagaggtgcaccaccatgcccagctaatttttgtagttttagtagagacggggtttccccatgttggccaggctggtctcaaactcctgacctcaggtaatccccctgcctcggcctccgaaagttctaggattacaggcatgagccaccatgcccagctgcctcaatgattttttaaaataattttatgaagttttaaaaattgtttaaactgttagccagatatgctgtcatgttaactccctatttctcacatcctgctagatttactcaaaaagcctaatgaagatttttgacctatattgaagtttttttcctataaatagcatcaaacttattttattctattcattagaaaagaagtttagttttaatattgcaaatttatattctctccaaggagtttctttgtatggatttaatatttaattatattttcataggtattttactttcccatttgaagagatagacttctccatggaagaatctatgattcatctgccaaataaagcttgttttctgatggcacacaatggatgggtaatgggagatgatcctcttcgaaactttgctgaaccgggtatgtaatttttaacttctctgtggatggggaaagaatagttcatggcaaggtcaaaataaaatctgctttactgattttcttccccattagtctattggtttttaaatatttcaccataaaggtaccagagatacatacaatttgagaaagaaaacatggagccaacaaaaaaagaagttcatcttctgtcctctcctttgccttcctaccttttatcttctcaaacagaataacttttatgtactgttttctatattgtgggtctacataagcttttatttggacaaaatattattgcatttttacagacaagtttgaaaccactgctattacaattacattgacataagagatattttcactcattggccagaggtattaagaatttcagtggcaattaaaccagaacctaatggttttaggtcccccctcactcttagtgtcttgtgtttctatagctatttcattaccaggaagaatgttgcaggagcccattgatatatttattttttaacatttcgaaactaggagtctatattagtgacattaaaatttattcagaaatcttaatgcttttttttaagagtataaatttgggtgtaagtatctctgccctcttttttctagccattctaaacgaaatcaagccattctgctgtatgccatggatctaatacaacctgttgccgaaaataagtaggagggtggagatggagttttaaatgtttttggtagaactatggttttaaaaggcctatgatattaacatttctgttttcccttatgatgcgacttgggtttttgaaattgaggacaaatttttagaagagactgtaagctagagttttttcagaatagctatgagaaataaataattattaattttttaaaacattatctcataccactttagatataatttaaccaatatatcatttatggcagaaatgatcaaagcaatttaaaaaccagtgtttccttgaagtaattgttttcattttatttcttgaaccattgaaagcaatctcttttctgaacaggttcagaagtttacctaaggagagaacttatttgctggggagacagtgttaaattacgctatgggaataaaccagaggactgtccttatctctgggcacacatgaaaaaatacactgaaataactgcaacttatttccagggagtacgtcttgataactgccactcaacacctcttcacgtagctgaggtacagaaaaacaatttatctacattaagaaaagaaattcagtgttccttcctagctttccttaagtaaactatgcaggtaaatgtttccttttgctagttggacacaagcattgatttggtggtagtatttatcactattgcataattagcataattctaacaatcttttgcagttgttatggaatactgggctataaaatatttaactagctaattttaaaattttaatttagggaagttgatcacgtttctgataatatggagtgcaatcatattggctactgtgaatacataaaatgttaatttttgttatttttaggttgctttcaatatattttagaagtgactgtgaaggtgaatagcttattacacattatagtggtgtgtgcctatagtcccagctactcgggcggctgaggcaggagaatcacttgaacccaggaggtggaggttgcagtgagccgagatcacaccactgcactccagcctggcgacagagtgagactctgtctaaaaaataaattaattaattaaattaaataaaaaataaacattaacattatagcatattgaagccagtctagcctcatcgatttaatttttattatttataaaaattataagtgtaaacataaacattgtctatttctctttgagctctttacaataacttctgaacaatgccaatacttatagtattaacttctatctaatacaatctttgtaattaaactcataattttcatcctgcttataagttttttttgttatttttagaaaccctacagtggcactgcttataagatttttgataccttactagtgaccagtgtcacttaggtgttctttggaaatgtgtgcttacctaaaaaatgtctatttctataatattaaagcagtattataatatatatttcaagtcctatgatgaaaaattgatttgatttggagggatttagtgaatattagttaagctggtagaacattgtttagttccaaaaaatgacggctttattttattgtgcttttagcaatagcaaaaagaaatatgcttctaagattgttacatggcagaaaagaatgttcaaacttaatttacttaattttaaattacaaaatctaggattctacttgttagctaatagagtttcaagtattttattaatctttgtgcaaatgttgtgtttaacagtttggaaccaatctgattttttattataaaccagtgtttataataaacagctagatagatagcaccagtgttaaacgtaaatcacacaagtggaaattgtaaggtgtaagagtttttaagagttatttatcatcatctgtaggagaaactggcttcagtctggtcagacaaatctaatctttccaacagctaagtaattcaccagcagggaatttatgaataattatttagtcaaccacctggaaattaagtctgattaaagttttaaaaataagcaagcaggcccaggcacggtggctcacgcctgtaatcccaacacttttaggctcaggcaggcagatcagctgaggttgggagtttgcaaccagcctgaccaacatggagaaaccccatctctactaaaaatacaaaattagctgggtgtggtggtgcgtgcctgtaatcccagctactcgggaggctgaggctggagaatttcttgaacctgggaggcggaggttgtggtgagctcacatcatgtcattgcactccagcctgggcaacaagagcgaaacttggtctcaataaataaataaataaataaataagcaaacaaaaaacagggagaaaacctaacagaattgtagtgttatgatttacatttagtaatatgaaactaacatttttcttcttcttttcctctctcatgtctcaatatctttgcaaaatctaatcttcctttttaaccgttttcttctcttgataaattctcttgtttctatgtgttttggtatgtttgatatcttgctgcatatttttctatgtcaaatcatgcctccttttgtctctttccttcctcctatcttgcttttctctttctgttacatttatttgttacatttgtcactgtgctttttacagtacatgttggatgctgctaggaatttgcaacccaatttatatgtagtagctgaactgttcacaggaagtgaagatctggacaatgtctttgttactagactgggcattagttccttaataagaggtaggcttgttggagtgtatttccctctaaaactttagcttttgtttaagtagattaaaggatttaatagcttcatatgcaatgcttaataattttttaacacagttaatgttcttctaaatactttgtatgacatattctaatataactcagtctatttttatcagtataaatttctactttggggtaagatacctcatttcaaattgaaagaccagtaggatgaactgaagactcactaacaaaaccattttttgttgttgaaaatatgcaaacctgtttttcatcttctactgggagatatgatgtaatgtttagatgttttataatcaattttgtatagcttacatcccagtaaacaacatatgttcccttttccttacatgagccatttctccagttaagttatggggaaaacttttttgtcacttaaactagtagacatttgtttaaatccttaaagcagttttattttttataatattgatgtggtctttattttgaaaatcatttatgagaagaaatctaacctcttcctggacataaataatgaagattgttaaaatattctgtaatgctctgcagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtggtaagcacctaatctttttcatgtacttattttgctaaatgctttgatatttaactctctgacacttggtcacaatcatacccatatacttcaaaatagtgtcttagatttataactgatttataatacatagttttcagaatgttttacttgtttaaaagcaaattaatttaccttatgaatttatttatgtaattatccttttacttcattatgctatagaatagcactttgcatttgaaagaaagcaaacttttgctttgttgttgttgtcttctagcatagatcagcgtatgatgctcttccaagtactacaattgtttctatggcatgttgtgctagtggaagtacaagaggctatgatgaattagtgcctcatcaggtttgtttatatgttgtttcttaaaacctacatggccaacaactttgggcatttttattaaaaaaaattcattgtaattaagatgtatccatgctaaattttacctttgtccagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggcaagaaataattaaatttgtttcttcaggttcaatttcagagtaagtctttccagtttgagagctaatctagttgttctttctgcttctcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggtaatgcaatctaaaaattgttactgtatttgtattatattattatattaaattatactgtaatgttatggttatatatcatgtatatatcatatatattataacacagtgctactgtggacgtacttgagaaaaagaatttaaactttttggtaacttggccaggtatgatggctcacaccagtaatcccaacacctcaggaggctgaggcaggcagatcacttgagctcaggagttcaagaccagtctcagcattatggtaacaccctgtctctatcaaaaaaaaagtacaaaaaattagatgggcatggtggcacatgcctgtagtcttggctactcctgaagctgaggtgggaggatcgcttgagcccagcaggcagtggttacactgagtccagatcccaccactgcactctactgggtgatagagtgagaccctatctcaaaaaaaaaaaaaaaaaaagaaagaaatttttggcaacttatatttttactgcatggaacaaaacctagacagaaatactttcaaatgttaacattttttgagttgtgaaatatttttgtttatattttatttcctaatttgtgtaaaatgaacatttatttctcttctagcagaacaatatgtatatttgtgttagtgtatatgtatatatgtgtataaatgtctttgtgtgtatatatgcacaaacatacatacaaacatgcgaactaaaatggaaaataatataaccttatgtttaaggcttttcataatccattctcatccaccatcctagccctatgtcagtccactatttcagccaaatagatatttttacttctccccaaatactatgcgaattgtctggatctttcaaggtctaaagttgcacctcctttgttcagtgattcttctgaacatgtagcaattatagtctctatgtattcctctagcatagagagtcaaaaattataaaatacatccctgagatatgtccttaatattacttgatttttttctggataggtgtattttattgtcttacttactattatatgtggcatattacagcatagcatgctcctgttcatgcagcagctggcaaagtttgttgattgattgaccaaatgaaaattcctataaaaatcatcatattctatattggttgctagttgctgaatatgcatagttccggtttttaaaaattatcaacctgaatacctaaaagtttctttaattgttcacaaatgtatattcactatccttatctgatctttgctaatatacgtattcagttttataggacaacaatcactgtgtacaatattatctcaggttttgttttggtcacagatcattcttaaaacatttccacttcagtccgcaaaattgtgatttttattttgttaaatgttcgtacgttctgttattatgcccttttaaatattctatagtatgtttagtagtgttactaagtgttaaatatacagtaaggataattgttttttcttttaaacaattttcttagtgtatatttacagaggtagaatttctagatcaaaaggttctgttacctgttgccagattaatgacttaaagcttaagttatttaaagtaaggttgaaattttatataatccattgaccctgcagttctatccctaggtatatatctgggaaactttcatatatttccatttgaagatatgcacaagaatatttattacaacattatttataatagagaaaaattagagacaaccttaatagaacagatatattttggtatattcatacagtagaatattatttggcatttgaagtaaatgtgctgtagctgatgcagcagtgtgaatgaatctaaaaaatacattgttgaccactaaaaagcaagttgcaaatatatataacttcaattcattttaataaaacttggaaatagggaaaataatatatgttgtttaaggaaacaggcatgtgtagtgaaaatgccaggggtagtgagcaccaaactgaattgaggttacctctgaaagtgaagaatgggtacacagaggctttattgtatttgtaaagtttaagtgaggaagtagaacttgggtttttaatttttttttgtatccgaaatattccaagttttaaaaaaatgtaagcctttcaagtgatttgcttttctctgctcaaaattaggaagttgttccctagagctaagctattattttgatacgtttctacttcaaaaaaagctttgttaactaagctgtaattttttttacaaatgtgaaaatacaccttgggtagaatcatctactttcagacttctaaaaaaaagtaactgataatttgttttcaactttaagttaaatgatttgaaaccactttagccttcctaattttggatgattccatatgaaattttgttaaaatgtttttatgtattcctaggcaaaattgaagaagtagttcttgaagctagaactattgagagaaacacgaaaccttataggaaggatgagaattcaatcaatggaacaccagatatcacagtagaaattagagaacatattcaggtatttgggactctcatcttactactgtgtttagcattttaagaacattagaactatttgttgaatggatttttttaatgtactttttttcaagcttaatgaaagtaaaattgttaaacaagctggagttgccacaaaagggcccaatgaatatattcaagaaatagaatttgaaaacttgtctccaggaagtgttattatattcaggtatgttaattgagctcaaactgttgactttacttatatttaaaatagtttgcatatcctgttaaatttgaataaattactcctaaaaattaaccactttttaattaacattttcagagttagtcttgatccacatgcacaagtcgctgttggaattcttcgaaatcatctgacacaattcagtcctcactttaaatctggcagcctagctgttgacaatgcagatcctatattaaaaattccttttgcttcgtaagtatgccttgtttggtagagatttgccaccttaataagtaagttaccactagactgaattaagcagttttaagggtcctctatatccttgctactcaaagtacggtccaaggaccagcagtgtcagcatcacctgttgttaacattttaccctattgttttataatttgtgtgtgtacctgcatgtgtattctctctatagatatagatacacacatgcctacatgcatacataacacatgcatgcatctctgtatacacacacacacaatttctctgaagtatttgagactaagttgcatacctcataccctttaccacatcattttttaaaaatgtcaacatattattctactttatggctttaccataatttatttaaacaatttccatttttggacatctagattgcttctaattgttccctattatttatgtctttgtacattcatctttacatgaatccttagttattccctttctagatgtttctgcatactacagaagaatataggttttgaggtttagacctaggtttaactttagcttcattactgtcagtatgatcttggatctattgtttagaactttcatcatctcagtctcccatctggaaaattttgtaagaattaaataggataacacttataaaacacttaatacaatgcctggcacatagtaaatgctcatagtttgccatcattagtactagtataaatattttcagaaatggaagttttgggttagacgaggggtccccaacctctgggccacagactggtactggtccatggcctgttaggaaccaggccgcacagcaggaggtgagtggcaggtgagctttatctgtatttacagctgcaccccatcactcgcattaccacctgaactctgcctcctgtcagatcagtggctgcattagattctcatagggacgtgaaccctattgtgaactgtccctgcgagggatttagattgcatgctgcctatgagaatctaatgcctgatgatctgccactgtttgccatcacccccatatgggactgtctagttgcaggaaaacaagcttaggggtcccactgattccacattatggtgagttgtataattatttcagtatatattacaatgtaataatagtagaaataaagtacacaataaatgtaatgcacttgaatcatcccaaaaccacgcccctcacccccagtctgtgaaaaaatgtcttctgtgaaaccagtccctggtgccaaaaaggaccattgggttagactatatccatatatttgaggctgttaatacatactgccaaattttctccagaaagattataataattaatactttcagctctatccaagagtttccatcattagcaatactgagtatatattattataacgtagtgtttaagggcatggagtatagaaccagactaactggatttgaattccattgcagactcttattagctataagaagtaagacctggctgagtgcagtggctcactcctataatctcagcactttggtaggccaaggtgggaggattgcttgagcccaggagtccaagaccagcctgggcaacatagtgagaccctatctctacaaaacgttttaaaaaaattagctggaagttgtggcatgcacctgtggtcacagctgttcaggaagctgaggtaacagcatcagcatcagttgagcccaggaggtctaggctgcaatgagccatgattgtgccactgctctccagcctgggcaacagagcaagaccctgtctctagaaaaaaaaaaagagatctttgagaatttataatagacataattatagcacctttcttacagattacttgagtaaaacacaatagtttttgacacatagtgattgataagtgttagctgttactaatcaaactggtaaatataaaatagttaaaaataacatctcatgtaatttaaatattaagctaaattattttgttcattggccatttgtatttatttgttgaagtgttgttttatgtattaccccattttgctattgtgttcggctttctttgttgttttgtaagactttttattgttaaggatattaactcctaattcaaactattcttaataaagtagttgcattcttaaccaaaaaatctgtgatgaagcagctttgtgtttggatggactgcttgtaaaatgcatgttcctcctcagacctgctcagattattttggagcaaggccaagaaatttgcagttttataagatccccaggtaatttttaggcaaggagtccactggctattgaaaaatattgtcctagaatggagttgatactgagacttctgagtgatttgactcaggcttgactcacaaactagctctggggagggaggctgatatggagagaacaaagcacagatgacaatgattttctaaattgagccagaactaaatgggaaagaaagatacacattcaagaggatatgtgttcacataaaatagcagtcatgtaaaatgaaattacctgagcatctattatagaagcacaagaaaatacagtttcagctgtattcaggtgtggtcagttatacagtcttactgctaaccaaacaaagggaaatcaaggccatgatagtcttccctctgacagttatcaggaggcatcttaatctgagaaaaatcctggtttcttgaataaacaagctgaggggcagtgcaaccttagagaagagaaaggaagggacttggagagaaatatgaaggtagagagcatgtgatttcctaggcaattaactttgactttttattcctttagtcatcctctgataagtatttttagtatacaataactagcataaaaagttcttgatgtctcacttaggggaatataaaggagagaaatcagatgagaacacataaataaatgaaggaaggaaggaaaacactaagtccaaactagaaaggttaaaaaaacagatttataagataaaggatatagaagccaaaatattttcccagcatacttctaatcaatacaatttggtacttgattatttgcttggtttgggagtaatgtcgcttctaattgaattttttttcacaatttgtcctttaataattacttaaaatgtatgagtataatgtttatttgaatgctgagttcctaaaacatacactgctaagacattttatgattgtaattcagattttcttcttttgtttctattgacaacaagcgaaacttcaatatatggttatctttattttccaattcttagtcttgcctccagattaactttggctgagctaaatcagatcctttaccgatgtgaatcagaagaaaaggaagatggtggagggtgctatgacataccaaactggtcagcccttaaatatgcaggtcttcaaggtaagcaaatggaaggatagctgagctttgtgtttttcttttagggtcatctggtgtcttctttacagacatagatataggctcagagtatgcctacttgggttgcaattatggctctgcttctgctcattaattgacctttggcaagtaatataacctctttgtgtgccaatttctgcttctataaaatttgaataatattatctaatttagaaggtttttgtgaggattaatgagatcattcacataaaacactgaaaacaggatgtaacacaaagtaattacccagtaaattttacctagaaatactagttctatctctttccttaaggtctgtatagctctttatgtatacttggaccttgattaatgtttcttgacctggtttattatataataaacagaatattcttgtttgggccccaagtgggattaggttgtaaatataatccattcacctttttttaaatctaattggaaatatattttattgcatatttgttttatcctgtaaagagaacttacagtaaaacatacagtagttgtaagatgagttaaaggaattaagtatttatcagttttattcatctagttggtaatatttacttagatgtttaagaaatttgctttatcacacctgtattcctggttcatatagttttcacttatgccttttgttcaactctttatttctttctccatctaacctatctttaaggactaatttaattcttgcatctttcataaaaccttctttaactattgctttttacagtaatttctttgtcctccagacaccattgcatttattttctatacctcttacttggcccttgaaatatattgccttattttgatagttagtataatgatttttgtgaatctttatcattgtgattaagaaacaggctttaaaaccagatttcctgggttacattgactagttttataacctgaagtaaatgctctatggcttacttttcccctgcaaaatggtacctaccacagggattatggttaggattaatgaattaatacatgtgaacagctcattagacgacacctaattcatactaagtaattggaaattgttagccttaaaaccacactaagtaggctgcacactttcagaaagaagaattaagttttatcttttttatgcttcttgtcttttagcttttatactttctgcaaaaccaagcacgtaagcggttctcaataaacttttttgagactttttggatttatgatctttttttctaaaatattctcatttttaatacaaaatgttttgtgctatgagtaagaaagaagtgtatgtgagccagacatggtggcttccacctgtaatctcatgctttgggaggccacagcaggaggatcacttgagcccaagagaggtttgaggctgcagtgaactatgatcatgccaatgccctccagcctgggtgacagagtgagactgtctcaaaaaataaataaatttatttatttaattaatttttaaaagatgtatgtatgttatcagatttgagtaattatctacttcattttcactctgagttgttaaactacttctagttcactacaaagaccaaacttgtgtgtgctctttttctagcctttgtctttcttatagttaagtttggttctttgctaattctccttatctttctaatgaaatgattcttcttatcttttctaaatagaattgcctttacctgtttattttttgctgctttataccaatcccttttccctctgattgtttaatattttcagcaggccacatatttccagcaggctgctaataagagcctcagattaaatcagatttaactactttgttgacctgtctttcccttaaacaaaatgtatttccctccttataatacggtatatctagtcatgttggaatccaggaatccattttggatctgctcctttcatcctcagtatccaatcagtcattatgatttgtggattcttttccatgttctgttgggtacaccatatcctttttattaccacagttttcactctattctaggactaagtcctatatacaaaaccaactaaccaattttccaaatcttgttacctcatctacaaatcattccattccgttggtcatcatcagatctgtttctaaaacactgttttccttatgtccttccattattcaacagtgagaccaacatttaccgagcattatctgctgtccatgaaaatgccagggcatatgtagaatattattttatagtcttgtttcccaacatctttatgttttaagctttcttccccagagaagattgtgagccccttgagggaaagaactttatcttaaatttatatagtttttagtttctcaaaacatgctacatacctagtaaaattcatgcaattctaaatagataaataaatttagtctaaatgaagtcagtgatgccaatataatttttaaggtagcatcattgaaataataaaatctgggaaattctaatgcttctaattgaagactagaaggattaagaaaaaaaaaatatatatatatatacctcattttgatacttcacttagttctaagtacctcctgttaaattttaacaattccttccaaagcatgctttattcttattatctccataggtgttcttgctctttctgaaaccagttctatgacttccttaaatctagcctgaatactgatgaacccactacttttcaacatgaaaaaatacaggcttattacttttctttcttgagatgcttttgggcagggaagccatgccagttacccttgaatattataacattaaaatccaaaagaataagaccagtcccagaagttatgaatcctgaaaagctctttatatctcttgtgacagtagtccccttcagtatgcctttgtaacttggctcaagccagtattgtcatacttatctccaactgtattaagcagtgttgtggactgggtagcccttgtgtgtgcctctaatacgtattcaccccaaatcactagaatagagactagcagaatagggactagaggatataggaacaaattgatgctaccaataatacagcatgacatgtctctgaattttcaggtttaatgtctgtattggcagaaataagaccaaagaatgacttggggcatcctttttgtaataatttgagatctggagattggatgattgactatgtcagtaaccggcttatttcacgatcaggaactattgctgaagtaagtagagctatattatcgtcccaaaaaatcaaggacataataataaatattaccatgttatatataatatttacattgttttctaacctgaaccattttcctccttccttcatcatctttcagttataataaatggaaatcgggtttatagattactagataaagttgcacatttagatttacctctaaaaacacacctagtctgtacacataccaaattaactttcaaatttattttaattacaggttggtaaatggttgcaggctatgttcttctacctgaagcagatcccacgttaccttatcccatgttactttgatgctatattaattggtgcatataccactcttctggatacagcatggaagcagatgtcaaggtatatccaacaaagcttgaataaatgggcatatctgtgttgaaactatatacagagtcacttcatacatgttcttaaaaaaccaaaccataaagaattgtcatagaactgaaaaggcttgtaggtggatagtaaatttattagcatcctttagtctgtgtagcatacaaaaacaaacttgaatattataaaatctgttctaaaagctaataaaacatattgataagaatattgttttatattgtttctatgtattcactgacttattgagttaattgataaagtttctgaaatctacatgtacaatttttctaatttttcatcaattaggagaaaaaattccactattactatgaatgaaatttgcctttaatgatgaatttccctaaaatgaaaccacaaatttaagtgtactcgtgagagccaccaaattgattaggacataatttcacaagaacaaactttcatttctaccatttgttttacaaccatctgtggactgtaagccagctaaaataatgggtgaaatgaaagcagttttgaaatctaaccaaagttttaaaaatgttaagtaatattactattgttatagatttgtatagaaaaatcatttgaaggaaagaaaccaagtaaaataaaactgctaaaaattgtatttctacaagtaataaattcaatcacttttgttacagctttgttcagaatggttcaacctttgtgaaacacctttcattgggttcagttcaactgtgtggagtaggaaaattcccttccctgccaattctttcacctgccctaatggatgtaccttataggttaaatgagatcacaaaagaaaaggagcaatgttgtgtttctctagctgcaggtaaggaattatgtacaaggttaaaatatgtaaatcgatagtattcgcggaagaaaagttataggaaaatgattattttttaaaagcttgtaatgctactcaagattttattttaccacttagtacatttcatagatattcactcataaaaataataaccatgcttactgtttaattataactgtgcaccaggcatttatgtgtgttttttatggctagctgattcttcatgtttctattttttccaactcttgacattctgtgtttttttaaatcaaatttattttgctattctcttttctatattttcccccaattttaaaaaataaacccaatcttgtaattatcaagaggtcatgtaagggtccctataaattataaaacaaaacagatgttaaataattttcatcatgtgtctaattggaatcaaatgctttcaacatttgaataaatatcctttattccaactagatttaaaacctgaatcaagtaacaaattcaagtaagcaaaataggctaaaggacaggcttttgttttctttttaatacatttcaagcatatttctagaaagtacttagtatttgaggtgactgaagtttagaactttccaaactaaactgaaaaatatcaagttacaggaagaaagaaatagtattatctgtgtaattccctcttttacccttaaatttgcagctacttagaccagataaaaagacttagtgatacccaacaactaaaatgaaaattacctttccattaaaaatgttcatgaaacattcataaaacgttgtttaagttctataattgtgtttttagattttcatttgactgtttgatctcctggtacccgttgttccctcatgaatccatgcagatgctcatgaaactgaccttagccataggggcaaaggaaacattgatgtaaataacttggttttaaagcctactttttagaacccattacaaaaaatagtaatttcaacctttttgattgtgtactgctgttgttaaacatcttcaaaatatacactttaaacgatatactgatataaactgttacatctgacatacttctcaggtacgatataaaacaaataaaaactaaaaaattaagttgataaacaaatacaaatagaagtgtgatatttgctcctagcatcccaagggaatgttttgcctattccatacttgtaaaaaataggactgtattcagatttgcagataggttttttggggttcattttaaactgattggggatgtcttcctttggttatagtattgcaacaacagcaattaaaaacaatggttcatacctgtaatcccaacactttggaaggctgaggcaggaggatcgtttggggcagggagttcaagaccagcctgaacaacatagcaagaccccatctttaccaaaaaaaaaaattaaaaattagccaggcatggtggtatgtacctgtagtcctagctactcaggaggctggggcaggaggatcccttgagccaaggagtttgaggctgcagtgagctatgatcacaccactgcactgcagcctgggtgacagaggagaccctgtctcaaaaaaaaaaaaaaatttgtagcctgttctaataattgacaaattagaaatcacttagaagatatggaatctattagttgtgtactcttagaggtcaaaaagttaatacaaacatttccatacatagtgctagagattttatagttttgactttttcacaaagacagaccgcatatatttttggatataccgattcagactcacctttgaatctacctgtattcatgtttcatacaaggaattaaatgggtcagagtaccaggaagtgtgtatggcacagagtgctatatatatgttagctgctgtcatcactatcatcaaaattaatatcatgtatatatcaaccatatataaaccatattaatcataaataaataatacacagtgtatttggggaaattttgtaccgtcattttggagacaacataggtaggaaaaaggtctaattcttatctttcttaatggaagaaactaacatctaattcccaataaacagaaacttaaattgtgaagtacactcaggaattgccaaaactttcttttatcttagtcaaattctttcacttttcgatctacattttaatatttgttttttatttcagtcatcaaatatttataggtatatattatatacagttacaattttcaatgaatacatacttgttggtgaacaaggtagatgaggtttctactcataggtcttatttcctactgggaagatatatgcattcaacagatagcaaacaagataattttcagatagcgttaagtgcttttaagatagttataagtgaatgctgtgtatattttatttgtcctcagtttcccctaaccaaaatatgtgttatatttatgctttggcataattttttttcttttgagacagagtttcgctctttttgcccaggctggagtacaatagcgtgatctcggctcactgcaacctccgcttcctgggttcaagcaattctcctgcctcagccacccaagcagctgggattacaggcacccactaccacgcctggctaattttttgtatttttagtggagatggggtttcaccatgttggccaggatggtctcgaattcctgaccttactgttttataagaaaccaaactcaatctttaagtaaaattttagattgcaccattaatcatactattttatcttgtatataaaacctccaattacctagaatgaaggatttaatgtgccagataacttgaagtgacaagtaaaattgtacatattgtgtacagaatataacacttttaagttgttttaaattagtgggaaatttgataatgttgactcaagtgctcaaatgttgactccatatacttaattaggtatcattaaggtaataatttcatgtttaggtttatttattgtccttaagttcaaggtagagtctttttaaatatataattaatatttagtgtttatgtgttaaatatttgatctctgattttactctttagatttaatttataaaagaaagtttggccaggtacagtggctcctgcctgtaatcctagcactttgggaaagcaagttgggcagatcacttgagctcaggagttcaagaccagcctaggcaacctggcaaaacctcattctctacaaaaaatacaaaaactagccaggcatggtggtgtctacctgtagtctcagctacttgggaggctgaggtgggaggatggcttgagcctgggaggtggaggttacagtgacgcaagactgtgccactgcactccagcctggacaacagagccagaccctctctcagaaagaagaaaagtttatctgtgtattcacacctcaatttagataagtatctctctatagctctggttcttaatcttctttaggtcataggttcctttaggaatctgacaagataatggaatctcatttgacagaagttaacataagtatagacatacattttgcaaataattttagagggttttagaggatttgcaggtgcctgccttgtaccccaggtttagagtaactgttctatagtaatggagttcataggtttgtgtgtattattatgattaacatattactttgttgtgttttttttgttaggcttacctcatttttcttctggtattttccgctgctggggaagggatacttttattgcacttagaggtatactgctgattactggacgctatgtagaagccaggtaggagagcctctaaagtgttgtactgcgagtttatgtctgaatgtcttttacatgctcttcaaactttccttcttgtccatcttttcttaacatttgggagctgtattttctttaggtagtttttattttatttttgtatgttcacttaataggatcataaaatttcaaaggggtgaaaatctttgaagtcactaagttctagtccttcatattacaagtcaggttatctttagcattagctaatttatttcaacaaaactaaaaatgttataacctttttatgccttccatagtgaaggcattgctagttctttgtctgagtcttgtagaagtcttgatgtttccctctatttgttgtcaagccttgtaacctccagttttatgttttctagacttaaaatggttttttttgtttttgttttttgttttttgtttttgagacagagtctcgcactgtcgtccgggctggagtgcagcggcacagtctcggctcactgcaacctccgactccgcctcccgggttgaagccattctgctgcctcagcctcctgagtagctgagattacaggcgcccgccaccacgcccagctaatttttgtatttctagtagagacggggtttcaccgtgttggtcaggctggtcttgaactcccgaccttgtgatttgcctgcctcggcctcccgaagtgctgggattacaggcgtgagccaccgtgcccggccgtaaaatggtattttttttaatgtcacaataatatgaatgaacttattggaggtcgaaaggaaagcactacagcagtgccactcaaaatgcattccacacatcagtagtgtcaccctcacctgagagcttgttagaaatgcagattcttggaccctatgccaaacctcccaaatccaaacctggacatagagagagtagggttggtgggcagaaatctgtgttttcacaaggtctctggatgattatcaacagtctaaggctgaagtttgaaagcactgctctaaaagataaaactttcagcaaaagggcatttatacgataccttgttttgatgccatcaggaaaataactgaagtttgcatctttacatgccaaaattttatttttgatacttttaaaactgaagtttttaggtgggcatctgaaatgaattgcatttttgttaatccgatatatagtaagacctttttgtattaccattatggagctatagaaatttaggaagctgtttgcttcttccctaaatgctcctgaattactgatttagaagaaggaaatggaacatcagcattcagcatagtatagtggttaagaacttcggctttacaccagactgccagcttctaatcctggttccaaactaccaactgacaaattaccttactgggtacttgggaggatcaaatgaacacatacagttaaggtgcctagagtaatatctgccacatgcctagagtaatatctgccacatgctaaacagttcataaatgttagtttttatcattattaatgtttaggctcccaattatcacctctatgcaatatcacaaatttgtgctgcttaattttacatagaactgtctagattattggttagcaaactgtggcctatcacctgttttgtatggcctatgagcaaagaatagcttttacctttttttttttttttgagacggagtcttgctctgtcactcaggctggagtgcagtggcgcaatctccgctcactgcaagctccgcctcccgggttcatgccattcttctgcctcagcctcctgagtagctgggactacaggcgcccgccaccacacccggctaattttttgtatttttagtagagaccgggtttcaccatgttagccaggatggtctcgatatcctgaccttatgatccgcctgcctcatcctcccaaagtgctgggattacaggcgtgagccactgcgccctaccagaatagcttttacctttttctttttaaagggtcatttaaaagaagaaagcatgtgcaacagaattcatatatgtcccacaaagcctaaaatacttagtatatggccctttatagaaaaggtttgcctaccccgatctagaggtgattcccagagaataatatattatcccagagggtatttgttagggtagtgctagctgccataaattataaacacttaaaatcttaatggcttttcacaaataaaatttatttcttgcttgtagtcgtagacgcatgctcagtaagcagccttctatatactgattcagggaagcaggtttcttccagcttgaggatctgtcagtttccatggcttctggggcctctccaggaggcaagcagagagggaaagagagctgggggaacacacctattctccatacacttaacatgcatcagttctggccacaaccaactgtaagattggttgtgaattgtaggaaattcgttttagtggacatatacctctaccacagatggttctacttcctccctctatagaggtaatcatgaatcagaagtcgttttattaaaatgtacaagattgttccagatggttaagattgctagcactatggccaggcatggtggctcacaactgtaatcagcactttgggagcctgaggcgggcagattgcttgagtccacaagttcaagaccagcctgggcaacagggtctcttaaaaaaacaaatatatatgtatatatagagagagctagtattctgaccttttcttaattgaaagtgtcactgtctatactaatatttttatactttgtaaataaaaagtttcccattgcattactgttgaaaagatgggcattaagcttagacatagaattaataaaaatttctgagtggtttagccaaaaagcagtaagacctagacattttaaataacatttccaaggccacacagatggcaaagctaggatttagacttcagccttcttatttcttaatttcatgctgtttctagagtgcctttctgtcttacaaacaaaattttcatttggtatataatagtaaaataatgctttaaaaaattaactgtcttcaaccagtttttaaactggttgaattatgtttttcaaggtcagcttctaccagtttgttttctttctctctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccctggttcacgccgttctcctgcctcagcctcctgagtagctgggattacaggtgcctgccactacgcccggctaattttttgtgtttttagtagagacggggtttcaccgtgttagtcaggatggtctcgatctcctgacctcgtgatctacccgcctcagcctcccaaagtgctaggattacaggcctgagccaccacgcccggccttctttcttttctttcttctttttttttttgatagagtcttgctctgttgcccagactggagtacactggcacaatctcagctcactgcaacctctgcctcctgggttcaggcaattctcttgcctaagccttctgagtagctgggactacaggcacgcaccaccattcctggcttatttttgtatttttagtagagacagcgtttcaccatgttgaccaggctggtctcaaactcctgacctcaggtgttccgcccgcctcggcctcccaaaatgctgagattacaggtgtgagccactatgcccagccagtttgttttcctatatgtttgttttactcttggtttctgctatttaaaataattaagttcttgtttaatagttacttcgattttgaaataccatagacttcaaaagtagaatctggagctatgagggaccttaaaaatcacccagtccaatctcaaatgaaaaaactgtatcagagagggagtcacacagattgttagcataaaattctagtctagaatcaaggttcctgactttaattcagtacttactctatcatactatgactactttctacatgaaaatataaagaaatagggcaagagagaaaacgcattcaaaatatagtcaccaaaagtgactggtttttgtcttcaatttttaagtgtttgttttcatttctgatccacttaattctgttgttttaggaatattattttagcatttgcgggtaccctgaggcatggtctcattcctaatctactgggtgaaggaatttatgccagatacaattgtcgggatgctgtgtggtggtggctgcagtgtatccaggattactgtaaaatggttccaaatggtctagacattctcaagtgcccagtttccagaatgtatcctacagatgattctgctcctttgcctgctggcacactggtaaagatatttcttaaaatgtttttttgtttttttttttttttctgaaaaatgacttttagtttctaatgtaaaaataagggtaattaagaatccaaatcttacgaattattcaaatgtcagtattgatttggcacctgctggtactataagtgattggtctttgcctgaagaactttgcaacatggtagaagagatgatgatgtgtacataaatatggccattgcaatagattgtagaggaagtgttgtgtagtctcttaaaagagagagaaggtccagtaggtaggtctcagggagaacgttagaaagtagctaaagtttcacctaaatgagccataaaaggtgagtaggactttcggagagatggagaaagttgttgggagacattagagttgaaaagaagccaggtgtatggcacacacctgtaatctcagcttctcaggaggctgaggcagaaggatcacttgaggccaggagtatgagtccagcctaggcaacatagcaaaactcagtctctttaaaaaaaaaaaaaaaaaaaaaaagaggaaaggaataatagggttgcatagtggattgaagcacagtttaggggacatagtacttaatagtgtttttgtaagagcctaggctcttataaaatacgttttgtgaaaaagtcaatatggtttggctttttgtgtaggatacctgcagggtagtaagagattatggaaagggtgagccaggttatggagagccttgactaccaatccagggagcttaaagattatcttatgaacagtgaagaatggatagacatttttgagtgtttttttttccctaatcaagaatggacaataatactatacttttgccacttctgatctgcctttatgttaatagtttgttatatatgattgggggggctgggaggggatagtagctttgtaagctactccagggttagcatatatttgtgttctcatgatatttatttatatcatgaagtactcaacatttgtccaaaatttttttatttgtcctctgttatcaactgacatttctgttacaatgaatataggttcatgctatcaggcaggtaattattttacacataactttgttttctcacagtttatccaaaaatattcacagcattataatttttataattaatagtagaatttttatattatagagttttggttatattcagagtctttaaaatgaaacataataaacatgtaaggactctaaacattttgcttctatttaacattctttaccttatttttaaaaatataattgtatattttcccaaatgtcatcctgagtatcacatttattatttatatgggtaaagaaaatgacttatgaattctttacattcactggggtattttccaaagtcattatggatcctcaaatttgagagtttccctttagctcataatttacccccattacctgtgtatgcagatgagtaaaaatagcaatgccaatttaaaattcagatgctggataacaagctaggttcgtttattagctgaagagatcactctgatagaaactgtagaagctcactagatttgtttttgtgtatcagcagattattttatgtcacagacatgaatagtcaaaactactgatgttaaatatttgtatgctcgtctgtattatttggtatataggagctgcttcttccctggcctcaccccaattcctatttctcacttcaaaggaaagtatatattttcacattacttcagttgtcggatttgggggaaaataagaaaaatgtaatttctaacagaggtaacacccattatgtctcaaacaggatcagccattgtttgaagtcatacaggaagcaatgcaaaaacacatgcagggcatacagttccgagaaaggaatgctggtccccagatagatcgaaacatgaaggacgaaggtacagaactttaactaaaatagtacaaatttatcaaggtgatgaaattaaaccttgcaattgttcacttagtaaatatttgtgtgccaaacctcacgatataatgattaaaaagattaacatagttcctgatctcaccaagtttttagtttctagcagaaaaataaaattttatatcttttgtcagccagtttgaaagataattttggtggtttcatttataactataataatcgccatgaactgcatgcttactattgctaggcattgtggtaactactttacctatattattaccatttaacactccccaaaacattgagaatgagtgatattgtttccattttttttaattattatactttaaattctagggtacaggtgcacaacgtgcaggtttgttacatatgtatacatgtgccatgttggtgtgctgcacccattaactcatcatttacataggtatatctcctaatgctatccctcccccatccccccactccacaacaggccccagtatgtgatattccccttcccgtgtccaagtattctcattgttcagttcccatctatgagtgagaacatgcggtgtctggatttttgtccttgcgatagtttgctgagaatgatggtttccagcttcatccatgtccctacaaaggacatgaactcatccttttttatggctgcatagtattccatggtgtatatgtgacacattttcttaatccagtctatcattgatggacatttgggttggttccaagtctttgctattgtgaatactgctgcaatgaacatacgtgtgcatgtgtctttatagcagcatgatttataatcctttgggtatatacccagtaatgggattgctgggtcaaatggtatttctagttctagatccctgaggaatcgccacactgacttccacaatggttgaactagttaacagtccccccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcatagatgtctttgcccactttttgatggggttgtttgtttttttcttgtaaatttgcttgagttctttgtagattctggataactgaagcagagtagcttgcccagagtcacatagctactaagtggtagaggtagactttactcatggtctatcttgagagcctaggcacttacaaaatactttttgtagaaaggtttatttgtatatggtattaaaataaatgtgcttttctaacttctcttgagttcaccatattcgtcatctcatggcacactatcatcgccgccaatgcaaggctaatagtaatttatttcattttattccccattccccttagtcattccaatgtgtttattatatatttattttgtaaaacatgcattgttttatgttcatgtgggttttttaaactttgtaattttgaaagattagactcacaagaagttgaaaaaatgatacatagtatgccatgaactcttcacccagtacagcatcagagtcaggagattgacattagtatgttttcaacttttaaaagtttttacattcacttgtgtgtatatgtgtatgtgtagatccgtgcaatttgaccccatgtatagcttcatgtagccactgccataatcaagatacagaactggtccatcaccataaagatctttgtgtacccttttatggtcacacctgaccactccacccccaaccctggtctctctggcagctactaatctgttctgcaactctatagttttgtcattttgagaatgttatatgaatgaaaccatgttctatataaccttctgagattgattttttcactgtgcataatgcccttaagatccatccaagttgttgcatttatcaatagtttattcctttttattgctgagtagtattcccttttatgcatataccagtatttatttaaccattcatccaaaccattcatccattgaaggacatttgggttgttttcatgttttggctaatacgagtaaagctactgtgaacattcatgtacaagtttttgtgtgacacataagttttcattttttctgggataaatgtccaagaatgggattggttcatatagtaagtatatgttttgttttagaagaaactgccaaactattttccagagtgttttaccattttaataaattcccgccagcaaactggagagatccagttttgctacatcttgccagcatttggtggtacccctttcttttaagctgttcagatagcttcatagaccactacaaactgtgtgtggtgggggggtgggtctgagatggagtcttgctctgtcccccagctggagtgcagtggcgcaatctcagctcactgcaatctctgcctcctgggttcaaacgattcttgtacctcagcctcccaagtagctggactacaggtgcatgccaccacaactagctaattttttgtatttgttgttgttgttgttgttgttgttgttgttgttgttttagtagagatgaggcttcgccatgttttggccaggctggacattgtggttttaatttgcatttccctaatggctaatggtatggaatatcttttcatgtgctcattggccatccatcttccctctttgctgaaatgtcggttcacgtattttgcacattgtctctttctttattattttttagagacagggtcccactctgtcactgagactggatggcagtggtgcatcatagctcactcaacttctaattcctgggtttaagcagtcctcctgcctcagactgccaagtagctgagactacacgtgtgcaccactgaaccaggctaatttctttttttaatttttttgtagaggtgggagtctccctatgttccccaggcttgtcttgaattcctgacctcaagcaatcctcttgcctcagcttcctaaagtgctgggattacagggatgagccactgagctcaatctcttttgtccgttttataattgtataattggagtgctgttttttgttttgttttgttttgtttttactattggttttttttattgtggtaaaatagacataatgtatatttaccattttaccataaaagttacaattttagccattttaagtgtacaattcagtggctttaagtacaatcacattgttgtgcaaccatcatcactgtccatctccagaactttgtcatcattcctaattgaagcaggaactcctcattatctccttccccagcccctggaaccactatcctactttctgcctctataaattcaattatcctagggacctcatataagcggaatcatacagtctttgcccttttgtacctggcttatttcacttagcataattattttttatcaatacataagagttgtacatacttagcataattcttttgaagttcagccatgttgtagcagatgtcataattttattcctttttttgtcttttttgtgataaaaagcatgtaacgttaaatttaccttagccattttcaagtgtacagttcagtagtgttaagtatattaacattgttgtggaacagatctctagaacttttttaccttgcaaaacaaactctatactcgtgaaacactagttcttcctcctctatccccactcttcccaggccttagtaaccacctgtctgctttctgtccctgtgattttgactactttagatacttcatatgagtgaaatcatgcagtatttgttcttttgtgactgattttttccacttagcataatgccaaggttcatccatctcatagcatgtgacaggattcccttctttttcaaggctgcataatattccattgtatgcatacattttctttattcattcattgtcagtgggcattttattgcttccatctcttggctcttgagaataatgctgcagttaacatgtgtatgcaaatatctcttcaggatcctgctttcatttttatgtatatatacccaaagtggaatgctagattgtatgttaattctatttctaattttttgagaaacttctataatattctccataatggctgcaacatttacattcccacaactattcaaatttctctgcaactttgctaacacctggtattttctgttcttttgatagttaccatcctaatgggtgtgaggtgatatcccattctggttttgatttgcatttccctaatgattagaagtgttaaccatctttttatatgtttgtttgccaattatgggtcttctttggagaattgtctattgaagccctttgcccattttttaattggtttttgattttttggttattgacttgtagaagtttcttatatattctggatattaaccccttatcatacatatgagaatttcatttctttttaaggctgaataatattccattgtatgtatataccacattttgtgtttccattcatttgtcaatggacatttgggttttttccaccttttggctattgggaataatgctgctgtgaacatgggtgtacaaatatcagtttgagtccctgctttcaattcttttgggtatctacctagaagagaacttgctggatcatatgataattgtttgttgacctttttgagtaactaccgtactgtcttccacagtggctgtgccattttacactcttactaatagtaaacaggcttccattcatctatatcctcaccaatacttgtttttttctgtgtttgtttttttggattttgtttttgttgttttggtttttgtttttgttcgtttgtttttgttttttgttttttttgctagtagccatcctaaatggctatgaggtggtatctaatggttttgatttgcatttccttaatgatttcttagtgatgttgagcatctcttcatgtgcttgcaggcatacatatatcttctttggagaaatgtctattcacatcctttgaatttagggaatgaattgagttcttttgttattgaggtgcagggtgctttgtatattctggatacgaaacacttattagatatggtttgcaaatattttctcccatattgtgggttgtctattcactatcttaaaagtatcctttgataaacaaaagtttctgattttgattaagtccaatttatctacttttgttacctgtgcctattgtatcatatgcaaaaaagcctcatcaaattcaatgtcatgaagcttttgccatacatttttgtctaagaattttatagttttaactcttgtgtttaggtctttgatccatattgagttaatttttgcatatgatattaagtccaagtccattttttttttttgcatgtgaatatccagtttactcagctccatttgccaaaaaaaatataaactgtcccttccccaatgaatggtcttggcacccttgtcaaaaaaaatttgactgcatatacagggtttatttctgggttctctgttccataggcctctgtgtctgtctttatgacagaaccacactgttttggttagtgtagctttgtagtaagttttgaaatgaggaagcatgagtcttctaactttgttctttttctagattgttttggctattcaaggtccctggagattccatatttattttaagatggaattttctatttctacaaagcatcattctctttggagcatttttatgatacctcccttaagcttttctgtcagatacttccaacatctgagtcacctcagtgttgtcacctgttaattgccttttctcattcaggttgcgattttcctggttcttggcctgacaagtagtttttcgtgttttcctagacctttggatgttataggacactggatcctatgaaatctttcattttaccaagtagccgttatttaagtttagtatgcagcttctggcctactcttgtgggctgtggtttcagtaacaatttaatatttagcaaggttattctggtctacttcattcatgggctatcaggaggccactcaggaaacctgagtggagttccacactgtgtaatttacttctcaaacctttgggtgtgttaatgctcatctgtttcacatgtagattggtcagagcctgcccaggacttcctatacagctttaaagcgtggttttccagcttcctcctcttcagatcttccctgaaatctctagttgggagtgtgaggggcaccccatcactgctgggcagggcatggaaatccggactctccactcagtctctgctgacagcatgctgtcaggagaggggagcactgtccctaacgacctgcttccactgggggtggaagtctatactccccacccagtttgtgctaacatcatgcagcaggggtgggaaacaccctgagctgcctgctgccaccccaaggccacctactactgccaggttgggtgtggaagttcatactccccagattcccctcgtggtgcccgcaggtaccacgctgctgaggaaggggagcactgccttaagccatctgctacccccaggtaggggataggagtccaggcttccactcagtctccactgacattccagggagaaaggacatccatggtgtttactggcacagggcggatgttgtcacaaaagtttctgtctgggtagggtccctctttccttttcctttggctagagtcaattggtttttcttggaactctttgtcattacctgttggaggttgcaggttgcttttccaagtttacatctcacccagactggtatatatggagaattttaaaaaaagaaaaaaaaaaccagggaactcaccactatgacattcctcaagtcttgaggttcctagccaatctgccttcctctttacactttttgagtcctcttatgatagtccactgtattatgctcagggattttcattgtacttaagagaggaagatcagggaaaaatgagtcttctcccctttttcataccagaagtttttgaactttctgtagttatgtgtgtttgagtatgtgtaaattacttatgctatatattacatagcatatattcagtgtactataatatatactataatcaataatttatgttttgagattatacacagatattagatataccagtattatctatgattaaacttttacaaaaaagttatcttactatatatgtccttttgcaacttgttttattcaatcattttgttttggagatttatcttttttatataaatttaaggggtacaagggcagttttgttgcatggatatattgggtaagggtgaagtctgggcttttagtgtaaccatcagcaaaataatgtacattgtacccattaagtaatttctcatctgtcactctcatctcacccttctgagtctctggtatctattattccacactctatgtccatgtacatacattatttagctccattttgatacatgtaaatccagttcattaatttcaaatggtatagagggtttcccattgtatgaataaactacagtgtttatccattcctctattgagcagttattttttgtgaatgcaagcaatgtggcagtgaatatccttgtacacatctccatgtgcacataagtaagggtttctctagaatatatatagaaatgaaattcctatgtggtagaatatacacatctccaactttgtgcttgtatattctggatacaaaataataagataccaccaaactgagctttagagtggttgtcctagtttattatatttaaaattttgtaaatgttttaaaatatttgtatatactatatataatacttataaaattttattttatacacattttgttttttaggttttaatataactgcaggagttgatgaagaaacaggatttgtttatggaggaaatcgtttcaattgtggcacatggatggataaaatgggagaaagtgacagagctagaaacagaggaatcccagccacaccaaggtagtgtaaatgttataatgctgtgtaattatacccttctttaagaaagcacttacttgtggaatcttttattctgttaactatgaactctttacattaagtcaatcaaaatttccctgccttcttcccttcatctccccattatacatttacacaatcctgttgatataagttatcaagtaacactatctgttcttttctgtaagtgctcgtgggttgattctctacaagcacctcaaaggaaagatttatgattcattatcccagtggttaagacattttcgtaacctgaactgcttattgatgtaaacatttcattatgcccatcttttgcaaacatagaaaacaaccagttgttctgtcttttatgcaattctttcactttctgaaccttttttcctaatttttaaatcttttttcctaatgtttgtcatttaagaagtttttatcatttcaaatgctaaatacatcatcataagctattaaaatcacttttaatattactatcacccaaataacgtactttgtacccattaagtaatgtctattaaaatagcttctgatactgtattaagctgagaagttattttcttattctaatttttttttttgaaagagagagcctcactctgttgcccagcctgtagtgcagtagcacaatcatggctcactgcagcctctgtctcccagattcaagcaattctcctgtctcagcctcccaagtacctggggactacaggcgcacactaccagacaggctaatttttgtatttttagtgaagacgaggtttcaccatgttggccaggctgatctcaaatttttggccttaaatgatccacccacctcagcctcccaaagtgctgggattacagaaatgagccactgcactcggccttttattctaaattttatcttcagtaagaattgtccaaaaaatagttgtgtactgggtgtggtagctgacgtctgtaatctcaacactttgggaggttgggaggttgaggtgggaggatagcttgaacccaggagtttgaaaccagcttgggcaacatagtgaggccccatctctacaaaaaataattaataaataagttgccatctttacatgctttaccagttttttaaaaatctatttggtacattagatccttgtacttcccttttatttttcttaaaaatgagctttcaaattaatgtgtctgccttccctcactttctccagccctatttttcatgtttgctatcttttctctagtaccttatcccaatattcagattccttactcctaccttttccaactgccatcttcttttattccacaattcccattctacatcatagaattttttaaaattatgtgaggatgatagacaatggcaaaaccgtgagaggaaaaaatctttacatgatatagtacacattcctatagagtaaggattttttaatagttttcataatatgttatatgattcattacaattgtttaccgaatgccctttaaatagtacttaaaggacgccaacttaaagaataaaaatacgttttttaattttagagatgggtctgctgtggaaattgtgggcctgagtaaatctgctgttcgctggttgctggaattatccaaaaaaaatattttcccttatcatgaagtcacagtaaaaagacatggtaagctggttattttatttacaaagaaccttcaaatgtactatgtatattctcaacctatgtaatcatcatttgattctatcagctaatatcggaaaacccttaaaattaagaagaaagaaaattcattaatttactagtgtgaaaattgtaacaattctagttgaaccatatttgtcgcaactttgaactgagataagaaagcagcatagctgttgcctttattgtgcatgtctttttcctcactgtgactgagcaagttgcatttctgtgagcaattttgcaatctttacatgtctttttctagaatagtgctgtccaaaataatgtgaaccacatacataattttaaattttatagtacccacattttaaaaagtaaaaagaagcaggtgaaattgattacaagatattttattaaatcagccaggtgcagtggctcatgcctgtaatctccacactttggggggccaaggcaggcagatcgcttgagctcaggagtttgagaccatcctgggcaacatgaaaacccatgtctacaagaaatacaaaaattagtagggtgtggttatgtgagcttgtagtcccagctacttgagaggctgaggtgggaggatggcttgagcccaggaagcggaggttgcggtgagccaagttcatactactgcactccagcttgggtggacaataccagacgctgtcttaaaaaaaaaaaaagacattttatttaactcagtgtatgtatataagatattgtttcaacatgtaatcaatataaaattattcatgagctattttacattctttttgggtggtgctacatcttcataatccagcttatattttacatttataacacatctcaattcagactggccacattttccaaaagtggataatttattgccttgtagtagataaaaataaactaaatattactatttgtctgtaactagatgtgtgaattgttttgaatgattaaaactaccatgtcttatgtcatttttcaggaaaggctataaaggtctcatatgatgagtggaacagaaaaatacaagacaactttgaaaagctatttcatgtttccgaagacccttcagatttaaatgaaaagcatccaaatctggttcacaaacgtggcatatacaaagatagttatggagcttcaagtccttggtgtgactatcagctcaggcctaattttaccatagcaatggttgtggtaggtgattcgtttgtaaaaacatttcaaaaaatgatgtgctagagtttgcttagttccttattcccatttgttttcaaattcacttcattgctaaaaagtagtatattgcttactagctagttttaaatagtctttcctaattaatcaagtattatgcgtatcacttttaacctgtaacattcagtatccaaaagccgaaagtaatagatgatgactaatgaagtgcttcctagagtttttcacattcagagcacacatagaagatgttatttgtggccagatgcagtggctcacacacttggcggactgaggcaggaggatcacttcagcccaggagtttgagaccagcctggatatcataatgaagccccaccaccatatttgaaaagaaaagaaaagaaaatgatatttgtatagcacaataggttacatggagtaggctgcttgtgctagatccaactacttcagttagccccaggccccacccagctaccctgaaagctgagggtctctgtatcctacacacctgtgctataaccagtgcctcagcacactagttggaaagccctgaactagtgaactaaagtggatagctttagttaacattctgttttcattgttgcattgctgcaatcagtttgtccggcaaagaattttagactctctgctgttttaaatctatactttagtctaaaaataaactacaaggaagtaaaatagagaaggtatgtgttcttctatgcctggctagctgttttcacgttgtcaaaaagagtaccaaacctactactataaattatagtagaatgaaaagtgtaaaagtacacaaaggtagctttggttcagcgtggaccattaaaattaatgcatattcttggtcaacaatgcttttctcttctttctctgtatctctgataaatttactcatgctattggagtaaaagttctgtgtttatttatggccccagaagcaaacaatgggtatcagatgtacttaaagaaagctattatgaatctgctgaagaatgagttacataaatttaagtgtgtgctgtctgggttcagtggctcacacctgtaattccaacactttgggaggctgaggttggaggatcatttgagctcaggagttcaagatcagcctgggcaacatagtgagacttcatctccacaaaaatttaaaaaaaaattagccatttgtggtggtacacacctgtagtcccagctgctcaagaggctaaggcaggatgatcgcttgagcccaggagattgaggctgcactgagctctgatctcgccactgcaccccagcctggtgacagagtgagaccctgtctccaaaggggttaaaataaaagtgtgttctgccttcagtgtagctgtggcaacttccttttggagctgagtaactttcttgaggtgacacagagaaataatcacctctaaaggctttcctaacttctacggccaaaaacagtccttctaagtcagcctcataggattagatctgtttaggcatctacactcaaattctgaccctcatggtattttaagtaatttttttcaagcttatgaatagtttctgtgggtaggaactaattcttctgtgatcttaaaaatttgtatatttgtttttggcattcactaggcccctgagctctttactacagaaaaagcatggaaagctttggagattgcagaaaaaaaattgcttggtccccttggcatgaaaactttagatccagagtaagttggaatataagtattaagaatgttatcatatttaatccaaatacattgacatcaaccataatttttttttttttgccagggcaacaaaaggagatgccatctctacaaaaataaaagttaaaaaaaaaattagttgggagagattgtgtacacctgtagtcctagctactcaggaggctaaggcaggagtatcacttgagcccaggagatcaaggctgtagtgagctatgatggcaccactgcactccagcctgcttgacagaatgagacactgtattaaaacacacacacacacacgcacacacacaccaaaactcacaattaaagctgactcttgtgaccagctctccaaaaaaagaaaagtaacaaatggagtatagataactgtgttataagttccatgtattacaataaagcaatatgtatattcagttgctatttgtaatccgataataggccaattttaattttaaaataattttatggagaagcttaaaaatcacctttccaatctataattaataaaaccatgtctttaatttttattaattcaaattattctatatatatttcaattattagataggcttcaatatattagaggcctaggaaatagttgactttaaaccaagccatatttagtgccaggctaacttctttaaggcaagataccagaatattttacattttttatattaaccagtatttgttaatcatttttaacacatgattaaagtcctgtgaactcagtatgtactaatttaaggttagatggatgatgtactaatgccgagcttattctgtagaagacaaaataattgattatttctcttacctttgttattgaaatttttctaatgctttttacataatatctgatcatcttttatttaacttaaatttcaatcattttgcagtgatatggtttactgtggaatttatgacaatgcattagacaatgacaactacaatcttgctaaaggtttcaattatcaccaaggacctgtaagaatttcatttatcttctgagtttcagtttaaattatttttcaagtaatttttaggtatttatggttttttttgtcttttaaataatcttttttaggagtggctgtggcctattgggtattttcttcgtgcaaaattatatttttccagattgatgggcccggagactactgcaaagactatagttttggttaaaaatgttctttcccgacattatgttcatcttgagaggtaagtcatcaggagcatgtaatttccataactagtgtttagtcagtttattagctattaggtaaattacagtttcttagaattgatttctgtatgccctaggtatcccaatgaaaagtgaagcctttattctttaacatgacaaattctgttatataattttcactttctcttattttgggttgttatttattttaagttgaggtcttgatattgtgcgatttatacatgtggaatagtctttgatttttaaaatttccctgatgtttttggatgtggttagcacaggataaatataaaaactgaaggtactcagcctgggccttttgagttaattgatttaaagatatatcaagaaatagttttcagaaatgctttcattatagttaaaatatcagaactggtcttttgcctgttagttcaaaaaacatttttcacttccttgtcctaattattagcaaatagacagtgtcagagttacgtatctttataagagtataaattcagagtgtatcttaattcctcaaattttagattatacctaagtatatctatattctattcctcagataatgaataaacagcacaaattttatctcctttcttacaagcacataagggacttctgcgtgtttcatattaatagagccactcctggtctgttttgtttggttgtcaccatggtacagattttaccatccttttaagctatttatgtctttgtatttaaagtggctttcttgtacatagtagcatgtaatcgggccttgctctcgtgtagcacaacagtttctgcttttggaatatttagaccatttacacttaaggtctgaaattgtgaaatttaaatgtttgttgtctgtttattctgtctgttctttgttagctttttcctctttttgtgcttcttttgcattgaatatttattatttcattttaatctcctttgttggctaattagatgtaattcttgtttatttaaaatggctgctttaggtttatagtatatgtctttatagtttaccttccagtgatataccacttcaagtaaggtataaagatccttaaaatagtatagttttatttttcccctcccggcctgtgtgctatcatcatcatccattttgcttttacctgttattaccccccacactacatggttactacatttgtttaggcagtcagttatgttttaatgatctttaaataatatattaaaaagtctaattactcttatagttgccattttcagtgctcttcatatgtttgtgatgttctgtatctccatcttgtatcattttccttctacccgaaggactttctccatcatgtcttgtagtgtttgcctcctcatgatgaattctttcaattcttataagtgtaaaacatctgtgttttgcctttattttaaagatattttcactatgtatagaattcaaagttaagcttttttctctttcatactttaaggtggttacattgttttgataagaaatctgcatcatttttatgtctaacctaccatcacatccatgctggtgtttttcatttcaacgttgtagttttcatttctcaaagttttatctgggctgtttttatatcttccatgtctctgcttaatgttttgaacatgtggaatatgattacagtgactcttttaatatccttgtctgctaattcatttctgggttgcttttgcttgtgattgttctctttattttgggtcatatcaccctgcttctttgcttggtagtttttgttttttgatttttggagcgacaggggtcttgctatcttgcccaggctggtctcgaactcctaggctcaagcagtcccccaacctcggcctcctgaagtgctgagattacaggcatgagccaccacacccagccatttgcctggttattttttattagataccagatgtgaattttaccttgttgggtgctagatttttggtgtttctgtaaatgtttttgagctttgttttggaatgcagtgaaattacttggaaacagtttgatcctttctggtcttgattttaagcttgttagacctgaccagaatagcatttggtctaggaataattattctccattagtgaatcaagacccatctgtgttccctaccctgtatttcgaaaattatgacgttttcaaatctggctggtgggaacaagcaagtgttcctgacgctgtatgagtgccacatactgcttcttctcatccttttggatggttctttccttgttctttggtagtttcctcttgtgaatttgctggttggtacactacagatacttgagtgggaccctctgcatatcttcagagttctctctttgtacagctccttcctctctagtactctatcctgcaaattgtagctgctttgtagtgttcctggattctcagttcaactcaaggaagtctgccaggctccacctgtgttccccctctctgtgccaaatcctggaaactctcaaggcagtaaggtatggtaatcatagggtttgcttcatttgtttctcatccttcaaggatcgctatttgttgcctaatgtctaatgtcttaatgtccagttcttcagttgtatcagacaggagggaaattctgtccatactacttcctgtttgtcacatatggaagtccttccttgctttctggcccagcaaggttttcaacactcatctttcactttcactaccccagcctggaattgggcaattctctaaggatcccttgttctttatagtgaaaaatgttatttagaagccagatctgagcacatggtgtatttattattactatgacccccagtagatagggctagggaatatataataatacataaacataagtaaatacatacacacttatcttcatctcaatgtatcctgtctatgtgtgttgaaaacctgagtttacaccagttccaagctatttctcagtgtttaattctatttttctccctttctatatttgtaattcccttttccaacaatgaataacctacttcccacattgggccatcaccaccacatagagtctgctcacccagcttgggcctgctaccccacagtaagccacctctatgtgtggagccctcctggcaccacttggattctaactacccactctggaccactctcacccttggtggactccctcttcatacctcttggactctaacatcctgctccatactacctattaccctttcccctccatttctggtcacctaccttgctctgtcccacctaatgacttcaggatgaatttttcaggaaagcaagggaaaggggacttccttatatttgtatggatacattccatgtcctagtgtccaagtgtaattatgggcagcatattcatggttttgtaacctcattttgttttttaattttggtatctgttagtttgctagagctgcagtaacagagcactacaaactgagtgacttaaataatagaaattgttaaacagcagaatattgtctcacagttctggaggccagaaatctgaaaaatcaaggcatgggcagagccatgctccctctgaaggcattagggaaaggtctcttccagccctgtctcctagctgctgataatcctgtggcttgtggcagcaaaactccaatcttcatgtggcattatcttaactaattacatctgcagtgacccgatttccaaacaggttcacattctgaggtactcggggctaggacttcaacatacaaattctgtggagatgtaattcaacacattacagatgcccaggtatccaacttcagtcatttggcattttactctgatgtagcttgaatacttggaaacatacattttctatattttccatgtttctatgacagttttttaaatatggtacctagctgatattagttattatccaaaataccctgttttacctaatgggattattttttcccatttttactatgaagtatttgatgcccactgaagcgtgtatgtaatatagccctgagatacaaaccatagtaatgaaacaaatatgttcccacaacccaacttaaaaatgaaacattacagatgtctgtactttttgaatttgttttcatttttaagggattacattgaaattaacaataaatttgatgtgctaacatcactgtgttctgataaggagggctggaacaagttatttaacctctataaatctctcttacctctctatagataggaatacttatggtaccttccttacagggttactgtgaacattaaatgagataatatacataaaagcagtattagaacataaatgcataataaataccaagtttattattcagtagaaagagaaattaattggcatttttttctttaagtagaaagtattctggaatgccatttttccgcctaatcatagttcttagtgtttcttcattacttttacttttacagttttatcaagatcacacataacacatctgcataattacaatttgagtctcataaacaaaattatgcctgagagagtatttatctctatgtttatatgtagcttgtaatggtagtttcttctatgtttttaatacataaagggattccttgtatttaaaagtctcaaattccaaagatggaatgtcaaagaataatttcagtctaaattcatttgtatgtctttaggatattgttttattttgtagcaaatgactacatatgattattttctacactagaaggcaaaaatcaccaggtcttgcctattttgttaatatgaattaaattatgtctttgtaaaatgtcttttctttcattcagatccccttggaaaggacttccagaactgaccaatgagaatgcccagtactgtcctttcagctgtgaaacacaagcctggtcaattgctactattcttgagacactttatgatttatagtttattacagatattaagtatgcaattacttgtattataggatgcaaggtcatcatatgtaaatgccttatatgcacaggctcaagttgttttaaaaatctcatttattataatattgatgctcaattaggtaagattgtaaaagcattgattttttttaatgtacagaggtagatttcaatttgaatcagaaagaaatatcattaccaatgaaatgtgtttgagttcagtaagaattattcaaatgcctagaaatccatagtttggaaaagaaaaatcatgtcatcttctatttgtacagaaatgaaaataaaatatgaaaataatgaaagaaatgaaaagatagcttttaattgtggtatatataatcttcagtaacaatacatactgaatacgctgtggttcattaatattaacaccacgtactatagtattcttaatacagtgctcactgcatttaataaatatttaataaatgatgaatgatagaagtttccatctacaatatatgttcctaaatggagcacagatgttcaaactatgctttcattttttcactgatatattaatttttgtgtaatgaatgccaacagtatattttatatgatttacttatgtgaggaaacatgcaaagcattaggaaatttatttcctaaaaacagttttgtaaaattagtattgagttctattgagtattataagatagcttacattttcaaaatggaaattgtcggtcatatttctagaactttaaagaaaaaagaatgttatattagttttctaaaactcaactatctttagtcatgttcaaaaatctattgctagatcatagtagatactggttttctattaactcaaaacctacattgacaagtttaacattgagaagaatcttaacaaaaatatggatatgaattcagtagatatcttaaattcaataaaatcactggaagtttttcatgataacttattttaagatgccttaaaaatcttaaagtcacaaaaggaaaaaggtttttaacatttacatgagttaacattttttcatagaacttatttcctagatagaattttttactgttttttactgttttcttaagaaaacagttaaatcattatgcattcagttggaagaaagtagtggcaagaattctttcattgctatataatattcagtggctcatttatacctaataaaataatggtattttaaaataatgctactttcaaagtagcatttttttagttagtttacaggttacatacccaaaaccttaactatgactaagaaattaaagaagaaaaccagcaaactaaaacttctgggcagcaaaaatatataaatgcttcagatgtcaaatacccatgcttgaaagctcgtgtaatttactttaagattatctgcctgctcttcttcaaagctgaccttgctttagaaatagttttaactagcttagttttctggtttccaaaactaaaatagattaaatcctacaaatttaaggacagttgtgacagtaatctgaccactatctataaatacattggacattggtttccaaatctccctttcttcttcagttccttccttgttcaatatatacccttctctaaactgtgcgggtaaaaggaatgactgtccttgagagaaccattagtttatcaaaggtttatgtagttttgttgctgtaccctaactttgatattcagggaggtaggaaaggtaacagaaaaccagcatatttaatcaaagcaagaagtaatcgctgacagttaaatgtgaccaaaaaaattaaaagttcacaatttttttaatgtagccatttggggttatctctagtaaggcagatacccacgttggtaaatttttaggatattgtgttgcactagaaaactaagtggttcatatttctaatgaggaagattaatgaaagaacattgttatattctgcgtggtatattttaaagtttaagaaggcatgttaaacattatttcctctatggtagttaaaatacagaattagatttttaacaggtgtcatttgactaaacgtttcggtagaatgcttcatacttgagtgatgctggataaggtattgtatttcaacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgtgatccatttctgatatgtcttgaactactgtgtctagtgggcaaatgtcattgttacctctgtgtgttaagaaaataaaaatattttctaaaggtc

SEQ ID NO: 36431 - DNA, 25678 bp, Homo sapiens
attcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtgagtacggccccggcgcccctccggccgcgcgtacccctggccactggaaactgctccgggccccccgggcccctccttagaacttcctggaggcctccccggagctgctaagcacggagcagcgccccctcccgacttcccccgacccagccaacagcacccccctggcatctcacctcccagcttaacccgcacccaggcatcatcagtgccaggggttggccaggcaggtgtgggctctgatcctggctttggtggagggactagccgagctttgggaggaggctcgccttctgcacttggcttgggtcatctgaggacaaaaggaaggagcccctcatccaccttctccctcatttcaatgagggcatctccttccccccttagagatgttctatgccagctcacagggtgaggcaaggagcatcagaaacctgagtcttcagggccagaaaggccttaagggatgcccctggaggtgtggcaggctgcccattactgggcatgtgtgaggttggcttgagtgcgcaggaggttagaggggagcgtgtgctccaggcaggagtccggacttcctcaggggagtctgcaaggctggggcaagagagaccagtcaggcactggcctgggtgcagaatttcaggggctaccaaaaaacacagtagttgagatgagtaatattgagatgtatttttttaagtcaaaattaatgcaaaaaaaaaaaaaaaaaaaaaaaacctgtgataaaggaaatatccagattttaaatagagtcagtaatagtggtatgccgagccatattggagcctgaggctaactgaaaaatcagcaacacggatcctgtctttatttgatatttggatattttgttcattacagatagttttgcattaatttttattttaaaaactattgtgttaaatattacttatctccgttactgagtttttttggcaccccctaaaattttgcaccccgaggaaaaaaaaaaaaaaacacctcactggcctcattcccctcaccctagtcctggccctggcggagagccccagctgtggacaggactccctctggcttttcagggggtgaacatacgtcctcctcttgggaaggcccaagccctctgcacatgaggacacagtggaaaggcagcttccacacatgctgttagcagacagggctactgtgacaagggctgactggtgggtgtggccagtgctggacggccatcagccattctctgctgtcctagaatccccctccctgctaccctctccatacaggcagcttttgggccaaggttttctactcagtccccaatacttatgcagtccaactctgccttgcctctttcaagctgtcgtcagtttcctctacccataattctctgctccccattgaggttgctgtgcctggcccaccaagtaagggctgactgagccctccagtgcctcagagtataggtgctagtgccccagcctcctcctcagcctctgtcagcagagggatgatgctttgtctccagccaagctgacctcagtgaggggctgctgctcatggggtgcctgtctccctgggtactgctggaggccaagactaggggagaggagcgtctccactgggaacactcactctatcacatccaaggtgtcgcttttgagttgtgtgctgaatcccactttaagaacctgcaggagctcaggaaaaatcagatggcaggtccttctgtggtgtgatgaaggatgcatccacctgctctggtccttaccaggtacttgcagcatccctgcagaagggcgcattatagccatgcatcagctgctctagggccccttggagaataggatgttttacctagagggtgctaaacttttgcagtggcttttcttagaatgcaagacctcagcatgaggctcagcctgatgggccccacctctgggcagagaaaactgagctctcaaatgccacaatattggcagaggcatgcctgggacttggcatctgggcaccaagtcagtgggtcttctagggcctgtctttgggctgttagttcttaaggaagccagttgattgagaggggaatgggacagggcaaggccatgtctgaagtgggggtgcttggtgcttagcagacctctggccactaccctgagccccacagttcattttgggtcaaaaacatttctcccctgaaggtagcatcctaggtgccaagctgagtgtactcacatgcatcaagtccaggcccttccctggggcagtctaccaggaggggcatctcagtgctgtgattaggcaagcattggtggggccaggggctttgtgagcccagaggagggccctccctgtcaggggctagggctcagggagacttccacaggaagcaatgtctaagcattgctgcaagggatggtcatcagcaccatccaggtgccccttcccctaatcattgagggtgtggggtgggagtgtgttttttgctggggaggggattgcaggctagtttagggctcacaaagaggccagagagggagcagtagtctctcccatcattggttcctccctccccaccctgctaggccagaccgtggaaaatcccagcccagggaaggccaagccttgtgcttgagatcagacccccaggcctggtgtgggagcccaaggcggattctccgagactgacttcattcctcctggccacacacccaggggtctgaggctgggcgctggcagcctgtgagtgtgtgtgggcgtggacgtgtcctcacaacaccaagcacatgtgagcaccacccacctccctccatgggtgggtggtttccaagcgcctgtcctgagcccagtttcttcctcgggtacctgtgccctcttccttcctaccctgggcactgagactgcccaaggcttcctgcagtaccattctctccaactctgaaacatgaaactgaaaagaaactagaggaaacagaggcccagagagggtcacatactttgcctggctctcatagcaaatccttgaagagaggcctggagggtggccagccacttcccaggcccagctgggtctcctgcactgtgtcggctccctcgatgtgaccactcctgctattaccaaccaggccctcctctcctgggatcctcgcctcagctcctgcctccctggagtttcagcttgtctgagctgggggtcttagtgccacctaagaagccccacagccccagaagaccaaagctcccctcccaaggccttaccctcgcaccccccgcctgactcaccggctctggcaatcctgtgaaaggaacatggaacaggcagccctgggcatcctcccagggcatcttggatggctgtgctagccttgcctgacgtgtgtcctctatccctgacttcacatggccaatcagaggccaggagagaaccgcagctgcctcctccctggtcccttgctcccagtctctccctcttcagtctgtcctgcatgtggggcagataaacccctgcagtctgaccaggttactcctctgctcaagaagattctgtagctcctcagggcctttaggacaaaatctagtgtctcagcccagcactccagagttagaggcacctccttcctgtcctttcttcctccttttctcaagcctccacagcccccatgggaccatgctgctcgtgggcctagatgttacacctccctagacacatgcaagggtgtttctagggtacctccttctctgtccagcctcctgcacccaagaggccagacctgtctggaccctcagtccctgagagcagccctggctgcctgctaccacctctcctgcctgagcccctagctcacctgggcctgctccaccccacctccacaggctgcctgcccacctctgccctccaggtcactcgccttcccctgcagagtttggagtagatgcagggaaggaccaaagcaggcttcacccaacaagcttccagagttagagcccagaggcagggataataataccaacttggccatttgctgaagaccacttcctgggcttactgacttcaatgtgcagtttcattcatcctcacaacctcctaatgaggtgcagattatggtcctcctggtgtagatgagaaaacaggcctagggaggtggcacagaagggtacagccgagcttgaattcaaactgaacctgtgctctctgcatcacagtgagatgacccaggaggatatcatgttcagcctgcgggcagggtggggcagggcatgagcatggacccctctgccagctttgcctctgtggtcctcacctcccacatctgcatccagaggaagaattatgcttgcatttgctgagtgcgttatacatcatctcctttaattcccaggtcctagccaggtactgttatttgtcccgtgttacagatgtggtgacgagctcacttgctgacttttagtagtggaaccaggatttgagtctgtgtgactctctatcctgagttcttaacaaccatgcatttaaaaaaaaaatttatatattattgcttatcttgtacacctcatttattcactcattcatttggtcattcattcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccggacactgttcttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacactatgctaagcattttatttttctcatttaattcccacaacagccttgtgagataaatagtattatcagctctattttatagatgaggaaactgaggctcggagaaattaaccaactcacccaaggtctcagggttaatgagtggccaagcttagacctaggctgactgtccaatccagtgggccctggcctcactctgttccgtctcttagggacgggtgttttatattctgtgtcacctgtctctgtgttcactgttcccctgaggtgtaaacacctgaaaaaaaccaaatttgggtttttgcctcaagtttgcgggccccacagagttgctggggatggtggcagagcagggttgggagccattagtaccattatgggcaccaggttactgctagacttggcctgggagctctggctttttgtcctctctccttcctcctaacctcaggggtcctcactgcagcatcctctgctctcagaaggtgtacccctctccagtagctccctagtagctcctgagtccattctacctcctttctaagctgggaacacatggaagacttcccaggacagtggctgacatgggcaggagaggaaaggggcagggagggagctggggtccgcccaggcggcccacacctccttccaattgctgtgcccagcattcctgcagaagagcagtcagggttgggatgctggaaagagaggtttagacttgcccctcccctggccctgacctagccgcctcatttccacaggcagctggaccaagggccttctttttgtcgggactcatgatcacagggtgagggttgggtctgggtccctctccctcttgctgatgggcacccagaaaccaggcattgcagtaccacttggaaatggggagaggggtgtcagaatgccaaagcaggaagagacacaggatgggaaagcgaggccccagaggcctttgccatccaaacctcaagagacaacccatccttccccctgcttgtgggccagctggaaccacaggttttccaaacccaacgcaaatctttctgcaaaagaaaggactctgggaatcgattccagaccctgcttgacaatgaagtctgtgctcacacaggcagtgccaccagacgttttatggagtatgggcattggctcacgcacttgccaaggacatacaggtgctaggccctgagctgggcgtggagaatttcaggggcatcccagaaccctccctggcctcactgacgtctcagcctggcagtgagaaaacagacacctggggtggagagtggcccaagtccatgtctgtctttgccagctctcagcacccactgtgcacctgggagacgtgcaccagaagctgagtacaggcaaaagataataccactcacccctgccctcatgggctcttgcctggctgcagaaggcagatatcatctcgtgaggaaatagggcagatatcatctcatgaggaaatagtcatttaacaaatatttattgagcgacttactgtatgctgggcaccgttctagagctgggtattcattcgtgaaaagaaagagacaaaattcttgcccttgtggatcttctattttcatgtataaacataataaatatgtaaaaaaaatagaaggtactaagtgctgtggaaaaatagagataggtaaggaagatcgggagtgtaggagagggacaggttgcaaaggtggtcaggcctcatgaaggtgacacttgagcaaagacttgaggcatatgagtgagccatgcagctgtctgcaggaagagcattccagataggaagacagccagtgcaaggccctgaggcaggagttccctggggttttcaggtgtgctccagtgtggttagaacagagtagagtggaaatggaggtataacaggggacaggtcagagaggtaatggggtccgggccatggggagcttgtcggccattgtaaggggtttgccttttattttctgtgcatcccttttactcagcgtttgagctgagtagaagcatgggtccctgactgctaaacagggcccctgactgctgtgccaggagtggacagtggagagtcagccaggggaaccgacaggaggctgttccagagagtaggaagagtggtagcaatggaggaagccagctttagggtatgttcttgagatagagctgaggggatttcctgctgggttggatatggggtatgaaagaaagagaggtgtcagggatcacacagtggtttatggctggtgtggctggaaggatgcaattgccttgagctgagatgggaaggctgtgggcagcgtaagttttgtaagaaatatgaaaatttcaggtcactgtgcagggcctgagagggcaaggagggaacccctggagtaactgaagcatcaagggaagcttctagaggtggggtagggggcaccaggcagggcctgcaagggcggggagggctcaggggcaggggttgggttcacgctgggaggaaatgtgcattaggtgtgcagagaggcagcagaggcttggcctctgagcagggagctgacctccgcattggttagcattgtctgcctccccctcagcccagcctgcctcctgggcagctggcgcaatcaagcacacacttacaaatcccttctgtgagtcaagcccttctgctgctgtctctccccattggtggggtggacaggtgagtgctgtaaaagggtgcagggtggtggtggaggggtgttcaggactgacagggtgggctttggagctaaagactgtgtgcctctgcataggtagagctggtgtgtgtgtgtgtgtgtgtgtgtgtgtgtgtgtgtgtgtacgcgcatgcacatgcatagctgggaattccaggacaagggcaccatggagtcagggggtaaaaaaggttggggtatgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggcttgagctgggttacatcttcattatggggcaaagtggaatctgcagccaccttgcctgcctgctcaccaagcaggtgtggcactgccaggccagtgctgacaagttaatttcctgattatgagataatcatttcctagggaatcgggcagccagctcccgccgtggaggcctctctggctcatctttattcaaggccctgctctgcagagctttctgcttctctgccacctaggggctcctctggagtctggctgcgctagccaaaacatcccgctcagcacatatttcacaagcaactgaccagttcctcctggactttgtttatcctccagccctgggctcaagagattagggctcttttgcattccactttccatcatttgcccctcatgaggaggaggcttggagaggaaagattccagagacaaggtttactgaacccacaaaaaagaggaagccaagagggaaacaggtgaggtgtggacgagcaatgggaaggcagccacagggctctcagcgccaggcagcctccctccaggaaccgctgggcaggagggaacagatttctaatgaagcaggaaggatttaggtcagaaggtgggagaatttcctgactgctaaagtatcgtctgtaggggttgtgagagggctcgggctcttgcccaaggctggggaatgaactgaacagctcctaaaaagtattttaatctccaagtgtttatcgatctatccaacctgtgttcaggggccagctagttcagtctccctcatcatccagatggggaaagtgagcctcagaaaggggactggggagactggacaagacagtgaactcacctctggagcttcccccctgagaaggccccagctgcatcccaccagggaaggggcagatggtctttgtcctccggttcccgagggcgggcacgggagccgtcagcaactccagacccagcattgagcaggaggacagggtgggcttgtcccgagcacacaggccccaagagtcagtgtgacaggttcctcctactgtgctcctgcacactcccacagaggaagctccaggggcagagccaggatatagaacattggttctgtcttctcggctccgtgtcttcactgtcctggaggtttgaagggcatgctatagctaaaaggcttaccccacatcagtggctggctgtctccctgtggaatgaatggccctgggaccgtattccctcgcacgcagctcctccccagccgagcatcctggctttggccatctcaagggtcttcgctgccccgtgactcagcatccctgccatcctggcccaggctctgtgcagcctgcatctgaggaagaatgcccacagaggccggcacagggcctcaggccccgagtcaggtggaggacaattagaagtggaagaatggaggccatgaagcctgaagtggggctgggtcaacccaaggccacacagaaggcctatgacacagtagggcaagaccccaggctcctgtctccctcctgggagcaagaaattgatggtggccagggttttcctgggtagtctgagcaagcccatccacccagtctttgggtggtgagacccgccccagcctacccccaccagtggtgctgggggcttgggagaagactgagcagggctgtaggtgacccagggagctggctgcgtaccttcatcaggcccaggaggggcacgtacggccgttcactgtagcgtgtttgtggagcggggagttagaggtgacctggaggtctaaaacaggaggctggccgggtgcggtcactcacccctgtaatcccagcactttgagaggccaaggcgggtggaacacttgaggtcaggagttcgagaccaggctggccaacatggtgaaaccccatctctactaaaaatacaaaatttagccagagcacacacctgtaatcccagctgctcaggaggctgaggcaggagaattgcttgaacccgggaggtggaggttgcagtgagctaagatggcgccattgcagtccagcctgggcaacagagctagactccgtatctatctatctatctatctatctatctatctatctatctaggtagatagatagaacaggaggccagctagaagggacatagaggatgcacatcgtggaatcctatgtagcagtgacaggcagtgaactagatagaccttaaaagtttacatggactgggctcggtggctcaccccataacctcagcactttgggaggctaaggtgggcagatcacctgaggtcaggagttcgagaccagcctggccaacatggtgaaaccctgtctctactgaaaatacaaaaattagccaggcatggtggcatgcgcctgtggtcctagctacttgggaagctgagatggaaggatcacttgaacccgggaagcggatgttgcagtgagccaagatcgcaccactgccctccagcctgggctgatggtttcccctgtatttggagtaagcaaaaagacctcatttgactgggtgcggtggttcacgcctgcaatcccaggactttgggaggctgaggcaggaggatcacttgagcccaggagatcaaggctgcagttagccatgttcacgccactgcattcctgcctggacaacagagcaagaccctgtctcaaagaaaaaagaaaaggtggaggtggcgtggggagctggatatgtaccttcaccaggtccaggatcttcctttaaaatgcatactttttgaggtgagggctgatcacacagtctgataataactggacttcacccaacattggccactctgcttggagggcctgttgtaccctacaagccaaaaattgcagaccagcctccttactcctacactgatcgtgtccactagcccccaactcaatcaacccttctttatccccttccaacatcacataatcccccagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgctgcctcttgtgtcacccccatggccatgagggtgtgacagaggtggagctcagagagggagtcacaggaggccctggtgattgttagagatgtagaacaaagaaacttacaaaataatggtaagagtgattccatttaagttctagaaaaggcataactaatctacagtgattagaagcagagcagtggctgcctggggtggcggaggcggggagaggacttacagggaaggggccagagggtgacagaaacaatccacagcttgattgtggtggaagccacacggctttatacatttgttagaacttatcaaactgtacacctaaaatctgtgcatttcactgtgtatagagtacagctcaaaaagtttatttttataaaaagagtgacaggaggagtcctgggagggcaaggagacctaggatctcctcctggggtaccccagctccctgtgtgaccctgtgcagatttatgggcctgagcctcagtttcctccggtgcttccaaagacattatgtgccttggtgtcttgggggcaggacatggaaaacactttgggttgcctagaacagtcattaaagaggctctcctgacagagcctgaggggctttggaccagtcagtcaccctcaaaacaaaagttgctccactgagggcgagtaggactcagggcctgcccatagaatgccatctggagcggaggagacacacacaggttagtatggtgaaatctaagtgtagatcaatacagatggggtggtgagagaggagaattttgtgcagtctgagatatcattgcaatcaggggagacttcccgcaacaagaggcccctgcctgagcctgagattcctcaacagtaagaggaagaagatgatcatctgtagcgagggtcaaggctcagattgtgaccagcagccccaagctgtttgtccttagtctctcttccaattctccacatgcagtactctacaaatgcccctcctccataactctggcacttataaccctactccactcagttttaatcagacttgatgatatcacagcaattcctgtttttttttttttcctttagctgaagagctttagtccatcatcaggggacaaacagaaatgagactgagattcagaattgctgataggcatcagacctccgtctgtgaccaggatcagggctcggtgtgtgaccagcatcgggactcagactgggatcaggaacagggcttggtgtgtgatcagggtcaaggctcagggtgtgcccagggccagggttcagtatgtgaccaaggtcagcgcttaatgtgaccagggtcagaggtcagtctgtgaccaaggtcagggtgcagactgtgatcaggcacagggctcagtgtgtgtacatagtcagggctgggagaggccaggaacagcattggccctcactggccccacctggcctcttcctcccgctcctccaacttccctgggttgcatagccagctcatgaaatagcctagataggaagggtcaggccacaaaagctttgtggagccatctgtgcagtatttcttgaaactgggcctggggtgggggcagcaagctgtctgatgtcaaatgctgggtctcctgagtcttaaggcccagctaccccaccctatacgcagctgagggaaaggcactgggtgatggggaaggggcccatccctctcatcctcacccctcccccagaggcttccagggtccagagagtgagaaccagctcccagctggcttgagggcctatgggtcccttgggaaatgactgcaaacattcctaggggctcaagtaacagggcctaggctggccaagaagtcccccaccagccaggagccacctcatcctcacccacccttgtactccaagcttcctcatcattccaagtaggtgagatcaccctggctgcctggaccaggctcccccatgaggcccaggccccagggagagcaaagctagggtctgggaactcagggtggtgtggggtgggggatatgctggcagacacttctgccgatggcttagaagccagccttcccctccttggcctcatcttccagacctaaaagctgatgagagggtcttggcagcaggaaaggggtgggaaatccctccatgggactcaagtcctcccaccttgcctgctctcacccttcctgaatccctcaagagcagaggacttcaaagaaactaagaggagcttacagcctcatcttatcacttacctgacagaatccctgaggccagagaggagacggaattagaggccccagaaccactcccctttaagtcagtggctgggctgggatagagcccagggccctggagtcccccctgcccacacccactgctgcccgcacccaccccagcccacaccccatcacgaacagaggagatattccctcttcattccaatgcagaatggagtctggacacctaagtttggtttctgcttattcctagtaactcctgctcagactcctgcatgcccagggaggaaggtggaggggcaggaacaggacggacaggccccgggctctggcacatcctggggaacaagggaccacaaggacgggggcagtctccagacttcccctgggcgcttgaccccaggccttgcaggggagagagccagggcctccctcaggttggtggccggaggttgcagacagaggagggtgtggtcaggtctagggtgatgatggcaggaagtggtggcaggtgatggggggcgggggtatggggaggagtggctgcaccaggcagaaaggaatcctgagaaggtcaggctgggtgcccaggctgagaatcctgccctgtcagcagcctgctctggggaagtgttttccttctagcccatcccttcctgcccaccctgactcctgccagcctgcatccacctggctctgcccatgaaccttcagggacacactccaggccagaagcccagggctctcttggtggtttacaaagaatgctgactgcagggatgagaggaacggagggtgtctgggggctgctgtccagaggcctggggagtaaggactcgagggagtgcctctgtcaggaaattacatggttcactcattcctgcctccaggtctttgttcatgctgttttccctgccgtggacaccctttcccgctctctgattctctaaatcctgccccatctcccagatcttgttcatgtccaagcttttccaggaagtcttagcagctcccacaccgcagagctcgagatgtaagctcttgctgcctgacttccctgaccccacacctgggcccaggacctaacacccaaggagaatggcaaagggttttggggtatgagaggatgtttggggtgtgaggaggtctctgggcattagcagtggccaacctgatgctctcaatgtcatgctcttcctccctccccccttctctcccactgcccactccaggtctccctgacttggtcccagaccccaactatgtgcaagcatccacttatgtgcagagagcccacctgtactccctgcgctgtgctgcggaggagaagtgtctggccaggtaaggagctgaggcagaagtgtagagtgttgggatagtccccgggagtcacccagaacccagcctagctgtggctgccagctaggctgtctgcaagctgatgaccctggccaagtgccccagcctcccaggaccctgaccgtttcatcagtgagccttgcctgccccgagggagtcaggaggggaggggagcaagcgggggcccagcatttctgtatactgtacctcactatacaaggaactccacttttactgtggcacttcatctttatatgagccctgaaggcatgggttaccccctcaggaaactgaggagcaatgaaaggaactcaaaccttttggatctgagctgtttaatgagaaggttccttttgggagcccaggcttccagtggtcatacagggacccaaggaagtcctattgggtggatgtacctgcaggatagagcccaggagtatggagccatgtccacagaggacagttgtggctttggctggtccaggctgcctctgcctagtcacagcaggggcagtgagcccgggggacaaagaagtttcagttatatgttgcactggaaagaggggaaggagaccagtttccatgaacctagaaggtgagcacagctggctcgccattattcatgggtgatcctgcctctcgcagtgtttgcttctaatttataagcagttcatattctgctggaacataggtgctttgcggatacctccctgggccaaaataattagttaagattatgttatctgcttcttttgttaatatccctttatgttgaaagcacctatttttcttaattacctgctttttggacatttgaactctctgtttagtttgactttttactatctaggaaactctttagaatctcaacattttctcatttctagaacttctagttcactgccactctaagtagctgatcataaacccttatctgtctgtaacaagataaagagcttgaactagaatgtaactcaactcactccttcattgagaaagtcttgctttaaaaaaagaaaaagtatccgctgaactaagcagagtgattaggaatgttgtcgatgtacattctggtgcaagttcccaatcccatcccagactggcatcagtgtgggaactgcccctggtccagggaccgcaggctgagtaccactcagccagcctgtctgggcagttcttgtcttgtttcagttgtcttggggaagagagcataatggtcctgctggaattcctccagcaatgaggaacttacagcctccatgacagcccttccagtcttaagagaattagtcaaagtcaaactattaacatcactgcctcttcatgaaggatcctgagtgcccggacctgcgctcccagctggggagaggaggcagcctgtcctctgtcctggagggtctcctggtacagctggagagaacagccctcacctgtaccccagtgacagaaccaagacacgagtgggaaaagagccagaaggactggttcacaggccagggctgctggaggtcagaggagggagggatcagcaagggctgaggcctcagaggaggtgggcgtgggagttcagacctggagaatcctgcaaaactggagccctggggcaggagggccctctgagatcatttcaagtatgggccgcaggctggtgccagttcacatgctgcaggcagaacccagagaagaaaagggaccaattccaagtctcaccaccagtttgtggccaagctgggcctagaacctagacccttatggtttcccacggtgtgctgagccgaacagaagggcaggatttaactgaacagagggaaggaggatgttttgtttcaacccagacatagacagattccaagcctcccccagacaaggctgagggcctttcatcctggcagacagtctgagccgcctgttgtccagacattctctcaaagagagcgctaatccctacgactggccaccgctcccctctggccttaggatcggaccttaatgagtgccagggaagagcccctgaggccaacagagttagctgtcagccgtcagctaaagaggggaggggccttcagccaccccttcctgttcctaccacacatgtgtgtgcatgtgtgtgtatgtgtgcatgtgtgtgtgtctcccctcactgcagcccctcgttcctctttccacccttttccttttgtcacaaggcctacctcagttggaaatctggagtcagcaggtgacttgcgagcaggcaattcataccagacccatgttccctgaatggaaaagggcaggttgccagcctgaagccatgcaatcagggagaggtggtctggacccagtgcaagatgtagatggtatcgggctgtgctgcagtcagtgctgttagagctcacaggcaatccggatcctctatgtagagcaatcagggcagacttcctggaggaggggacttttgagttgaccctaggatactgggtgagttttggaattctgggtcaagcaaacagcatgggcaaaagtatgggtcagggaaaaagttcagcctgtttggaaaataggctttgaagcaggaacccagggtgtgtgggggagtggaagggcagatgggactagaaaagtgaagaggctttgaccagaggacttcacgtctgtttttcaggcccacacccaagacatggcatactttggtcaacaattagggctctgtcttgttgtcagagacttatcagaatctcctggataggacttttttttttcttttttttagaaagggggtctcactctgttgcccagactggagtgcagcagcacaattatagctcattgcagcctcaaattcctgggctcaagggatcagtctccaagtagctgggactacaggcataagccaccttacctggctaattttttaattttttaaaaatttctttaattaaattaattttttaaattttaatttctcactatgttgcccaggctggtctcaaactatgggcctcaagtgatcctcctgcctcgacctccaaaaagctctgtaattacaggcatgagccaaagtgcctggcccccgcaatagggctgtttttcagtggcccttcagagattgctatgtgctcctgcacctaggggctgaccccagctgagtcacctgcaggtatcagggacactgccatgcttggtaccgctttagaaagatgctgttggcagctggcggccacatggtggaggccagaaaggaggggacagccaggatttcacggggtcagaagacagaggaagaggcctgagcctccgccacagttcgaggagacagaggagaagatcttcagggacaaggagtggggctgcagaaccagtggccaagggctgggggtggggctgagggggcccatgctgggttctggtgtcactgtgccccaaccccccctcatctcccccgccgtccctgcagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagtgagtggggaggggctgggcccgtcctcttccacttctcctctgggccagggaccttggtgcctgagctcccctcccaccatgagcactctgggagacacagatactggattagagggcccggggaggtgttacctgccaactcttttcactggggcaagtgtttctcagagaagccttagccaaagctaggctggaagatggatatagaaggattggtctcaatcagggatggaaatgtctagaatacagggcattgcccagtgaggccattacaggtgggagcccaaaaaggaagtgaggggtctagagcatgtgctgtcctggagtgacccagctaggtggggagcacagaggggccaccccgcagtactcaggagacaggagaacctagaccagccaggaggctgtgccacagcagggtcacctgagcccatctcaggatggggacaggatgagaggcccagggaagactaggccctcttctttctccttctctcctctgcccctaggcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccaggttgggctggagagatggggtttggggcatgggaggataaggagttggggaggcaaagagcgaggcccgctgaggcccggcaagtgccaaggcttctggccactcagctctgctcacagtgaaggtcttctcaccagtcctcaggctgccacactgccctgcagggactgttccctccctgccccagcccctttcccatgttattccaggtgatctgctcgtggagagaaggaaacatcgcaacagtctggagagcaacacgtcctattggcctgttcacccacccatatccctctttccatcagccaccctaaatatccacaaactgtccatctgtcctgtctctttttatccattctgccatccatctcgtccctcccacctggctattagatatctgtctttcctctggtccatctagccagtggctttaggaaggtgtggacccaccctgagcagttgccctgggccagggtcaggggagaaacccaggggaaggtgggccagaaactcctgaaggtgggcgtggggtggctctgggaaacaagcagcatcacagccgctcctcttgtccctttcccagggcctgagcccaggctgctatgacacctacaatgcggacatcgactgccagtggatcgacataaccgacgtgcagcctgggaactacatcctcaaggtgggcctctgggtctggggctttccctccaacctgatgttcatgtccaatgtccccccgttcctgaaagaagcttcagcctctgggcctgttcccttctccccagctgccgagcagaggcagcatctgaggcatcacttgaggtttaggcttcccagccgaagatttaggtctcaggctgacatagcctctctttccataaagaacccagggaacctttgccccagctgtggtaatgccagaggcagtggtgatactgtctccctaagtgacagaggaccagggagagcaagaaagacttggagagccatgtggtctatcttcctgtcttcggacagggcagactttgtatcatttgggagacagatgagaggccctcagctccttatagggacccctgcaaagccaagggctcctgtgactaagacccttttagcctgaacccctcctgctctaatggacactcactccatcacctcttcccttggttgagggaaaagtagaaaagcatattaacaacacacatccagacttggtacatccgtgtaggccaggttgtcatgggcccacctggggaagccatgtctcagcctcctccacacaggtataaaatgagtagggatcattccaccagttcatctggacccactcagaagcagaaaagcagctcagtaaaggcagagcagtgaagccaggtttgcaggcggaggccttccctgcagaaagtcagcaggtggagagatgcatccggcagcggttctctgcagttccctcctgagtgctcttcagcaggctccaagcttgctcctccagggcctggggttgtccagtatattttttcttttcctcattcatccactcaatcaacatgtaggaagtcccctctgagttctaggcactagacacacaaaccacataagcaatgcagttcacagtccctgccctttgggagtgtaccaggatttgaaagttgcatccctgcatctgttcttagatgttctgcaaataaagctggccctaccctagttaatccaacatttaaaagtgttgtatcccaacagctccttttcagacaaaaagcacagatcatacttgggccatcatctcagtgaatgttgggcacgtggggctccagagcaggggatcagacaggccctcgatcagtcacctagacagggatgcatagggaatgactttgagccttggatttggggagaccaggtgttgaatcctggctcagctcctcattactgcattccctcgggcaggatccaacctctctgaccccaaatgccccatgcggggcccacctggcataggctctagctctagggaaacatccaatcttctgataagggggattagatgatgttttcttggattaccagctgcctcttctttcccctctgtgtctctctagcagtgtgtctctgttctccctctctctgtcacctctctgtctgtctgtctgcctctttaccaccttctctggtgagcagttgaggtgcagcccccctgactagactccctttctccctgtttctcttcttcctcaggtgcacgtgaacccaaagtatattgttttggagtctgacttcaccaacaacgtggtgagatgcaacattcactacacaggtcgctacgtttctgcaacaaactgcaaaattgtccagtaagagtttgcccaccacccttcctggctccgtccctttcctgcctggggagcaggcaaggccacctgagatacctaagatacctgcactttaggtcaccttgatggccgaacgcagctgcagcagggcccatcaaaaagagccttgtccgtgccaaccccaagctgagtgtttacggtggggctcaggccgtagggtgttgatctggggctgcatcctgtggctccctgagatgtcccaagtgaaaaccagcagaaggcagagtcatttgatgcaaggccatgagctctgcagtcccagttccacagcttcctcgctatgtgacattgggttacttccctgagctactttcctcaactataaaataggtatttccacataggctggcaatgaggatctacaggcctgatgtctgcatgttcacagtggcacacagtgaacagcagctgtgatcattagtgtccttttcaagtggactggattaaacagtcacagattagaagtgattctggttcaaaggagccatcttcagtccctaggcccccattgtagaagaagtgcctaaaatctgggcttgggattttggcacatgctgctgggtagggtcctcagtctttctcctgattccccatgtgaagtagtttgcagagggaccccttgcttacaagctcacaaggaaaccccaccacactccagatcgaagcaacccttttccattaaaaaaaaaaaaaaaaattagtcctagagctttcagctttagttcatcaactgggagaaaggtggtagagatcttaaggcccagagaggtatctttccctaaaagtgtgtacttattaatggatggcaggtatgagagattaagcctatgactatggtcagggtgtggtgtatggccagggtcaggattcagtctgtgacaagggttagggctcagtgtgtgacaagggttaggactcaatgtgtgaccaggatcaaggctcagtgtgtgaccaggatcagggttcagtgtatacctagggtcagggcccagtgtgtgaccagggtcagggctcagtctgtgaccagagtcagggcccagtgtgtagccaggctcagggctcagtgtgtgaccaggatcagggctcagtgtgtgaccaggatcagggcttagtgtgtggccagggtcagggctcagtctgtgaccagagccaggctcatttagagacagccctctcacacttggttgctaccatcaacctaactgttcacagcatgctgccaccacatcatgaatattaaaaatgggaacagcagcctccagttcagtgcagagattaggttcctcatgagtagaatgagatcagaattccccagggcacacagcatgtttgaaaggacgaactcctgtcccatcactggcagtttggctctttagcaggcctgggtttccagcacattcctgctcctcagggcctgtcttagccattcaagacccagggtcacctaagtggtagaagccattctagggaaggaggaggaaggaagaagggggtatccaggaaacaaaggaggctgctgggggctcggggaggcagggaatccctcctgctgctgggaaagggggatgggaacagaaacagcatcccacgtgccaggcgcctggagcagccaggagggctgtcggcagggcagatggagaagcagcctgcgcggccctcccagctccccgggggcctgtgggcagcagggggagccaaagcccttccttccaagagctctttacataagtgcttggaaaggccgggccttattagagtgtctcagtctctgtgaccctgaccgcaggcaggcagctgggccagcgtgcacaggaagctggacagagcgttcccagaaaggccacgggactgacgcctgtgggtttccatcgtgtttctggaggaaaaaggaggcttaaaaaaaaaaaagtactgagttagaaaaaacaagaaagtatttccagacagtagcagctctgctaatggcctagaaaacaatctgggactagggcatggggaggggaatgtgctgagactgtgccctgggtgggtgggagtccatcaaacccctccttttggagctgggctgagggggtcggaactttctcttgagggaaatgtaggcccatgcctgccctgccacgagggatctgggctgtgggagggacgccctggctgaggaggccacgggggcctactttgcagcccctcattgacccactgtctttccttcctcagatcctgatctccgggagggacagatggccaatctctccccttccaaagcaggccctgctccccgggcagcctcccgccgaggggcccagcccccaacccacaggcacggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttct

SEQ ID NO: 36432 - DNA, 2479 bp, Homo sapiens
caggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccggtgaggatagcgcgcgacctagggctcaggcaggggcacctgcgtggatgcgcaggcagaagcagcgggtcggcgcggtccgcaagttcctggaccggcagcttggctcggaaggctcggtcctccactgagacgcagggggcaggcagaacgcccaccccggcgagcagacagatggtgcccgcagggaggcagcggaacagaggctccggaggagccggagctgcgctgcgggcactgcgggagcccctccaaggaggccatgctggcgctgggcggcccgcccaggccctcaggagagggtgaaggtccaggacagggatcgggcgcggcccgccaccacttaaacccgcgcgcgccaccagaggctgccccagacctcaaagggctttgtttccatcccacccccatcgccgaaaagtaatcgtcgccttacctttaagtccccacctggcaaagaaggtccttagttcctccacctccagctctctcctccgtattctggaggtgacccagctgcggtgggggcgtgggagatgtcaggagaccactgggttggttcttcctgcacctagcccaggcttcgttaggactccagctccctgtcagtcctgcccatatcccagtcaggagacaatatccaaaccaaccccttacttcaccagtgctccaggggaggcccacagttcttcccttgagactgaaatgctaccaaggaagcctccgtgtcaggtcccttccttctgggcttcacttttccatctgagagctgggtgcaaaggatgggctgctttctgatgggttaatcgagacgaggttcccaggggcctctcagcacacttgcctgactaaccctttccggaggatgggatctgggtaaggcaggccctttcctgttcagcagcagggatgagttacagctctgtaggcgggagccacctgtcagcccccccggggctggtgactccattcccagcaggccgaaactctggtccagaggagatagtccggccttggaagttttgcctccttccttcatttgtctcctaatgtcttaagctgcctgtccacagaggcactggctttgcttgtgtgcccctccgggcaggccacaggagggaggaggcagtaaggacctggcaaaactgcaagccccagggctaagtgcatgaaaggtgggaattcaggcatctgggccaggcttctaggggagaagctgtaaaagggggcaagggtcttctgcgccatcaccagcattagccaacagtccagatgctagctgcagcctggccctgccctgccttccttcctctgtccaacattttctcagtagccctggagatggaaagggaagctcctcccccacagagaaggagctcagagttagaaataaacaaaaacatcccagaggcatggaaaggtctcctgcccctcgggctggggggccctgggccagggactttatctccatggcatccatcccttggacctgtaccaccgaatactctggaggacacagaggcatggcaatggtggggcacctgtagtcggtggtgcctcaacaggggctaaaagccacatctctctgttccagtgtcagcggccggagcggcagctcagcaagtggtggaccaggccacagaggcggggcagaaaggtctggtggggctggagggaggcgggcaaccccagcacacctcccactccccgccccatcccggctggggcccaggcacatcctctcctctgcagagccctctgtccacaatgccccaagcaggtcccccgggagacccaggccaggctaagcctacaggcactgtggttcccgggccctgcctgacctgccctctctcccgcccttccccagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagccccc

SEQ ID NO: 36433 - DNA, 6058 bp, Homo sapiens
gcagagtgcgctgcgtttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatggtgagaaccctgagcccagcccttcacctccgcaggcccgcgccctcacccccagtggcagtgccatggttgccccgtatgaacctagggctccacagtgtggggtttttgcaggtcagcttctgcaaggcaacctgcactcttccaacccgttcatccttgtagcacggacgcctgaaggtgaagacgtcagaagagcaggcggaggccaaaaggctagagcgagagcagaagctgaagctataccagtcagccacccaggccgtattccagaaggtggggccctcagaggtagccccgaccccaagtagctcccttagtatagtgcagaggccaagagctggtccctagagtcagactgcctagatccaattctgggttatctcacttataactgtatgactttgggcaagttgctgaatctctttgggcctcagtttgctcatctgtaaaatggggctaataattgcacctactgcataaggctgttgtgaagattaaatgagagaatacctgtaaggccataaagcatggttcatagtacctgttgtataatgtgggattcacagaatattggatggttttaagtttacgttatttagtcctgtagtgggaaaattatatgatctctaaccctgccacctatcttcttagcgccaggctggtgagctggatgagtccgtgctggaactgacaagccagattctgggagccaaccctgattttgccaccctctggaactgccgacgagaggtgctccagcagctggagactcagaagtgcgtagggattcaggatctcagaagactgccctggccctgcgcctgcactgcctgggtctaggggtggaggagaaatggggcagccagtggcatagatggaggatagtagggggctgggtgcagaaagtgaggggtgagctgaggttgactgtaggagagccctgaccccccccttcccttctgggtacaggtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactgtacgtggctgcagattctgtccccacagccctcacctgcccacattctggtactggggcctcagtaaggcccagaatggggagggatatccaggatgggtccactgagctggtgctgaaagggatgttggagccaaatgcatcctccgtggagtgcactgaggtgtttctaggggttcctgaggggactctaggggtcccagccaggtagctcctcttgccctgcctctaagatatgctgtcacctctcccctccagttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaaggtaaccagggtcagggatgctcaggaggactctgcagtgccacccttccagcccccatgcctgaccctgttcctgaacctgtcactcaggtttattgagcacctacttcatgcgtggctccaggggtgcttaagaatcagtccctggctgaaggaagcttaagtgtctgatggggaagataaaactgacatacgtagcccctgtgcaaggacagcatataagtgagactgggggctggaagtactccaaggagagggtagggtgttggagtggccaggagctcaccagtgtcctgaccacagccccatgcctcctggaaccccacagagctggagctggtgcagaatgccttcttcactgaccccaatgaccagagtgcctggttttatcaccgttggctcctaggccgaggtgagcaatgaggaaaggggctgggtgtttagcgcttaataggaatgggagagggtttaaagaaatctgacactgtctccccgcagctgacccccaggatgcactgcgctgcctgcatgtgagccgggacgaggcctgtctgactgtctccttctctcggcccctcttagtgagtcctgcagcttttgtcaagagcactgtgggactgtgggcctggtgctgatggggctgaagtctttgtcctttgtgccaggtgggctccaggatggagatcttgctgctcatggttgatgattctcccctgattgtggagtggaggaccccagatggcaggaaccggcccagccatgtctgggtatcccaggattggtggggcagaagttggggtctggggcagggctgggtgggacagtcaaaaaagtggttaggctggggcatttccttgacccagtactcccagctctgtgacctgcctgctgcctccctcaacgaccagttgccccaacatacatttcgcgtcatttggacagcaggcgatgtccagaaagaatgcgtgcttttaaaaggtgatggaacctgcagcctccaccccttgcagcagcccccatcactcttttcctctcaagggtgcaccctccaaccacctactctttccccaggccgccaggagggctggtgccgggactccacgacagacgagcagctattcaggtggtgatagggaagcacaaaacaaggagaggggctctggactctgggcatcaggcagccagggcaggaggctggggcctcaaggagctgtttcagtctagatactgggaatgttgaccagtgcttcagggctgtgggcctcaactcctccccaccctgcccaccctcaggtgtgagctgtcagtggagaagtccacagtgctgcagtctgagctggaatcctgtaaggagctgcaggagctggagcctgagaataaatgtgaggccccattccgtgagagtctgctcccagagcccgctgaggaaacccctttccagtgtggccctgagaggacagcaggaaggcctcaggaggatgggagcagaggaggttccaagagaaaccctccttttccctgccctctcctcagggtgcctgcttaccatcatcctgctgatgcgggcactggaccccctgctgtatgagaaggagaccctgcagtacttccagaccctcaaggcaagttctgtctgcagaacagaccagggggaggcccagcaggcaggaggcaggcagctgacatgcataccctgcccacctcatccactccaggccgtggaccccatgcgggcaacgtatctggatgacctgcgcagcaagttcttgctggagaatagcgtgctcaagatggagtatgccgaggtgcgtgtgctgcacctggctcacaaggtatgggctgccatgcatgccttcccctggccctcatcccgctggcctccccacgtccctgactttgcccccagtctcaggtgcctttgtggacttccaatcaagatagagttcatccctgcctcccagcttgctcctcttccaggcctttctgtcactcagcccattcttcttcttgccactcactttcaaatcccgagtcaccaggacctccttgtgctgtttcttccccaggctggtcacagcttcatcttccttcagagtgaccgctagcccactcctcccacacattccagcacatctcaccctggagcaacctccaatacctgaaggccaaatactttccagagattcctgagaagttgtccaggctccactttcctagtccttcccaacacattagttttatcacatcaccacagcccacctccattcctgccaaactcatctctgcctcatcaggaccagtccccatgggggaccagtctttgtttacccagcaccctccactggcccctgtacctccgaactccaggcctcctcctcctcacccaccccactggttaccccactcgcagcactgtctgtcccacgtcatgtactgctgtgggctgtaaggtcagcttcccacatgctcccatcctcttcttggctggggtccccaagggcctgtggggcacagagggcatgtgcctaataaatgctggccgaggaccctctcccaggtctcctgggaagcccatcacctccttcctcccttcaccccccaggatctgacagtgctctgccatctggaacagctgctcttggtcacccatcttgacttgtcacacaatcgcctccgaaccctgccacctgcactggctgccctgcgctgccttgaggtaaagtacccatgtctccgtccctgtcacgggtggttcttttcctcttcctctccctcagaagtctgcccatcctacaaggagatgtgcaggaccctccaccccgaacaggtaactgcgtgccttccacctccatcacgcagcctgaccctgtgagcccctctgtgctctgtggacccgtcaccctgagctcctcagttgctgaaccatccctggctgacagcgcctgtcctgcctccctgccctccctgcccccaggtgctgcaggccagtgataatgccatagagtccctggacggcgtcaccaacctaccccggctgcaggagctgctactgtgcaacaaccgtatccttccttctgggtgcctttcagacagtgggtaaagtgaggtgccaccctgggaagggacagacagcaggcagggtatgtgccaccctcttgcagggcaggagagagggggctctgtagtgtgagttgaagggggagagcctggggctgtcgggctatcactgacctgcactggtggagttgtgcggagtggacttcctcaagtcagagttcacaaatgggcagcccgcagctgttcttcaggtctatgtagttttttgaaaatcaggaactttcatactttaaaaaacatctagagttctaattcctctcttaaaaattggaagttagagcaaccttacactggtattttcactcagcagcccttggtcattgctgaatagtaaatgtctctttggaccaggctagatttccaccttatcataccctgcaccactcccctgatactacaccagcttgcgtggggtgttgcggctcattctttcctggctgaccctgtgggtaggcatttgcagtccctgcctagagcctgactccctccagggagcatatgagatgcccatcaaacagacttccaggcagcagtccccagctcttgagggtacacaggagcaaataaattgggaggaacctgccaagctttccttgactctcctgaacaaggcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctacc

SEQ ID NO: 36434 - DNA, 15982 bp, Homo sapiens
gcgccccgggcgggcacagttacgcgccgcacggatcatggccgcagccgctctggggcaggtgggttcgcagccccgcgccggggtctgggaaataaccgggggaggcgcacttccgggaagaccactggcctgcagccggtccgactcggcgccgctcctcccgccctggggttccgctgcagggcgcggaggaggatggcgccctttggaaaggagcacgaggctttaatggggtgagggggagcaggtagacgcggatgaggtggggcaagtaattggcggggaggtaaaaaaaaaaaaaaaaagggaaacatggtggaggaccctgtaatgagggaggcgtgggggtggggaggttgtgatttggggagcggagccctggggtgcggtggggcatcagcctgtgcgggagctggaataaaggggcccagacctccagggccgggtgcaggtgaaggcagagttggacctcaagtctcagctctgggaattggactcaaggtcctattttcttggaatgaaagttgaaaaaaataagagatggggattgctgtgcttcccaaactcctatctgaagctttgcacctggattggaaatcgaggcagcgtctcatggtcaaagtgacagatgctgcaggctggctgagacgatcccttctgactgtgcgatgtcaaacagcagcagcgtttcccagagtctatgatttcagagaacaaggtttctcagtgaggaaggaaacagccaaagaaaggggtcattacaagccttcacagctgcggtgtaaccttgggagaactgtctgttaactttacacctgactttatttgagtctcttatcctagctgatgaatgtcagggcagaatttcacttttttcggctcttagtgactgatagggatagtcctgggatacctggggtatgtgggcaatctgggctttagtggtgacactcctggactgtggtggggcagtactgggctttgacaggtccacttgggactgatgtggaccgtctcatcatggcacagttctggtgtcatagaatggccctgaactcatgatgggacattcctaggctctgatgaagatagagatatcctgtaatggagataattgggctgagtcctcagctgtgatggggacagtcccggggtgtggagaggacagtgctggaccatggtagggacagtctggaaggtactggcctagacagcaacatagggatagtcctggggattgaaaaagacaacaatgggattttttttttttttttaatttcagacctggtgaataggaaataagccctgatatttggcagagacaatgctggttataatggggaaaagtgctgggctttggataggggacattcctgagctgtttgggacagtacttggctctgctggggaccagttctgataagttacaggcacaatctggacttgtgatgtggagcatcttgggccatcatagaacagccctggtctgtgatgggggagagtcctgggctataaagggggcagttctagacgtgatggggtcatgtgtgggctgtgacaagggcagactgcggtatgatggggtctctccggggccgtgatatggggacagtcctggagtatggagggcactgctgggctttgacagtgacactcctggtctttgatggtgatactcctgggctgtatgggacataatggaggttctatcacattatagagacctgccctgtgaacccccaaacgtactttatttctttgtctcgtcttttctttttgaccgagtcttgctctgttgctcaggctggagtgccgtggcacgatctcggctcactgtaacctccgcctcatgggttcaagtgactgtggtgcctcagcctcccgagtagatgggctcaagcgatccacctgcctcagattacaggcatgagccaccatgctggtcttttttttttttttttttttttttttttttgagagacactctatcactcatgctggagtgtagcagtgtgatcgtagctcaccacagccttgaccagtaggtcaaggtgatcctcccaccttagccttctgagtaactggaattacaggtgtgtgccaccatacctggctaatttttaaattgtttgtagagacagggtcttgctatattgcccaggctgatcttgaactcctggcctcatgcagtcctcccacctctgtctcctaaagtgctgtgattacaggcatgagctactgagccagctgcctactttctttctttgttttttttctttttaattgagacagagagtcttgctctgtcgcccaggctggagtgcagtggcaccatctcggctcactgcaacctccgcctcctgggtttaagcaattctcctgcctcagcttcccaagttgctgggactacaggcgcccgccaccacacccagctaacttgtattttctgtagagacagggtctccctatgttgcccaggctggtcttgaacacctggcctcaagctatcctcctgcctcggcctcccacagtgctgggattacaggcgcgagccactgcgtgtggcctctttctatgattagatctattttggcatctcttgtttcttggcgtcaatttctgtttttgtttttttttttttctgtttgtgcgcccctttctgtgtttctttttctcatccttcctcttccatctcttactctctttttttcatcttggctctgagggcagctctcctgcccacaggctggctgtcgcactgtgtttgtgtctctcatactgtgggtgtcctatccctctgggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcaggtaatcagagcccagttgatcgaataccttcagagaataagcacctgtactcctgggtctggcggaggaggggctggggaactggactcctgggtctgagggaggaggggtggggcctgtactcctggatgtaagggaggagggtctgaggcctggactccagggtctgagggaggaggggctgggggcccagacttcgggtctgagggaggaggcagctagagtctggactcttacttaggtctgagggaggcgggcctggggtctgcacccctgagctctgggggagcaggacctgtcggtccttggtcttctaaggcctgtcagcacttgggtacccggaggccttcacttacctgtgtgccttccctggttgttttcttgtctgagctgatctccaggctgcgaccaaaggtctctggggtgggaggcgcttgcgtttgactttgccgcagcatggaggagggggcgggagctgactcagctctttccagcgagccctcgtcagggcagggaggggacttggcctccttcaggaccacctgccccgtctagaatggactgaaactgggacagaacaggcaggccagtgggacctccaagtgcaggaggtggcgagcgagctgccagggcccctgctgtgccccactcaccccctctctcacttctttctccacccagatctgggcacgaaagcttctctctgtcccttggcttctgtgtggtcccagaagatatgcctcctccagtttcaaggtgaaaggagggaactcgatgcttggctctgagagaggagggggctggcagctggttttgggcatctccaaaaggtccacagcccagagatggcagtgagtggtggtagcttaacagcctgccattgggccgcagacaagggatgaaactgcatgtcccagaatcctccagggtgacaggtccttcttctctatgggtctgaggcccagggcttcatgggagttgtagtttttcagctgggaggttgtggccagattctaggatacccctgtctttcctcaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcaggtggcatggcggccggcctctctccctgtccctgtctgcatctcctcctccttgctgtgtctcttgccaggtgtacctctcttggtttgtttgttgtgtgtttctcctttctgtgcattcaccatttgttttctgaggccttccatgctccaggctcatgcttggtgatgctgggttccccgagatgagcagacccggttccttcacttggaaaaccccatgctgtgggcataactcagtatgatctgtgctctgatggaggccctgtggaggccagtagagacccccagcctcacttgaaagaaagcatggcttcttctggcatagagggaagcttagagggggatggtgggagaggtgacagggtgatggtaggaaaggggacagccggggggctggcgggagagggacagccaggatgatcgcgggagaggggacagccattggggggggagatggtgggggagggcacagccagggggatggctggagaggggacagccaggggagggatggcgggagaggggacagtcaggggagggatggcgggagaggggacagccaggggagggatggcgggagaggggacagccaggggagggatggcgggagaggggacagccaggggagggatggcgggagaggggacagccaggggaggcatggtgggagaggggacagccaggggagggatggcgggagacggacagccgggggagggatggcgggagacggacagccgggggagggatggcaggagagggacagccgggggagggatggcgggagagggacagccggggaagtgatggtgggagagggccagccgggggagggatggcaggagaggagacagcccaggggggatggcgggagaggggacagttggagatggcgggaagggggacagtcggtgggggatggcaggagtggagacagccaatccaaaccccaaacgggagtagagcctggtacatttgggagaaattgcggtgttggagcatggttaaggaggctgaaaatgtcagggccatggaggagctgaggggctggggccttgtccaagggtgctgggagccactgagggctctgaggaagggaggggcagggccatgtctgggtatagtaagagccctctcaggccatgtggagggcaagagttgcaggctaggaagccgggctggtgaccaggtagaccttgggcctgtccccacatggggacccaggaggaggagcggctttgtggcacctggtgagcctgagatactgtgaagtttctaggagacagatccaggaggcatttggttttaggacttatagctgcggctgaaagcaaggtcttcagaaggaaactttggttgagacaagatttaagtgagcatcttacagctccagtaactggttagcaggttggctgattttagtcctccagggcacagttctgtggcatgaagacttttattccattcctttctttcctttccctccctccctctgttttttcctttcttccttcctttccagaattttaaggttttgttttttcccctctcccctcccactctggacatctaagcaacaccagtcgattctgtacagagcacacacacctccaatcacagccagacactcctgccagtacataagcgtgatgggcaggattccgcctgctgagcccccaggaagctggttacttggagaccaccacacacttctcccttcagcccagcacagcagttgtcctctggctggggacccagtactttttcttcagctgagtgagagcagaggaagcctgtggccctggcagacagaacgcactgctgtgatcccgcgggtccagggggcggaagggggaggatgagggagtaggacaatgctgtccctatgtcacccacactccagggcatgtgtggattgcaggccgaccacgtgtattattttttattttattttttcttatttatttatttagagacagagtctcactctgtcccccaggttggagtgcaatgatacaatctcgctcactgcaacctccgcctcccgggttcaagtgattctcctgcctcagcctccccagtagctgggattacaggcgcccgccaccacacccggctaatttttgtatttttagtaaagccagggtttcaccatgttggccaggctgttttcgaactcctggcctcaagtgatctgcccacctcagcctcccaaagtgctgggattgcaggcgtgagccaccatgcctggccttattttttattattgtggtactaatacgcatacataataacacacagcatcaaatgtgggattccaaccattttatttgtttgtttgtttgtttatttatttatgagatagagtttcactcttgttgcccaggctggagtgcagtggcacaatcttggctcactgcaacctctgcctcccaggttcaagtgattctcctgcctcagcctcctgagtagctgggattatagacatgcaccactattggctaatttttgtatatttagtagagacacggtttcaccacgttggccaggctggtctcaaactcccgacctcagatgatccaccgcctcatcctcccaaagggctgggattactggcgtgagccacggcgcccagcctccaaccattttaaagcccataattcagtggcaggcaatgttatgcaaccatcagcaccatcaaggttcagaactgtttaatcccccatacctattaatcagtacccattgtccctcaccccagcccatgacaaccattagtctgctttctgtctttgtctacctgtatttgtttatttattatctttaaataatagggatggggtttcaccatgttacccaggctggttttgaactcctgagctcaagtgatccacctgcttcggcctcccaaagtgctgggattacaggcgtgagtcaccaagcctggccacctgcatttttgttgttgttgttatgactctttttttgagaaagggtcttgctctgtagcccaggctggagtgcagtggcacgatcttggctcactgcagccttgacctcccaggctccagcgatccacctgcgtcagccttccaagtagctgggactgcaggtgtgcaccaccatgcccagctaatttttattttattttatttttttttagggatggggtcttgttatgttgcccagggtgatctcagatttctaagctcaagtgatcctcctgcctcagcctcccaaagtcctgggattgcaggcatgagccactatatccggtgtatccgggctcttttacctgggttttgttttgttttgtttttgagacggtgtcttgctctgtttcccaggctggagtgcagtggcatggtctcagctcactgcaacctccgcctcctaggctcaagtgatcctcctgcctctgcctcccgagtggctaggactacaggcacacaccaccttgcccagttaatttttaaatcttgtgcaaagacaggatctcactttgttgcccaggctggtctcgaactcctggcttcaagcaattctcccaccttagcctcccagttctggggttacaggtatgagccatcatactgggcctggaaattcttctctataccttaaagcttaaagagctttttccatctttcttgcagcctcatgctgtatcatcctaacaatgcacctccttaggcaatcccctactgttggacacttaggttgtttccagtctattataaacaattttgcaataaagaatctagtacagggccggctgtgatggctcacctgcaatcccagcactttgggaggctgaggcaggtgggtcacctgaggtcaggagttcaagaccagctttgccaacatggtgaaaccccatctctactaaatatacaaaaattagctgggtgtggtggcgggtgcctgtaatcccaggtactcgggaggctgaggcaggagaattgcttgaacccgggaggcggaggttgcagtgagccgagattgcgccactgcactccagcctgggtggcagagtgagactccatctcaaaaaaaaaaaaaaaaaaaaaaaaggaatccagtacacacgtcccttctttagtcacttgtttaagtgcaaatgtatctagaggctcaatttcgggaactgtaggtcaaaggatatgtatgcttgtaatcttgatacgtatcgccacatctacatctacagggtgtgtcagtttccacacccaccagcagagcctgtttccataccttggacaacccttgtccaagttttagatcttttccaatctcccatgtggttttaaaggtatctcaaactaattttaatttgcatttttctccctagtgattaatgaaattgactatcttctcacgagcttaagggccacctgtatttccttttgtgtgaactgtccatttgctaggctgatttttctatcaggttaggttttaaaaaattcatctggggctgggaagaagaggcagggggattgcttgagctcaggagttcaagaccagcctgggcaacatagtaagaccctatctgtacaagaaattggaaaaaaaaaaaaagtccagtcgtggtggctcacgcctgtaatcccagcactttgggaggccgaggtgggcgcatcacctgaggtcaggagttcaagaccagcctggccaacgtggtgaaaccccgtctctaccaaaaacacaaaaattagccgggcgtggttgtaggcacctgtaatcccagctacttgggaggttgaggcaaaagaattgcttgaacctgggaggtagaggttgcagtgagccaagatagagcacttcagcctgggcaacagagtgagactccatctcaaataaaataaaaaataaaattcccaatccaagatataaaacagttatttttgtttccttctatagcttttatggtgtaatatatatatatatattttgtttagacttttaatgcacctggaattttttctggtgtgaggtgtgaaatagagattcaacgtagtttttctctagatggatatttggttatctattccattattcagtctgtccactcatatagcagtgtcactctgttttaagtattgtagatttataatgttttactacctgatatggctactccctgcccctgccccatcttgcccctcatttttgtggtggtggtttttatccccccaaaatattgtagctagttttgcttgtcttccattcatttatctattcattcatcaaaaacccactatgggaaaaaaaaaaaaagtctggctgggtgcagtggctcacccctgtaatcctagcactttgggaggctgaggcgggtggatcaactaaaaatacaaaaattagctgggcgtggtggtgggcgcctgtaatcccagctacccaggaggccgaggcacaagaatcacttggacctgggaggcggaggttgcaatcagcagagatcacgccactgcactccagcctgggtgacagagtgagaccctgtctcaaaacaaaacaaaacaaaacaaaacaaaaaaacactctgtgccaagcgctgcctaccctggtgcatgggactgcaggagaggctgtctggtaaacgtgtcaagggtaatccctgccttccaggctcttccactctgcagtggagcagatgctgaacaagcaaacttggaaccatggggcagtgatcagggacagagtctccagaaaaaaaaaactaggtcccaggctggagtgcagtggcatgatcgtggctcactgcagtctcaaactcccaggctcaagtgatcctcccaccaccttccaaatacctgggactccagtcacgtgctaccacgtctggctaattttcgtattttttggtagagatggggtcttgctataatgcctgggctggtcacgaactcctacactcaagtgatcctcctgcctcggcctcccaaagtgctgggattacagtgagccactgagcccggtcgtgtcctttgctttctagagtctccgtgtgtctctacctgtttgtctccctgtctatatctgtctctctttttctccatctctctgacccagctgctaaatctccccggtgctctcctcttggcctccatctttcagttgtctgtgtctttgtgtatctgtctctgtctgtcttggtgtctctcatgactgtctggagaagtctctgagcctccccacccgcgtgtccccgcagctgtttgagggcatgaaggcgttcaaaggcaaagaccagcaggtgcgcctcttccgcccctggctcaacatggaccggatgctgcgctcagccatgcgcctgtgcctgccggtgaggggtcccggtccaccggggtggggaggagggctggggccggggcagcaagggccccttgactcattcagaatcccacccagagtttcgacaagctggagttgctggagtgcatccgccggctcatcgaagtggacaaggactgggtccccgatgccgccggcaccagcctctatgtgcggcctgtgctcattgggaacgaggtgggcccaactccagggctgggaagctgggctgcgggggttggattctgcagggcaggggtggggtcctggaggcctgggcctggggacgggaagggactgggggcctggactcctgacgctgtccctttgcccgtcgcagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggtaagtagcacccccatccccagaacgactggcgcactgggcgttggagacacagggaccagcgtgcgtgctttcggccatgcctctggatgtcacatgaaggtgacatcatcagcaccgtgcagggctcagtgctaagtgacctccctggtccctgaaaacaaaccatggaaggaaggaggaggggattatttttcagatggacaaaaaggctcacagatgggaaggcattgggtggaggtcagtggggaaaccaggactggtccctggaagcctccaggagtgaagcttacactcagctcattggcttctcgccccagaagcctcccctgatcccccaggctgggctgcgctccccatacccagctcccacagtcgtttgagcctccaaagcccctcacccccgtgtggactttctgtgtaaatctgtctcccagtggcctcagctcagcagggcaggaaggagacagctgggtctcctgggcaaccaaggcagagggtgggcactggcgtgttgggacaggaatgtggccccagctgggggtgcattcaggtcctttcagccacatcctgtgaggtctcctgagggccaggccctgtgctggcagaagctggggacacagatgagtcagccccgagccctgctctcctgggtctcccaggctggtgggagccccagtattcggagctgcatgttctctggtgaggtgacccagggcattgtgaaagccttcacagaggccagaggcggtggctcacgcctgtaatcccagcactttgggaggctgaggcgggcagatcacgaggtcaggagatcgagaccatcctgattaacacagtgaaaccccatctctactaaaaatacaaaaaaaaaaaaaaaaaattagccgggcttggtggcgggcgcctgtagtcgcagctactcaggaggctgaggcaggacaatggcgagaacccaggagacagagcttgcagtgagccgagatcgcgccactgcactccagcctgggcgacagagcgaaactccatctcaaaaaaaaaaaagaaaggtttcgcagaggaggcgacccttcaactaggtctgacgaggagggaggagggggtttcctgggtacaaaagtcagcaaactgtttccagtcctgggaaccatgtgtacagggacagaaggaataggatcacagaagatgttcaggttacaaaaataagtttgggttttgaaaaatgcttagcaagtattcattagacccaggcaggcctggaatgccggaaggaggctagggtcttgtcctggggcactggggagccatgggaggcttgttagcagctgaggggagaggctatctctgggagagagactcagaaagtcatccaggtagcccagttcactgggggagtccagggaaggtccagcacccagcctggaggtctggaaacacctctcgaggaggtgacaacagaaacggttttggagccaggcgcggtagctcacgcttgtaatcccagcactttgggaggccgaggtaggcggatcacttgaggtcaggagtttgagaccagcctggccaacatggtgaaaccccgtctctactaaaaatataaaaagtaaggccgggcgctgtggctcactcttgtaatcccagcactttggggggctgaggcgggcatataaatataaatgtgaatataaattagccggacatggtgctgcatgccccagttactccagttactcaggaggctgaggcacgagaatcgcttggacccgagaggcggaggttgcagtgagctgagatcgcaccactgcactctagcctcagcctgggcgacagagcaagactctgtctcaaaaaaaaaaaaaagaaaaaaagaaaaaaagaaatggttttgaatgacagctgaggatttggtcagtatgaaatgggtgagggctgggcgcggtggctcacgcctgtaatcccagcactttgggaggctgaggcgggcagatcaccaggtcaagagaggctgaggcaggagaatctcttgaacctgggaggcggaggttgcagtgagccaagatcgcaccactgcactccagcctgggtgacagagcgagactccgtcttaaaaaaaaaagaaaagaaaagaaagaaaagtgggaagagacaggagagaggggacataaccatttagggtcctgatgccaaatgaaaagtcaaggattccatctcaggggaactggggagccctgtgagagctgtgagcagggagacgggagagagtaggatgagcctcctctggggctgggctggggaaggatggggctcccttgccccacccaaccagactgccctccaccaggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatgggggtaagcccacccatgacccagcccgaaccctggtggaagtgggtggcaccatcattcctggcaggttacaggccccagggattctgggatgggggaagggggtggctcttaagacggcggtgctagggggtgagaggtaacatcttccaccccttacacctgccctagtgctggagctggtgacgcccccgctgaatggtgttatcctgcctggagtggtcagacagagtctactggacatggctcagacctgggtgaggacatggcatcttctggtgatgggcgccatgtgccaggggccagggcatcagagggctgggactggggcacactggcatgtctctgccccttctcctgggtctgtctctcccgttgggcctctgtctttctcactatcctcagggagggagaggtggaggtctgcagcagggcaaccctctggggacacgtgtctctgccaactgccctgcagggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacagggtgaggcggggctgccattgtgggtgggagggaaggaggggaggggcttggtcctcaccgcaccttctgtcccagaacctccacattcccaccatggaaaatgggcctgagctgatcctccgcttccagaaggagctgaaggagatccaggtgagctgcagggagctggggaatgggctgggagcttgttccctggagaagttggtgtcccatgagcccctggactaacagccagcctccttcagtagtaccaggaacagataatggcctttcttattgaggccctggagagtgggctttctgtgctgctctgtggcctggaaaaccccttggggctaaatcaccctttcctgggagctcccggagccctggatatgtcttcagctttggaaaccccttcctgtgatcctctgcggctcctgggtgccctggtaggagaaaccccctctccgtgggcctctgaggcccctgggtgccctggtgggagaaactccctccctgtgatcctctgctgccccgggtgccctggtgggagaaaggccctttccatgaatcactgagaccttagccagccctctggccatctcagaggttggcctcccaagattccctggagccctgggctatccctttggccggagaaagcttcctcccatgagcctctggaccttggcccctctctggcaccagactgtttaatcccataaatctctgggggtattcccatcttctgggccaagatctctttcccaagaatctctgggctcctttcccagacctagagctacatttctgtaaacttttgtgcatcaggacctagaactacacatcctctgactatctgggctttctgagctgaaagtgactttttccaagagccttagaggcctggccataattcctgtcttcagaactacatctcccggaagcctctgcgccgccttagccttgattccccgttcccatcattgttggggccctctgggaagtggactacatttcccgtgagccgctggggcacagctccgtaggcactcggcctggaacaccccagggcctactgggagttgtagtgcagcttccacctcacgcactgcctccgttgttccgcagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacacac

SEQ ID NO: 36435 - DNA, 33639 bp, Homo sapiens
gccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtacgaggcccgggctggcggggcgcgcgggtcgggccgcggggggcgtcggtggcgcggggccgggcctgggctgcgggggtcttgagggtggcggtggcgccggccggagccgggggacggatctcggaggtgtctgggcttgggaccgggatgggggacgcgggccgctgggggctcgggtggggtagcgggtgcgcggggcgcgggggcgctgtgcacagcgcattggcgtgatccgccttttcaagtttcctcttgctctttctctgctcttgcactcttagcgcttttcccctctcagtctaatgtaaataactgaaggtttgaaaagccagcttgatgttcggtttcagctgcgatattatccccagcgagcctgtgaagggcttagggcgacgcctgtgttcctcaaatacttcagtttgacctttcctggtttggaattccttgctttacattgggattacagtgaggagttattaataggctaattcattcatctcttcctccggagacctcttgcttcgtttatttctccctccctctcagtgttttttagccttttctgggttgcattttggctatttataaacatgtcttgtctccttcttaagaccgtaagcaccttggaagcaaagccctggctgtttaatctttgtttcccctgcagcacccagacctggaggtgcttgacaaatactgttttgaataagcgaaagctttcccagtgcatatgctgtgtgcttttttttttttctccccttttttggccttgcgtggtaagaataaacaacttgtactttgtatcagagttgaatattaatagatgtttaccagtccctaatcactctttcagatgtatgtattctcagattaagactttgatttggagttttacagtcccagagagaggctcaagttcaaaattacatacctcaagccaaattagtcctgtctccatctgtcctggcatgctgcttccttctctgcaacaaatactgtggaatggcattagggaagcgagcaccgtgctgggagggctgtacatcctgcagaaacacagcagacacggctctggtctcatggagcgtagtctattgagggaatgcagtattaatccaattgtgatactaatgagtgaataattaaaaaccaggcaagagttctgaaggagtgtggtccgtgaaagtgtgttagaaagaaagatgacccagacaggggtgtcagggaggcattaaccaggcagcacgcagaacatctcaggcctgtgggaagggtaactcaagaagggtgtgttttgagtaccacgctggagaggtggatgaggaggcagagaggagagggtcttgaggaaggcgtcagtttgtcttgtaagaaaaaatgggaacttttggaagggcttccatgctggggtcacagtgcatttggtccaccttcagtgagtgactcctgtgactggtactgccctgttcttggtgacaaaggggcatgacatctgttcctagaaggcgtaggaaatcctccagtaagtcgatgccttcatcaggacaagtgtttgcaaatgtttctgcaaatggcagtggtctggttcttcctgtagagaaccacagtcagaaatgttgtaaggaaaacatggtctttagcaatttttggttacatctttgcacttctttattttcaagtgctctttagcccaggcttagtttctttaacctgagtaaggagcacggagcactaggggaagggtggaatgtccaaataagaaaagcaagtgggggtcatgaatcagtaagaaaggattggaagagttcaggagatagagcttttatgtttcatttttcgtatacgcatgataacaactgataaaatagagcttatctttggcatctccacttcagacacagttaactgaacttttgagcttcacagattgattacattctgatcataaggctttgaccattagtattcttatttcatggtaacttccaagtatgtttttactttgcaactctgaattgaatcttttcttctaatagaggaaattaatcgaaaactagtagaaactaataaatagaaaatgaggccagaggtgatggctcacgcctgtaatcccagcactttggaaggccgagttgggcggatcacttgagctcaggagttcaataccagcctggccaacatggcgaaaccccagccctattaaaaatacaaaaaattacctgggcatggtggtacgcttgtagtcccggctacttgggaggctgaggcatgagaattgcttgaacccaggaggtgaagtttacagtgagccaagattgtgccactgcactccatcctgggcaacagagtgagactctgtctcaaaaaaagaaaatgagttttagaaggagcaagcaggacagttgaagtttgccaagctgaagtaaaagtcacctagaaccaagtcctaggctgtcactttgacgtatcagtggccatatttatacagcattgttccttaaaagtgaaacagtcaggctctcttctggacatttgcctctgagctggtgaaggaatgtttgcctaacctttaaactcctttgtactctgtgcttatttgctcttctgtaaaaggaggctctgtgtagcttgacagagagatgaggaatgaaatgtactgggtttttgtttccctttttttttttttttttttttgagacaggacctcgctctgtcacccatgctggagtgcagtgacacaatcacggctcactgccacctccatctccccatctcaagtgatcctcccacttcagcctcctgagtagctgggaccacaggtgcatgccaccacacctggctaattttttttttttttttaattttttttgtagagacgaggtctctgtctgttgctcagtctcatcccgaactcctgggctcaagtgatcctcgtgcctccacctcccaaaatgttgagatcacaggcatgagccactgtgccctgctgaaatgtactgtttatgagctacctctcattaatgtgttcatttaatatgctttttaacatattaaaacagtatttcaccttccatagactgagtagtgttgaacatttttgttgctttgaagtcaccacatgaatactgtactttatgtaatatcgtgaaacaaattgaaatcttaggttttggatgaaacccttagtctgaatatgaaacagttctaccaaatgccattagatacactacattcttaaagccctggccagttagtatggcttgggacttcccaaggaactctgcttcagccatctgagacctgggagattacaaattggctgaaagtaattttgatgctaagcagcgatgttcagaaaggagctgaaaagtatatgtagtgggaaaatgccaggaatttcttttgaaattaagtgctggggcagttcgagagtgaggaaaaatctaatacaaaatctctacatatattagagtttatgccgtctacaatgggaataacaaatgaaacagaagaatacaattcaaattgctggttctatgctcatttttattaaaatatactcttaatgtttttattttgtgcttcattttgaaaacagcacagtattacagtatttgccatataattttgagaattatcagaatattttccttaaaaatgtatcattttaggctgttcaggttgaattgtgttccccaaaatatctgtttaagtcctaacccctagtacctgtgaatgtgaccgcatttggaaataaggtctttgcagatgtaatcaagttaagatgaggtcatcgtactgaattatggtgagccctaattcagtgactggtgtcattataagatgagggaaacttagacacaaatgcattcagagagaaagagatgtgaggatggaggccaagattggagggatgcatctaccagccaaggagtgccaaggggtggctggcaaccaccagaagctagagagaggcaaggagggatccttcccttgagccttcagagagaccttgaccctgtcagcactctgaatttgaatgcccggcctccagaactgtgagacaataaacttctgttgttttaagcttcccagtttgtggttctttgtgatggcagccctaagaaactaaaatataggctttgctcatcaaaatacgattcatgagaaatttaggatgacaaggcaagatgaagtgaagaagatatccttggtaaaggaaatagcatttcttttccttttttttttttttttttttctttgagatagagtctctcactgttgcccaggctggagtgcagtggcacaatctcggctcactgcaacctccacctcccgggttcaagcgattctcctgcctcagcctcccaagtaactgggactacaggcgcccgccaccacacctagctaattttttttttgtatttttagtagaggcggggtttcactatgttggtcaggctggcctccaaactcctgacctcatgatcccgcccttctcagcctcccagagtgctgggtttacaggcgtgagccaccgtgcccgtgtataaatagcatttcaaagtcacctggttccaataaagtatgaaataacttgctcttagggaaatcaccccaattgccctttaccttaatttcatgaaagatggaacaggtaaacatgtcaacaaaggaatcctgtaacaccaaaacaaaggacatttcttcaagttgaataaatatatgattatacatgtttgtcattttctttttctcattcactgaaagctggtgaacatttcaagtaccaaagtttgggaaacattgcaccagtggcttatcaaactaatgtgcacacgagtcccctggtgtattaaaatgtagatcctgacttggagggtgagggagatcggcatctgaccagctcccgggccgtgcaggtgctgttggtccagggaggcatgtaatgactccatgctcgagaactttgaaagcatggttttttgaaaaaacaaaatattctttctcatggtcatttgaactgtaaagtattccaatccatgcctgtgactttactgctgatgctctgatgactgtaacatctatatttctagtcacatccttcactcaaactacagatctttttttcagctacctaactacacctgggtggcctacaggcatctgaatgcagtacgtcccaaacccaacaaattattcacgcctatgccccatcttctatttttcctgtgtttgcctagaagataaagttagagtccatttttaattcttccccatccttacctcctggatctattgggtttcagagtcttttgagctgacttcttaacatggtttaagttactgtttaccctgaaagatgcaaaggaaagttaaattagggccagtttacatgattaaaaggtaagcaaattgggtttcattccaaagttcttcgtcgtagtgacttgagcagctgtgctgactatcttacagcttgccacacagcatctgcaccactgtccctaggcagcttccacagcacctggaacctgggttcatgaggatacaagagcctcctgggccaggatgggagtagttttccactttagaagaactatatatctatatataatatagatatatataatatatatagtttatatataaattatttacaatttatatataattatttataatttatatataattatttatatttatataaattattattatatcagtggaaagtaacaaagagttggcctgctaagtaactgccttcctcaaatcagcctcctcagtgtgtgtgatcccaacgaatgggtcaggaaaatcaaagacccaatcacgaacctggagcaattgttgggagtctgtgctgcaaatgttaaatttacaagcgtcaggattccgctgtgccgacaacgtttaattcaggcttaggtaaaccgcggctcctacaggcacactgcagagtcccatgattagcttttgctgcctgttccacctcctttacttcttattcttcccgctcctctacaggtcgtgtgctcttctgctgcccaaaccttccacctctcctaaccagcatttcatcaaggttcccactgttcaattcctccctgaccattgtaccaaaactttttgtcctttaaagtacatgtcatcttatattctgtcctctgccagctcctcgttgctgttatctgatgaccctggggatagtcctttttcaacaaggtcatctatcatatggtcttgctctttgctctaactcctgactgatcctaggtcactgcattgtccttgcagaggtcaatcaacaactccgctccacagttccttgactttagtcaagatgaagtcaggtctcttctaccacctcttcaggtactcacttccctgactgctccctggactttgtcacctatcccattctgaccactccaactccatccagtcttcactgtaagagcttcaggctgctggtccatctcctccctttcttctttttttctgagacagagtctcactctgttgcccagtctggagtgcagtggcattatctcagctcactgcaacctccacctcctaggttcaagtgattctcgtgcctcagcctcctgagtcgctgggattacaagtgtgcgccaccacgcctggctcatttttgtatttttagtagagacggggtttcaccatgttggccaggctggtctcgatctcctaacctcaagtgatccacccaccttggcctcccaaaatgctgggattacaggcatgatccaccatgcctggcccctttcttcttttcaggcaatgagctgctctctcttcagataagactcatggcttttccttccacctcgtccttctttttctttcaactacacacactttgcacagctccagccctggctacccagccatctgccttgcctgctgtgcagacagagctccttttagattgagatcattgcagatgtatggtctctgcttccagctgggtactcagtaatacttagcaatcatttttcttatcctggccacctctctctccacatcagctattttaaaccttcacacatctcctcaagcccattctctcactcctagtagatgaccaccagtagatgtaaggaaaagatgccatgtctgcaaacttgcttacctcatccttaaccctttccatgttgtctcagaaggtctctgttgtttaaaactaaccccagccttctactttggaccccatctctaaagcttcaagtccccacttcacccatcatgtctgttcccctccttttccctttccactggtagcttcctgactttgcgccttcctcctttaaccacctctgtctctcctttccctcacagctaaactgcttataagagctgtcagtactttttgtcaacagttttacttccttcattcttcaactgactgtaattaggattttgcccccacctgaaatgatgttggtttcaccagagatgctgatgatcagtcagtggacacttggcagcctttatcttacttagcttctcttttcatattcggcccttataagaactgcttccccaaatctccactgtgttggcttacaggtattttcaacttaatctctgaattggcaacttattattttaccttaaagcctattccttctcagaaccttcagcatctcttatctcagttttcgtaatcacagaccctaagcctttaattcctaaagaaggaaaccttctttaaatgactccattctacccaaattctagtgctataccacagcacttagccttttctgccaggaagtaggacacatgaaatgcatcatacagtcagaggccatacatccgtgcttcctttctgacatttggaaatcttgaaagcaagacgattgcttggggaaaaaactaggaaggcagaggtcatcgtgtctgctgaatatggcttaattttcttgaacactcaaggtcatcattgactattgactgctgcacagaatgtgctgtgctattacggccactttctagctcatcccctgctgtccccatctgcctttgtgcctgtagttcacagtcctactttagtatatacctttgatctactgcagtttggggcattaggtaatagaggctgcttgaagtgaatgtaaaacaagtcagtcaattccaaatgaggtgtctcctgtagagttaatcttttttggctttatgtttgctatttcagtggctaggagacctttttttcctggtctttattttgtctgtgttcctgaatggctgacatttgctcaagattgaattctaattatttgatacctttcctattatctcatttgacttttctcatacggaaagttaaaagtacattagtaggatgtatctgttttagattttctgttttggggtgtggtctttcccttcaatcttaattcattctggagaaaacccttatcaggtgaatataattataaactgagtgagaaaaatttattgtgaatttgagccctcaagttaacgttcactataataaacaccgaatctaatttaagtgggcacaattatttaaccagttgacacttagttatataacctacataggcattttgccttcattaattactctgtaatatggctattcacctgttcctgttaagcctttctgtagttgttaagcactatacacttaacatataaaacatacacatggtatgctatatatatgtcatccactgttaagcaaggaaaaagaaaaaaccacagattaaaaatacaaaataaacccataaaactagtacagattctgccatattctgatatggagtcatgatgagtgagatcatcattgctgcaaaccagcaaacattgaacactctgagagaacatgatgcattcctgccagaatgatttctgtgagatccaggtaattcagcactaactgaaactcctcatgaagttggattctcatcatctaccaaggaataattcattatctccttatagttttatctgcgttatctaaatacatgtatcaccacacagaaaaagaattgatggacagctcagctgcttatctgctgctccttccttgtggtattgtttccttcttgaatcctttgctagttcttccagtttggggactgtgcatagtaaacgtacagagtcattgtctgataatatcacgtatttttttttccgttaagctttctattttgagatcattgcagattcatatagttttaagaaaaaatacggagttctcatgcacctttttcctagttttctccaatgggaaaaacttacaaaactgttgcagaatatcacaactaggatattgatgttgacacagatacaggacacttccgtcaccacaagatctctcctgttgcccttttataggcacagacttccttcctatcaccacattttccttagcctttggcaaccactattctccatttctatgattttgtcattttaagaatattatataaatggaatcttgcagttgcaattttttcggattgactttttcactcagtataattctctggagatacattccaggttattgcatgtattgacagtttaatccttgttatttccgagtagcatttcttgttatgagtgtaccaaagattgtctaacaatttacctgttaaagaacatctgggttgtttccaattttgggctataccaatacaactgccataaacattcatatacagggttttatatgactcaaagtcttcatttctccgagatgaatgtctaggagtgcagtttctgagtcatatggtagttaaatgtttagttttataagaaactgccaaccatactgttaacattttacttaatgttaaaatctcgagctgtaatggtgagtttgtctgtttggccttttaattctgttagtttttgcttgacatattttacagctgtttggcatatacacgttcaagatacctatatcttattggtgggtttacccttatgtattaatagttatgtaatgaccctttctgtctctggttattttctttgttctgaagtctattttatctgatattaatacagccagccctgtttttctttgattaatgtttgtatgatacatccttttccattctttcagcagtccatatcattataactgaagtgagtttcttgtagacggtgtatgattaggtcatgctttttaagtcagtcttccaatctttgtcatttaattgatgtatttattccatttacattattgtaattattgatattgtatgactcaggtttgccattttatttctcagttttcttttccagcctgccttgactggccattttaaagaattctgtttgatttaccaagagtgctgtggaatgtatctctgctcatagctttttcagtggtcactctgtgtattacttcatatatacataacttatcatagttatatatatatatatatatatatatatatatcatagtttactgttgtcatctttttatcctgtcttgttttaattgtcttaaatatttcctttacatattttagaatcatatagataatactatttttcttaaacagttaaacataatgaagaaaactcaagataagaaggaaagcctattgtatttgcccatgtttttgctttccatgttctttcttccactcagatgttccaagattccttcctttatcattttcttcctgtttagagaaattcctatagctattcttttgcaggcagatgtcctggtgataaattctgttaatttttttttaaatcagagaatgtcttcatttaccctttattccagaaaaatagtttcacaggacatagggctctgggttgaaaggttttctttctttgagcacttgaaaaatacagtcactctcttatggcctccctggcttcagatgagaaatctgctgttattcgaattgtatttcccttgtagatatggtatcatttttctctggctacctttaagactttttatttgtcttcagttttcagaagtttaattatgatgtatcttgtcatggacttctttgagtttatcctgtttgagttcattcagcttttcaaatctgtagatttatgtctctcaccaaatttaagttttcagtgctgtttcttagagtgcttttttcaaccactttctctttgtcctctccttccaggactccagtgacatgaatgttagatctttttcattgtctgcaggtccttgaggctctgtttatttatttcaaccttttattctttgttgttcagattggatactttatcattttgtcatctagttcactgattctttcctgtcacttccattctgctgtcaagcccatccactgaacttttattttggtagttttatttttcagttttaaaatttctatttggttcttctgtgtatcttctagttctttgctgagacttctagttctttgctgatgatttctaattttttcatttgtttcaagcatgcttgtgttacttgttggatatgatgactgctttaaaatctttgtcagataattctaacatttgtcatcttgacataggaatatgtctgttaccttttttcgttcagtttgaggtcttcctggttcttggtatgatgaggagttttcaactgaaacgtggatatttttatattatgttataggaccttagatctttatttaaatcttttaattgttttcctctcttggacactaccttatcactgccatcatgtctagattctggaatctagaagttcagattccccacttgcttccattgacacatgagaggaattcatcttgttactgctgctgggtaaggattagaatgttctcgtccctctttccctggtgacctccactgacactgtgccaggggcacacaagagctcattacacagccagcagagatgaaagccctagctccctacttggtcttctctgacaccatctttgtggggatattgatatgcccggttgtagccttgcaagggtggaagtttaggctccccattcggcctttgctggcatgggtacaggttggaccatagtttttgctgtggtgcttggctagaatagagtcattattgtgtaagagttttcctctctcttgcttggctgccccttttttggtcccatggctacagagagcaggcttttgctaggactttttttgtctgcatccattggcatttctgggttgccagcttgttctgctccaagcctaggatacaagaggcaaaaagaacccagggaacttccttccaaatcattccttgggccctgaaatcccgggtacactgaaatctctggtacactggccttcttttgctccactctttcagagtcttttttttttttttgagacggagtttcattcttgctgcccaggctggaatgcagtggcacaatcttgcttcactgcaacctctgcctcccaggttcaagcaattctcctgcctcagcctcccaagtagctgggattacaggtgctcactaccacgcctggctaatttttttattattattatttttaatagagacatggtttcatcatgttggccaagctggtctcaaactcctgacctcaagatgatccacctaccttggcctcccaaagtgcaggaattacaggcatgagccactgcgcccggcctcagagtctttgatatttcttttctagggtggttttttttgttgttggtgttgtttggttttttttttttttttttttttttggactgagttttgttctgtcgcccaggctggagtgcagtggtgcaatcttggcccattgcaacctccacctcccaggttccagcaattctcctgcctcagcctcctgagtagctgggattacaggcacccaccaccacgcctggctcattgttgtatttttagtagagacgggggtttcgctgttggccgggctggtctcgaactcctgactgaggtgatccatccgcctcagtctcccaaagtgctgggatttacaggcatgagccaccacacccatccttttctagggtttttagttgttcttagtgagaaaaataggaaaaagttcttctactccattgtcttggaagtggaagtccacctgggctttaagggtaatttttttgcacatcaaatgcaacaatgatgggttgttgttgcccctcttctcagccctgtgaagatagtaccccgttgctttcggacctttggaatcaagacacctagtttctttacaagccttctttcctttctttcttattgcttttacagtcttcatgtgtattctgcagtttcacaattatgtatttatgtgtagatttatccttatttattcttctcatggttcagagttattttttatttgaacaatcctttaattttaattctataaaattctcagccattatttattttaacatgggctctctaccctcattctcttatttttttaatttcaaaattcctgttagatccatgttagatcgtttccttcaatcctccatgtctcttgagttcttttatatgttctgtcctcagctctcagtactgcctactggtaatctccaggttttattctgattcactaattctctcctcagttttgtccattttactctttaacctatccattgaataattagtttacagacagagtgctctgtcacccaagctggggtgtggtggcacgattctaactcactgcagccttgaacccctggactcaggtgatacaccctcctcagtgtcgcaagtggctgggactacaggtgtgtgccaccatacccggctaagtttttatttttattttttttaggaacagaattttcatatgttgcccaggctggtcttgaactcctgggctcaaacaatcctccctccttaacctcccaaagtgctcatattacagttgtgagccaacgcgctcagcctggaactttttaatgctaacaaaattctaatagcattatttttagtttgattgcctgtaaccatgtgaatattatgagaggttgaataggcttcatctctcagtggtgattaacatagttcttaagaaacgtgacagagctaggccaagcatcagtaaaggaacacactcttggagcttaattgaggagggagtgcttgatctgatctggaaaagagtgtggaggtgacactttcaaagctacaaacaggggagccaggaatacagagcagagcctttgaggccacagaaggagtcaggcagcagtggggattagcagtggtgggtcaggagcaagggtaaggagtggacttagcagctgagtcaaacggggaggagggagttggtgttctggtactcccgagctcctaagctcctaagctatgcagaattacagttctttggtaacagaaaaaacaaagtgaattaacatgggtaatatgaagttactgatactacatcatgctaattaaaaatttccatttggaaatcctttatttccattttataaaaaataatatcccaaattaaatatattactatgtgtaaagaagaagttattcagtttgtcattgaatcagacaaatttcgcacttgaagtgctgacctaaacttggcttatgccgttatacaaattacagatgagggaaaagaagcaagaccacgtaaatctgcaagtgcagacaaaacttatttttttccttttcccttttcccctgctttttaagaagaagaaagaggtagactcttcaaagtctaccaggtttattcttttgtacagaaaacacttgaaattttctaaactaactttgctgccaactgaatatgcatatttctttgaatagtggctagcaaagggacaagttttattcattccaagagtagttttcagactttaaccttgcaaagtaattattcaaagagcacagtttggaaaaccactgaattaacatgtcagccaaatatcttaaatgtgaaaaggtaagtcaacatatgtattgtcatttcacaagatactcagttacctctttttcctgttatattaacaactaagatactaaatttgatgatcgtgatctaagaagaaattcacagcactattttgaagttattttcacagtctctttttatctttcagattttttgtttaagttcttggttattggaaatgcaggaactggcaaatcttgcttacttcatcagtttattgaaaaaaaatgtaagtgtcatgaaattagtcattcttccgtgcatgtcttctgagagccctctcactcagatttgtttacagtaaacttaattttttcagaggaaaaaagtaatagtttgaaagtattttgaagggttatgttattgaactttgggtgatgtgattttttattaagttagcatttctatttaacaatggttcagtatatggttacttctactgtacattttgcagatgctgagagaccatatagtgatgttgaagatagcagaggggttctgtggcaggaatcctgtttcctgacagagcagccagagaagctctaggcatacattttggataaaataacaacatttggtcctcatagtgggcttgtgttgtagttaaggcagttgctgtcatcaattctgttttataggccagaaacagacctcttgaccacacagcccatcttttaccattgactttcactgttttggtaaaggaggttgaattttttatttcaaactatgtgagaccttggaaggctgtagaagactgtaggtttgaaaggcccttaaaacaaaaaatgctttttaataatggaaagaatcgtggagaaagacctgtctagttagtggcaggtgggtgaagggtcaaaaacagagtgtcttatttaattaagtttatcttaagaaagtatatgtgaggcatggtaggtggtgggtaaaaaggagaaagaaccagtttggggtgttttggcagaaagctttgaagaataataaaatcctagaaatttactctgcttcttccattttcatcacccaagagcttgttggagcctgtttgtttagtgacatggacccagtgtggcttagtcacagaactggtccttactgaatttaacaagtattcattcactggatagtttatttacaagttgccaagactttgtgtggtacagtcttagaaaagaatacccagagggtactgggccaagtacccagcttatgtaatcattctgtcctcctcagagaactcccctgcatggtcctctctgcaactcctcacaacagtaatgaacggaaggtctctctttgtaaccaggatgcccctggcctttagttactattttttttaaggatcttaccctgcatttttcctggtagtttactcctaatggaatttccatactagttctatactgtctgggcatgaaacagactagcatagtcactgtaaccatttatctaccctctgccctgtaaataataaatccagttgccagtggcatccctgatctctgaaacaattaaattttgttctgcagttacaaaatataaactagccaatggactgtatagctgcgatattcaatttcagcttatctgtttatcatcacagaaatgttctttcataggcagtgtattcccgctgggtttagcaaaatacttattttgcctgtctcctgcccattcaaatagtactaatttctccaacaaattcatcccaaatcatttccatagaacactacgattaatgaaatctcaaacacctgtagcttgcatagggttttgttttggggtttattggagggtgtattgttttggggtttgttggagggtgttttattttggggttttttggagggtgctttgttttggggttttttggagggtgttttttctttggttcaatttttttcctccttttcccttttcctctgcttttccttccactcactgttatttctttaaaatatttaaccattcaaatacagtagttgaaactgtctccacctcattacttactgagttccacacctgtcactgggcgttatgcccttcagaatggtacgctggtatgtcagcagtcaccatctgtgagcatcttaacagtgcacagttggatgtggttcggatatggcagggctactttcaggcataggtttttaaatgtatcatttgtttgggggttttgagaaaaatctttatgtctctttgagaataggggctgtgtgtattatctttaaaactaaatgcatcttctcaatggaatgttggagaaatgaatggctagagtaatgtccattccccattgatgtaactcttggttttagtgtcacttgtttaaatctataagcctgttaatgttctaaaattaaatatgctgttcttgtttttcttttttagtcaaagatgactcaaatcatacaataggagtggaatttggttcaaagataataaatgttggtggtaaatatgtaaagttacaaatatgggatacagcaggacaagaacgattcaggtagcttttctctaacttaataaaaatatttgaaaatttgatttaaaataattgatgatattctctcaatatataaggtctcactccctccccaacacaccccttccttgtcctaatctcagaaacttcatttttggaaactttgattgacaagacagctaaaatttaggttagctctctgcagcatggattactaaagaatacaggaggatctccgcgcaactgcattataattcggaggctgacccattctcaggaggatgtggcactgtgtattgtacagtatgtttctagattcaaatcaaagcacaagcttgtttttctgtgttccttttttaaagaagaactttttaaaaccttgtgagggtttgttttgttttacattaactagagcatgttctgatgtttgatacacactccacaaaatattctctccacactttaattacaatagggtcataactgaggctcagaatgacttcagtcactgcaaatgaggttacatgtttagtattctgtaactactaaagcaagaaaatagattaatattttagttgtggtttttgcacagatgcacaaagtcagaactgatattcatagttttataattcagtgaaataaaatccaccccatttgtaaacatttcacttgaagttgagtacatgtcgtatattaaataattgaagtttggctgggcacaatggcgcatgcctgtaatcccagcactttgggaggccgaggcagacctcctcacctgaggtcaggagttcaagaccagcctggccaacatggtgtaaccccttctctactaaaaataaaaaaattagccgggcgtggtggcaggtgcctgtaatcccagctactctggaggctgaggcaggaaaatcgcttgaacccgggaggtggaggttgcagtgagctgagatcacgccattgtactccagcctgggcaacaagagcaaaactccatctcaaaaattaattaagtaattgaagttcaataattgcttcaaaaataccataaccacctttaatcaccatcatttttctggaagcattgattaaacatggtggattcaattagacatttatgtcttccctctcagaaccccactgaaatgtctgttaagtaactgaaattgaagtaactcaaaaaggccaagattgagtgagtgcacaattatgattgagagatttccaaaaaaatcttaaagataggaagtagatggtgctctgacagcagaaggagctccaccttaagtactgtaatgggggaagccatttcttcctctggagtcccagaaaaggtcaggatttggaagcatcaggttctacaggaggtagaggttacagaggttcatgtttacacacgaaataagaggttcagtcttttacgttgaaatggagtctagactcaaggtcataaggcccacctgagggcatggggtcaggcctgaaaagagggaaattaagtgaaaatgaaagcctctggcccccaacccacctcccctacctcttccctggtcgctggcagccaggtgtgtatgtcccacataggagaaaggagccttctctgcagaaaaatgaatagtcagaaaggaaaggcttgaaggtagtgacattttgctttcccagtcaaacagcccagtctctatccagtcatctgaaagtgaaaccctccaagcccacctgctccacccacacataaagagcttcttttagactttttcattccttgctcttaatgatcaggcagaattttgaagaaagtttctatagcaaaagagagagctcaaagtaaagaagctggaactttgagggagtaagaaaaacacactaaaaccacagtatccttaggaagaagagcagagattgcattggagtatgtaatagaaacaaagtcatacttaaaaagagcaatcagaataatatgttaaataaactcatggtgaaaaatgggagagatgacataaagaatcctccagaattaatccagaagatgcaatgactattaggagttccagaagagagaagagcagagagaataatagaagaaaatgtttcactgaaggaatgagattccagattaattggcccacctaaaatcaaacatagtaaggaaaaagtccagaccagagcgtgccatgtgaaatttcagaacaccacagatgaagtaaggaagaccagaaaggttccaagagggaaaaagcagccacatataaagtgtgaaaaatggaattgctttgcacccttccacagcaacattggaagctaaaagaaatggaagcattgccttcaaaactcagggtgaaataattcttcaacctaaaattctaaacttagccaaactgtaagtgtgcaagtaaaggctgaataccaacagatgtgcaagaaagaggaggaagccaagattatctttctcagagacttcttagaaatgtactttcttagaaagtttaggaggatatacttcaccaggacaagggcatgatcccagaaagaggaaaatgaagccagcaggaagatccagctcagaatggcacaggtctagagggacagtgagggaagactaagacagcagtcagtatgtgatggcactgcccttccaggaggaccaggggaacaagtgaggggctctgtaagagctcacgactctgtcagagcggggaagaaacagctctgaaattcagtttcctaaaccttttgtagaaatgagaagaaagaaactgtaagatccatgagtgtaagggtttttgagttttctgtttgtttcccctgtgcccagaatagtgtctagcacacaggggcgcagtatgtgctcttttaatgacttaattaaaggaaacccagttaccagaaagagagaactcacctcgcttgtggagagtagggctcccagagaggagtgaggcaggagatggctgtgtttaatttagagacttttcgtgacatttcactttaaaactatccacatgtattatattggttaaattacttttgtaagaaaatgtggcacatatacaccatggaatactatgcagccataaaaaatgatgagttcgtgtcctttgtagggacatggatgaaattggaaatcatcattctcagtaaactatcgcaagaacaaaaaaccaaacactgcatattctcactcataggtgggaattgaataatgagaacacatggacacaggaaggggaacatcacactctggggactgttgtggggtggggggaggggggagggatagcaatgggagatatacctaatgctagatgacgagttagcggttgcagcacaccagcatggcacatgtatacatacatatgtaacctgcacattgtgcacaggtaccctaaaacttaaagtataataataataaataaataaaaggaaaaaaaaaagaaaatttaacacctcaaagtagtattcttaaatgtgtatatttgtatactggagtaatttgtataagaaactatttgtcaagacagtgttgtaaaataaatttgaaagtaaaattttaagaagtagatgtgatacagcttatcttgaagagaactcgtagttccctcttcctctagaagctaggtgcctgctgagcaagaatagaaaggcgctgcctcttaatagatgtgaacaagcgaggcctttccccctgccttaggaggctgtggggtgaagagcaaacagtccactctgcacctctacctgccaccagtccttaaagcgtgtgcctcttgctaacagtctcaaggcagagaggaaaagcttcaagctacatgaagaccttgaagcttcctgactaagagctaaaaagtacatttaaaagtagctcttctttgccaagcagcaaagtaataattagtaattttgtttgtttgtttgttgcaagctgcacgggtttctttgttctccaaggatagttcattcctctggtgtctttttttttctgacatcaagtctatggggtttttcttcacaccagccagtcggattctctgacaccagctgggtgtccaacacttcaattcacttttgacactacccagagttaaaggggaccctccaggctaaggagacctagactgccacccccgcttcagacaccagtcacaactggagtgcccaggcttcctgcacttcttggccaaatacagatctggcagttcccacaccctccatccctcacatccccatcaggttggagaatttgttagaatgattcacacaactcaggaaaaacatttttcctggcatttactggtttgttagataggtgtcaattcaggcacagcctggtggaggagatgcttaggagacgaggtatggggatgggccacctcccagcacctccatgccaccaccagcccaggagctctctgacccccatccttttggtttttttgtggaggttttattacaaaggcacgattgattaaaacattatccattgatgattgactcaatctccagctcctctttcctccccagagggctgaggtgaggctataagttccagcactctcctcactcggtgagggctcccacggccacagccccgatcccaaggctctctagcctgctactcttcccacagttatctccttggcttacaaaagacacctttatcactaaggaaatcacaggggtttgggcctctgtgccaggaacctgggacgaagaccaaatatatattttttaatttaattaggccacagttaagttctgggaatgtctagctagcagtggtccaggccctgtgctaggcactgggatcctctggtgagtgagacagcagagccctgccccatggaggggaggcaggcagccaacacagagacagagacagaaagagcatcccaccaagtgggatggtgccacccaggagacagcacgctgagatagagggggtccactggatggggatgcttggggaacgttgctgaggagatagagttaatgagacccaagggacaaggaaagccagcggtgtgacgagcccagacgggagtggcaggggctgggagcagggaagagaatggggccaaagggacaggtacagtgacggagatgtcctgtcctgggccttgatgagttgggctgctctgaagaatggactgtgggccacacatggcagcagggacagcagcgtgggcagacacaggatttgtgtagtgtaggagactgcactaggctggcggagtgaatgtggaggtgcacaggaattgaggatgaatgtggagctgatttgctttagaaacagggtgcgtggtgatgcctcttcctaggccaggacgggcctggagggtgggaccaaaaagagtcctgctgtgcagatgttaagtttgacatgtttatcaggcagtctcatggagatatggaggcagcacttggatctgagctggagacaaaatttgagtcgaatgttaagagagcccaggacccagctctggggaatcgcaatcccagcagggcagattcagaagaatgaccagagccagagaagtggctggtgagcgggaggaagactagcagagtgcagggcgcagaggctgcgcgagtgagtgaggacagaaatgcccactccagcttcggttgcagagagggtggggaccttgacaggcttttggggagtagcagagatggacactaggttggcggtgaagaagaggaagctgcaggtaaagacagctctttcagaaagttggatgtggggccacgcgtggtggctcacgcctgtaatcccagcactttgggaggccgaggcgggtggatcatccgaggtcaagagttcgagaccagcctggctaacatggggaaaccccgtctgtactaaaaatacaaaaattagccaggcgtggtggcgggtgcagctactcaggaggctgaggcaggagaattgcttgaacctgggaggcagaggttgcagagagctgagatcgcgccattgcactctagcctgggtaacgagcgaaactctgtctcaaaaaagacagttggatgtggagaagagcagacagtgggacagtaactgaaaagatggtgcagcatatttctgttttgtgttttaagatgggcggtaccagagccaatttatttttattttgctaataggaaaaatcctgaactcctggcttttttttttttttctttctgttgcctgggctggagtgcagtggcatgatcgctcaccgtcacctcaaattcctgggatcaaacagtccttctgtctcagcctcctgagtagctgggattacaggtgtgtactgccatacctggctaattttttgtagagacagggtctctctctcttacccaggctggtctcaaactcctggcctcaagcagtcctccctcctgggcctcctaaagtgctgggattataggtgtccggccactaatgggaaaaatctcacaaagagggtgagattgacaatgtaggggaaaacatgtatgaccaaaagacgccttcttgaatgtgagagtggatatgacatactgggacactcagttttcccgtagtaatagggcagggatgcaggtgggtgtagggccgtggtgactatggattcctgtggtgactatggattccaccgcgccgagaggtggcgagaactggaagagatggagaaaattgtgccagggagtggggtagatgaggagctcgcagagaagtgagtggattgctgagccccttagtgtccatctagggggtggtgctggcttccgcagacagctcaccctgctaggagttctcaaaggagacatccatcagagagctgcatccgctgtgaaggaatctcctacttgccacagtgatgtgatttcaggcagaataacccctcacatgtatgttcaaatatctttgaatcatttctcttttaaaccagtgtctgtccctgtgttgtggtttacaaagcaagcatgggtgttttttcatgggaaagtgggatacagtaaagggtctcaattggttgaaagtaaaaccagtataattcttccaggtccgtgacgagaagttattaccgaggcgcggccggggctctcctcgtctatgatatcaccaggtaatgccagctccccctggtgaaggagggtgctcagtgccctgcagcccaaaggctggtcttggcgaggtgccctccgtgcagtgtgtgctttgtgtgtccagggacggtggtgtggctggcatccaggaagccccttagcccttccatctggggtctcagaggtctttgaacgagcccctaccactgctttcccctgcagagaaatgtgtttgtaaggttttaggtggataaagcaatccatgctattacattacatttcttgacatgatgcttggacactttccttaaggttcacaaagctttatgtatggaaagttattagaagtgagttgagagagggtgaggacacagactctgggctgagattgctgggttcaaatcccagttgcagtcactagctgattgaccctctcaggccaggtgcttcagctgcctgggccttagtttccttgtctgtaagatggagatagtaataatcacatgatcctcaggaggttattgggaggtttaaattagttaatgtgaagcagttagtagctgtttgtgacatatggcaatttaactgaaataaaaaattctgttcctcgattgcactggccacatttcaggtcctcagtagctacatgtggctggtgactaccatatcaggacagattatagaacattcctatccatgaggaaatcacattcagcagtgctgatctcagtagcactgtcttagaaatgtgtcatctaaatggcatcatctgggggccctttctgggtaggaacctgtccagtgagaggatgtcactcagcagccgcttccctcttccaatctgtgtcccgggagccaggcgttctgagaggaggaaggcagtttctggcccagcccttcctgcacttgcccaggcagtgaaaggctcagcctgctaaagtgtgaagtcatcaatcaggctagcaaagtgccatgagaagaactcaatccttagacacatgagggccaaaaatagtaagtctgagagttggtcctggagtcagacagagctggtcaagtcctgactttgccactggctgctgtatgacctagggcaacgtaattaatctctctgggccttggatttctcagagaaaaggggaataatggcagtctgtgtcatggaatctttataaagaatcaatgtgataaagtcctgtaaaacaaagtgctggcacattgcaaggattcattaagtggcagcaattagctatgaaatcttgcctaccagagtctagtgccttgcgcatgctaagagctcaatagatatttgtcaattgaatgaaggaacatctctttccttttgccccatgactgggcaaacgaaaaataacaaaatatctcacttgctgtctcattttaccagaaacaaaatggaacaaactgtgggtatggtatatacttggtgcattcacgttgtctgagttatcttaaaggtgttggtgccattaccctgaaatgttgaaaagcggtatgagtagtgagaatgactggaaagagttgctagttttataaaatacatgtattattttcacaatcttatattacgcagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatggcaagtgaccttttacttcttactatttttcaaatcgcatatttgaggataatagcatttctttgaatttaaaacatatattggaatttcaagattaaactagatttaggaaatgtggaatttccaattgtttttttctataaattagacctattaagcatatttttagtatattgcattctgcctgcagaagttactataatgataaaagcaaatgtagtaacattatgtaatgacttttcagtctagggtctttgaatattagagatcttgggctaaagtgaaattaataatatttaaagactctaaccaaatgatgtcattattttttaatgtattttgaaggaaatttggtgaaatattaacccaaatagaaagggaagcggaagaagaaatacttggctttttggcttcattttaagtcatttggttatagacaactttgaaacttttttgaatttccatatagaatacatgaaaatgccacataaaattaatggttgcttaattaatggataagagaatgattttttaaaacttcagacattttaaataactttaatttttagaaccaaaaactagaatcctaatatcaatatttggactctaagattccaaattatattgtaacttgactagtttcttgctaagaaaataaacatgagagaaatccatatgccatcatgacagtttttaaaaagctgtttagaaatcagaagtttagaatgttaacaaagatgaaaaggaatttagatgtcatctaaactcatttttacaagtgaggatacaagaggctagagaggccatggtttgctgagagagcaagcagaacaggcctttctgctgagatgaacagccactctggtgggtagaaagagtattaattcctatactgtctcttcatgggctgtatgacagattgcaatatagtcccctaaaaagtgtaaacacttgtaggtcatatttgtggtgacactcagattgtttgaagaaggacattgcaactttccctgaaatcaatggcagggccattttggcaagccagctcctttctgatgggctgtcatttggctggggaagcctggttgcttgctcagccccttcaccaggttaagtgctagcacaagatagcagttacttttcagaaaaggctaaaattcttttaacatttaaaaaacacataatgacatatattgattttatatttacagaaatatatggttttaggtcataaattatatttcgtctgcttttctaagagaatgctacacaggcttttgtaagtgaaaattatgatcatcttctaaacatgactttattttgtttgatgtccattttagagctgatgtttttggaaacaagtgcgctcacaggggagaatgtagaagaggcttttgtacagtgtgcaagaaaaatacttaacaaaatcgaatcaggtaaaagcctttccattaagcaacttttcttctgcatattttacactgtagctcagtagatcaccttttaattaatagtttcagggtgatttagtaaagaatgttctctctctacctgccaacctaaaatcatcacatatgggttcaaaggtcctgttcttatcaggatgaaagccccatccttatcaggatggtttccatggtgatgaaagtggatgggcacaccagctcagctgtggaaaggtagtcaaggtttcagggagtgtttgcatttagaaccatagtctttctttggtccttcactaaacggaggaagaataggcctttgtccactctgtcaacagcacgctaattctgttgggccagtggtcatgtgtaagggagttataggtacatggtatagtgttgattgttgcagatcgggcatcatggaactatggagtccagagtaattttatttctgaagcttactgagcatgcctcaattataaaatgcctcatttttgtatttgcttattaaaataatttaaaataatcctaatgtaggcagctgacgaaatactgtgtagttgtcatttactaaagtaactatatatgggcatcaccttttaattgattcattcaaacatctgagtgcctatttgtcagatgctgggatacaaaaatgaataaatcacaccccttgccccccaagaaactgtctttcatgggagacagtcagaggataattataatatcacaaggctgatgtagtagctgagagatgcacaggctcagggtaacgtgaagaaggggacctgccccagccagaggatagaggaggtgtcagggagggctttcaggggaggtcttagatgagctcagtctttcagaatataaggaagagtgagccagcaaagggagtgaggaagagggaatagcaggagaaaaggttgaagaaaggcaggagccagccagtcctcatcaaggatctagaactttatcttgtagattaccaattgtcaaccctggatgagcactagagacactgagatgcattaaaagttctaatcccaggctctgcctctggagacgctgaactaattgggctgaagtatggtcgaggcaccagtgtttttaaatgtttactcatgctgttctaatgttcatccaagattgagaaccactgctgtaggtggtgggttgtcagcaggtgggtgatgtgattgggttgtgacttgagataagtcatgtatgtaggaggttatgttgaaaacaaactgaagggaggacaggcctggaggccaggataccaattataaggcatttttgagtaatcctagtaagagatgactgattaatgctttaacaaggatatggaagcagagatggagagagagatggatctaagatatatttaggcagtagcatcttatgactcatatgcccaatagtgggacaggacaactgactcttaggtgggacaaggtgaggaggaagggccagcaggggaggaggaaccaaggatgactcgcagctgtcacactggtgtctctagacagagatggggtggagccagaggagaagcagggaatgtgagggagtaaagatggctctgttgcaaatgtgcggcctttgcggtaacgctgagacatgaacatggagttatctagtaagcttggggaagagttcctggctggcagtataagtttgggaaccatcaatatataggaacagctaaaactgtggaagcaatgtgatcgtccggagaacagtgtttaaggagagcagtgatcaacagaaccctggagttggaggatgagcagaggaagaggaatctacaaaaaagatgaaaaaggaaatggtcggaaatgtgtgaagaaaatcaagggaatgtgggtgtcacttaagccctaattataagcaaatcaaaggagtgttcattatgtaatgtaatagtaacagagggaagcctcataagctaagactgagctgaaaaacacacattgggatggggaatagaaagtcagtgatcattttgatcaagaacaatttcagcagaattatgaaggtagaagatggctggccgtccgttaggaagaagtaggaggtgagcaagcagagtgtccactcctctcctgaggaagcacaggctggcactgtagggtgcaaagggttaatttaaagctggggttgtgggtgatgggagaaattccagcatgtttaaatgctgagggggaaggagagaagaatgggcaaggagagggcagggaagaaggagggtgctaggtgaagtaggagggaggagagtcgggcccaggtagaagggctgggtttcaacagaagtggacatgtcatctttttgtatttttttttatcagaaagaaaaaaaaattactaagcttggtacaaaaaccaagacactgttacataaatccttacagttggcttactgttgagtattattaagctcagcatgaggttgtatttacatgaccttgctattttaatattgtatccctgaatgcatcagatagaacaactcatatgcagtcttccaagatgtgtttttttctgagatcatcaaaatcataagtacctctaggtgaaaaaaatataagagtataaattaggattcttcagcagtactttttatttttttaatgggtaatacattcagaaaccattgttttcttccctttttttatataaaatgtatcatatgatagactaccacgccttgcttttttacttactattgtataacctacaaatcattacaaatcagcttatagtttccgtatatacatataatacataaggtacatatatataacataatgtcatacataatgtgtgtgtgtaatgtgtaatatgggttgagtatccctaatccaaaatgttccaaaatctgaaactttttaattgccaacattgccactgaaaggaaatgctcattggagcacttcaaatttcagattttcagattagggatgctgaactggtaagtataatggaaatatttcaaaatctgaaaaaatccaaaatacttctggtttcaagtattttggataaggactgctcaacctatatttggataaggaccgctcaacctatgtgttaccataattcatgagccagtctactttggacatttgggttgttgccagtattttgctattataagtaatgttacagtaaataattatatatatatatatatatatatatatatatatatatatatatatatatatattttttttttttttttacatgtgcatgagtctgtgtgtcagacaaatgcccagaagtggaattgctgggtcagagaacataagcatttgggatcttggtgtagaggctgtcacattttctcctagtgatgggcttatttcactaaagccatgtccacagcatgtagtatcatcatacttggacttttggcccatctaataagtgaaaaattatatctttgtaatttaattttaaattattttatataaataatgtattcacataatttgaaattcaagaagtataaaagagtatgcaatgaaaagtccccctgttaccaccccctcctgtcctcagccatctagaactcctccgaatcagccgttccttatgtatcctgctagagatgttttgtgccggtgcaagcaaacatatatatagttttttccctttattcagaatggtgggatatatacacagtgttctgtactttgctttttttttttttaatctatttttggaatcaaagaaacataaaagccttttttaaaagaagacttgcttggtccttaggtgagctggacccagaaagaatgggctcaggtattcagtacggagatgctgccttgagacagctgaggtcaccgcggcgcgcacaggccccgaacgctcaggagtgtggttgttaggagagcacacaggtgggtttggacacctccctgccctgagttcctggcaagctcaagtgcagaggcctgttaaagctttgggaagctgcagtatgaaaaagaggggatcccagccgggtgcagtggctctaattccagcactttgggaggctgaggtgggccagttgctttagttcaggagttcgagaccagcctaggcatcatggtgaaacatcatctctacaaaatacaaaaaattagccaggcgtggtggcgtgcacctgtagtcccagctactcatgaaacttaggagaattgcttgagcctgggaggcggaggttgcagtaagccaagatcataccactgcactccagcctgggcgataaagtgagaactgtctcagaaaaaaaaaaaagagaaggagaagaacccataagttaaagttggatgttctaactgaaagaatttatactctataggaaattcttatgctcttgttcagaaagaaaggaagggcaggtggtggttgatgggaagggtgagatatcctgattccttatgtcagtgaggagcccttcctggattgattgaggtctaaatgaatgtgccttttgctaaaacaggaggcctatttataaaattgacaaatgtctccctttaactttttaaagcttcttcttttttcccatttaccacagtggacgttttatttatagtcgacatcatgtagtaggcacaggcaagtgttaaaagacaagatattcacgaattctcttttaggctttaagctgtatttacttttgcatttatagttatgcagattttgaaattgttcttaatattttttaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactc

SEQ ID NO: 36436 - DNA, 55357 bp, Homo sapiens
gctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgt

SEQ ID NO: 36437 - DNA, 2145 bp, Homo sapiens
gcagaggcagcggttggaggcgcggtgggtgtctgcgggggtctcgcggggcggctgcggtgtttcaccgggaaaggctcgaggagagcgcggctcacgagaggtaaacggaccctgcagaccgtgctgaggcggtcccggtgccgggccgctggagctggggtcggccatcggaggagggcgggcgggcaggagagtgtcgcggggcggtggggcgagggtcgcggagtaaggaagggcaccgtgtcaacggcttggggctgcggagggcgggtgggagccggactcaatctccggtctcagcgtctgcaccctagctcttagtttgggggcactgtcgacttcccccgtccctcggggatcttgcctgggggatggcgccataagctctgagaagaggctctagaagcccactgtccatggatcgagccctcaccccccacttgagtggcccaggacctgggagtctctctaggtcccatcgcccccctcacgacccccccagggagtgggggaacacctctgttatgccttaaaaaaaaaaaaaaaaaggaaaggaattttaaaaatgaaggatgggagggtgatttaggaagggatcaagaagttgcaaatcttgtgtgtattattaaacgtctcctttttctcccatgaccttttcttggttcagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagct

SEQ ID NO: 36438 - DNA, 150248 bp, Homo sapiens
atgacggcaaaaaatgtaagtatttgtaaattttttaatgtaagtattgtttaaagtgagctgtgctttttcctacatattttctcaccattctggttaaccagatttaatttacttgcatggatttataattgtatttgtttatgtttatgcagaatatgagataagctttaatgcgattgaatatggtgccctaatggagatagtagcattcttgcaaattggcaccaagttacttctcaacagctgcaaattgctatctccagaaggtttcccaccctgccctcctcttttggatattgtaataaatttgttttggtacttgctggagggttacttggcctttttgagcaaatcactgttttctttggcttattttttttttttttttttggttactcagggaaatgtatgtgctcagatattgtctgaaagtagcttgctaccttccatgagatggttcctgaagaaacattagattttagatgttttggagaagttattcaagtttttccctctacttgaggtgatcatttctgaatatacctcctttcaagttgtatgtcactctttatttatttatttgtcactgtttattaatgagtttgtttccagttatggtaaagaattgtgccttaaagagtacaacatataggggaattatttgtaaattgctttactgttccaatgttatatgtattaaagtctaattgctttactgttcctatattattatgtaggaatctttgactgggaattaaacaaaaagggaatttgttataaagatgcagggatatctcaaggaatttaagagtgggaattttatgggccctcagaaagatccaggcccagaaactagaaatccagcaggaattgaagcagtatttggttttcatttctcatctctctcagcttgttactgtgtacctgcttcatttctccctctgtctgtctgtccaaatcatctttctcagttccccagccaggatggtggaacatggccccactcagcatttccatctatatgttaggggaccagcctgttcagagagaggtgtgaagaaagggaaggaggcaggccaggcatggtggctcacgcctgtaatcccagcactttgggaggccaaggtgggcagatcacctgaggtcaggagttcgagaccagcctggccaacatggtgaaaccccgtctctactaaaaatacaaaaagtagccaggcgcggtgacagacgcctgtaattccagctactcgggaggctgaggcaggagaatcccttgaacccgggaggcggaggttgcagtaagctgagattaccccattgcactccagcctgggggacaagagcgagacttcgtctcaagaaaaaaaaagggaaggaggtagcttgatgcatcctgcctgcctttctagtttcagactccttaggaggagcctctggcacagttaaagtctgatgttgactagtgctttagttagttgtgaccaggagaagcaagtgttgttgcatgaaatggctgctgagggtccagcacagtgtgtgaggaaagatgataaagggtttcttgtgagtcagaccgatagttctaaatattgcccattatgcagccgaacaatagcgttaacaaacaaatccttattgcattatgtctgtttgcttattttgggttataattcagaacattgcttttaacatgcattggtaactagaagcagatacagattttgcttcattatcatttggggacagtcatcaagatttattgagtcattaggatatgagggcaggaaagaagttagagacttctcagtatttgacttgtgtaactgggtaaatgactgtgctgtttaattagaagaggaattcttagggaggtataggatattgtgataaacttaaatattctgttttgaacatactaaagttgagaaacctaaaaacttccaagtggagatattggctaggcgatttgataagtgactctggcgctcaggggaaagcttaggaatggaggtagaaattttggggtcatttctttttttttttttttgaaatggagtcttgctctgttgcccgggctggaatacaatggcacaatctcagctcactgcaacctctgcctcccaggttcaagtgattctcctgcctcagcctcccaagtagctgggattacaggcatgtgcaccatgcccggctaattttgtatttttagtagagacggggtttctccatgttggtcaggctggtctcaaactcccgacctcaggtaatctgcctgcctcagcctcccaaagtgctgggattataagtgtgagccaccgcgcctggcccgggtcatttcatattaaaatcattgtaaagcaatgggactacatgtgatcatatagtgagtgcatggatagcaaatatataaggaccaaggtctgagcacagggattctccaacaaaaaggtggaaagcaagagaagccataaaggacactcaaagaatgggcaaagacaggaagaaaagagttatcctgatgatctggaggcccaggtgaagaaagtgtttcaaggggaagtgatcaattgtgtcacatgttactgagaagtgactcacaaacacagaagagattgtagatagggaagagattgccctcttacagaggcattactaaccatgtattcaaatatgtacattttaaattttctcattttacatgtctctgatgacaacagtttttttgtgaagagttacttttgtcttatccatgctttattaggtctcttatagttgcaaatgatcgaaaccctatcaaaacagcttaacacaaaaagtggaatgtattgacttatataattgaaaagtctagaggctgcttcaaacacatctagattccagggatcaaacgatgatgtcaggggtctgtcttcttccatctttaggccttctgtatggtggcataatggcttgcattggcctcataatacttgtctcagaaggagagagagaacttttgtgttttaaagagatggagtctggctatgttgcccaggctggtctcaaacccctgacttcaagggatctgcctgacttggcctcccatagtgctaggattacaggtgtgagccactgcacctggcccctttttagtatttatgtttcaaaatctacggagaagtttgagttgaccttgcttaaactccgtggagatggaagtgggatacggtaagtggccaggctttgagtcatgagcccactttgagcctctaagattaattgtcttactagaactacatgagatgtaggattgatcactttgcaaaaggaagaggtgaggagctggcaacatatttattgtatctggggtgaaattgctatcaaatagtatctagtatccagtaatatttttctagaccaaaaatgcagttgtgttctaatttaagcaataatacagtaaataatttgaaatataatttttgagggttttttttttttgccttgtcaatgaatctttaagaaaaacatgtaggctgtaatactcattatggaaaaattagaaaatacagataaagaaaagaaaaaatagcctagagactgtcagcaaaattttgcttaggaagatatctgatttgtatacaaatttgtatatgtagcaatcaaaatgtatagacattggcccagcgcgatggctcacgcctgtaatccgagcactttgggaggccaaggcaggcgatacttgaggtcaggagttcgagaccagcctggccaacatggtaaaaccccatctctactaaaaatacaaaaattagctgggtgtggtggcagtgtgcctgtaatcccagctacttgggccagaggggctgaggcaagataatcacttgaacctgggaggcagaggttgcagtgagccgagatcgtgccactacactctagcctgggcaatagggactataaattgctgggtttatggacatgagccaccgtgcctggctactatttaatttctgtgatgaatgcattttcttatcttgatatctctggaacatcattttaagtgtctattttagtttagtttagtttgggacagggtcttgctctgttgccccggctggagtgcagtggcatgatcatggctcactgcagcctccacctcctgggctcaagcgatgctcccacctcagcctctccagtagcggaactacaggcaccttgcccacttaatttcttcttttctttgtagggacaggatctcactatgttccttaaggctggtctcaaactcttgggctcaagcaatcttcctgccttagcctccctaggtgctcctattacaggcatgagccatggtgcctggcctaagtggctattttatgttatttattgtatggatattacaccagtttcctaatattgaccattaagttacttctgcttttttcctttttggaacattttgtctgtttttgctcactcatcatattatctccagaagaaaaattctatgaaattactgagccaaagtgtgtataattttttagagcttttgattcatattgctaagattgcacagatttatatatatacttgtggtatatgaaagtgacatttctttttatatgtttataaatctttgccaatttaatcagcaaaaaatggtgtgcaatttattacatttctctgattactagttaagtaaactaacattctgtatgtttattggtcatttgcatttctcttttgcatatggtctgtgtcagggttgaagtgttggaagccattgccatttggatgacaacccacacttaaatattgctttggcatattaatagatatatttttgccaaattaacagataaatttacataatcatttgactcgatcctatgagctctttagtttgtcttgcacatacgttctatcattcccattttgtagtgaccgttccacgatcaccttgcctgtgaaaggtagagcttaactgagcacagatgatcttactctgaacatttcagtaatgttatgtcagtcagaaatgttgaatatcaatgaaattacaatattattagtcaatatgatctgattcttaaaaattgaacttaaatactttgaattcagtaaacgcatagtgactggttatatagtacacaacacagcattggaatacccactatagtaaccattttatatatatgtatcttataacatcatgttttataccttaaatacagacaatacaatttatttttaaaaattgagaaaaaagagaggaatactcagcatattttcctcaggacatgattaggcaaagaatttaacatgaaatatgagttcacttttttctcttgttcattgaaagataagtcctttttaaataggtagaataagggaagaatggctaatattttaggatgctttcgctagccaactttttctactctcaaataatacagtttttttgaatctttacaaaatgtttatgatagtagaaattaatacatattttgaagttttaattaaatatattttggttttatatataagctttaaatacaaacacctcccctccatctatgagactaagattagcatgcagtatggactcacaattgacttttatctttttggagtacaatttgttggttcttaagatgcaggtgtacagctgcttaaaaagtttccacattcgttggctgttttactctgcagaagttggatattaagagcaggtgtttaagcataacggtaacccagtaactgaactctctattatgaatatgtggttttagttgaggtttttgaggtttagttgaggttgtataataacaaaaaggtataaactgatccttttgaagttattataatacatgtatttaaatggttatattgtatcaagcatggaatttattaaaggctgtctttgccttctttgctttctttttaaagtagaacaccaacaagttttgcctctgtcatcttcctatagcagaagagtttaaaaaggaggggggagttattagtaatggcacaataaactcttcaacaaatcaacaagttggatatttaacattatttgtgagcaactgaagagccataacatatagttatttgttgcaaattttgttggaaagtattgtctttatttctaactgaaaagtgataagaagctggacaaagttaagtatctgcactattatctacatagaattaagaggccattttctagatgacttagtctcagctactgtcataaaaatttgatgatgatagattctagagatttgcatcaaaatcacttgttaggatatgaaaaatatgtaaaaatattactgctaacatacttcttgacagaaagaaacagctattagtagagcatttgaattcttagtagagcattgaattatcaaataatgaaataattagctcttacattgatattataaactatcaaataattgcttatgaaaaatataaatacagccaggcgtggtggctcacgcctgtaatcccagtactttgggaggccaagacgggtggatcacttgaggacaggagtttgagaccagcctgaccaacatggtgaaaccctgtctctactgaaaatacataattagctgggcgtggtggtggacgcctgtaatcccagctacttgggaggttgaggcaggagaattgcttgaacccgggacgcagaggttacagtaagccgagattgtgccactgcactccagcctgagcaacaaaaacgaaactccatctgaaaaaaaaaagaagaagaaaaatataagtagtcagtgtttagaacaataagtggatagttataaagttataaagctttgtgtgctttaaaatcttttcagattgctggagatctgatgtgctgcacagtgatgataattaatagtactgtattgtgtgcttgtaatttgctaaaaggatagatcttaaattgaatcttcgcaacacacatatacacaataatagctatatagaggtaatggatatgtcagcttgactgtggtgatcattttacaatgtatacatatatcaaaacatcaagatgtacaccttaagtgtatgccatttttatatatcaatgatatctcagtaaaggggttaaaaaatcctttccatgtggtagtgtcttgaaagtatagtttgagggctgggcgtggtgactgatgcctgtaatcccagcactttgggaagctacggtgggcagatcacttgaggtcaggagttcgagaccagcctggccaacatggtgaaaccccttctctactaaaaatacaaaaattagctgggcgtggtggcaggtgcctgtaatcccagctacctgggaggctgaggcaggagaatcacttgaacccgggaggcggaggttgcagtgagccaagatggtgccattgcactccagcctgggccacaagagtgaaacgccatctcaaaaaaaaaaaaaaaagtacagtttgaggtatcataccacaaacttgtgatgttacaagttagtgtaatgtaacaaaattgtaatgtttcaaggttacaaatcttcaatgcttacaaaaagtatttgatagtaataatagagccaatttttggatgtttgcgttctgccaagttttcaaaaattgagggttttttttcctccaggctttgtaatatatttctgatattctgtttgatgatattcctgtattcagctctgtgatgccaagtagtgtagtggatattaccttaaatgaaataaattatctaaaagtgaattcataaatacttgctgtgggtagtccctcaagtataatactgacagtaacgtatgctgacatggattgagcagtatgtgccaaatcctgtgctatatgctttacatgaattatctcatttagtctttataacaacctgaattgctaagtactggtatcaccctccaatttacagatgaggaaatgcatgacttgaccaaggccaaacccctagtaggcttgatggtccagaatatgaatccaagcagttggacttaaggccaatgtattttacttctgcattgtggtattaatggtctttatttgattcctcacatgtcatagtattgaaagcattttagatagtgattaagaatagtacaaattaagggcaacagtggggatggaattttgaaatatctattggcaacttcatggctgccacattacttacttgctttcaaagaactgtcagtaaaatctgtaaaatctcagttctgctcataagtaatagtatttcattaatttttatcttaagctggacaattcatattcccctcaccttttttttttttgagacagggtctcactctgtcatccaggctggagtgcagtggcatgatctcagctcactgcaacacctctgcctcccaggctcaagcaatcctccgacctcagcctcccaagtagttgggactacaggcaatattcttccccttttaaataatatgtcaacatttcattttaaaataatactcctgtggttaatataattaattcatttgatgtggctatatatatttgatatggatgtctgatggaagatataaaatagcttgttaagtgaacacatactacttaatattctatttttaactttttaaacggttttattcaggttggtttgacttccacaaatgcagaagtaagaggatttatagatcagaatctcagtccaacaaaaggtaaggattattgaataaaatttttctgaattaagttagttttattgcatttgttttgtaaaatatgcagctacatgaattactttatgtataataattttatgatattagcacgttgttccatgccacataacttgtgctgtatgaaagtcatttacctctgacagacggaggatttttgtgtgtgatttttctctttcctaagagatctctaagatcccttatcaatgatcttattacaattgaaactgttcagaccacttttttcttgattttcttgtttgacaatcctactttcaaatggtttaagttgtaaggaagtacagtagagaaaatacgtatatatgtgttttgtatattttatatacgtgtgtatgtgtgtatttctttgactaatatatgtcttactggaagaatgcttatatcagaaatctggcccactggcttggtgcagtggctcacacctgtaatcccagcactttgggaggccgaggcagaaggatcacttgagcccaggagtttgagaccagcctgggtaacatagtgagactctgtctttacaaaaacttagccgggcatggtgatgtgtacctgtagtcccagctattcaggaggccagtgtaggaggattgcttgagcctggaaggttgaggctgcagtgagccataatcatgccactgtactccagcctgggtgacagaatgagaccttgtctcaaaagaaaaaaaagtattctgacccaccagtacaagaacttacacaggaaccagcagtatctttcaatatgtctctttgaacaatatcttgtggtatatagagatacatgctgaaatgtctacggatgaaattatatgatgtctggaattggcttcaaaataatccactaggagaaggagggtaaagtgggtggtattatagataaaacaatattgtcttaagttgattatttgtttaagttaggtaatatttctgtggggtttcattattcctttcctttctcttttgtgtgtatttgaaatttttcattataaactgtaggaaaaagatctattacaatacaaatagctatgagagaaacatcagcttccttaaagggtttatgtctaaggtgggagacgtactctagagcagaggtccccaattcccaggctgtgagctcatggcctgttaggaaccaggctgcatagcagaaggtgagcggccagcaagtgagcattagattctcataggagggcgaaccctattgtgaactgcacatgggagggatctgggttgtgcagtcctttagagaatttaatgcctgattatctgaggtggaacagtttcatcctgaaaccatccatctctctccacccccatccatggaaaaattgtcttccacgaaactggtccctggtaccaaaaaaggttggggaccactgttctagagagcaggctagagacatctatattccaatataaaaatgtctagcttattttatttattttttttttggtggcagagtctcactctgttgcccaggctggagtgcagtggcatgatcttggctcactgcaacctccacttcccgggttcaagtgattctccttcctcagcctcccaagtagatgggattacaggcacatgccacaatgcctggctactttttgtatttttggtagagacagggtttccacggtttcaccttgttggccaggtttaagccaccacacctggcctagcttaataatagtaatagtctgtgggaatgattctgagagttaaggtatgtattatgaggccatttaagagatactttaagcctcaatgctcctcattttttttcccacatgacaacattcatagaaaatgataacatttgtgggatgcactagggctaaacaaaaaggctgcttaaggtcaggattaagctacctaaaagcttcagctgcccgaggccactccagactgccgtgagggctgagggactccattcttttgtatacccatagcttattcacaacacgtaactgggaatctctgctctaataaaacgtagtaatcaggtcaggggaaggaagtgggaacaacaagcttggtagacatggaagacatattgagtattgcaataatgagaataatggaatgatgcagcaaccttgaaaataaagagaggatagcaagtcataaaggggaaaagtgacatggaaaaatgcttttggctgggcatggtcgctcacacctgtaatcccagcactttggggggccaaggtgggcggatcacctgaggtaaggagtttgagaccagcctgagcaacatggtgaaaccctgtctctactaaaagtacaaatattagccaggtgtggtggcaggtgtctgtaatcccagctactgcggaggctgaggcaagagaatcacttgaacccaggaggcggaagctgcagtgagctgagatcatgccattgcactccagcctgggcaacagaatgagagtctgtctccaaaaaaaaaaaaaaaggaaagaaagaaagaaaaatgcttccaaaagacagaagacaaagaaagagaatgggggtttaggtgagaaagattgtctttgatggtagaataggcatctgaagggtaagtactagttataaatgttagccctggacagatgttaacaccagtaaagtttagttacagagtaaaacctcagtttgtttaactttatagaacaaatggagaggaagacagagaatcatttaagagtggactagagagatcagattttgaaatagctatatgcatgtgtttgtttttgagacagggttttgctatgcccagggtggttttgaactcctggagttcaaacctctggagtagctgagactacaggcatgtgtcactgcacctggctgaaataattatatgttttaaaagaaaactgttgctcttctttgagctgttagctagtaacagcagaaggaacttcacattaagtgaaccaacaagatttggaagagatttcttttaattggtaaaattcagttaatatttgttacaggcccaagatgagagttgtattggaagtgagatgtagaaaagtatttttcttaattgaaatgatgatgtagcaatgatattatagaaacttttgaaaaatagaaaaaaaattctgcctttctaatacaaccttttcttttttgtaatttttcataattatttatataactatgttttaaagttataaaactggtaagtattatagttgtctattttccttttttgactgaatctaaaaaacacactttgcatgttttcacatttataaatacctttcttagagcttcatactgtttcattgtgcttatgagtaatgatttattaaacattttttcatttccttattgttggatatttgtcttttttgttggttatatatgatgcatatatatttctatatatgatataaacctatgatgttggacatcataatgaatctttaatcagctaagtttttgtttctttttatttattaagataagtactcagaagtgcagttactgggtcactcccctgcctaattaaacccttttaagcaacttcctatttaaattaaaataaaatcccaaatcccttacctgcaacaccctgaagttaggtcctgaagttaggttcatttttttcctaccatttttcctctgtgttcttcacatatgacaattttcattaatctgtcttcaagttagcttattttttttcagttatcactattctattaatcctagccagtgattttttttttcagacgttgcatttttcagttcgagaatttccattgggttctttatgttttttttttttctactgaggagagagggtgaaagcacaaatgcaagagcattgacaaagaaattgtagaatgttagagcagcactgaactcaattgaggttaaagatcttaaaccctgctggacgcagtgactcacacctgtaatcccagcattttgagaggctgaggggggtggaacacctgaggtcaggagtttgagaccagccttaccaacatggtgaaaccctgtctctactaaaaaatacaaaaattagctgggcatggtggcgggcacctgtaatcccagctgcttgggaggctgaggcaggagaatcgcttgaaccagggaggcagaggttgtagtgagccaagatcacgtcattgcactccagcctgggtgacagagcaagactccgtcaaaaaaaaaaaagatattaaatccaggaggtcgactacttttgtccagcagcactgataagaaagatagctggtctgggcacagtagctcatgcctatgatcccagcaccctgggagactgaggtggaaggatttcctgagtccaggaatttgaggctgcagtgagctatgattgcacaattgcattccagcctgggtgacagagcatgaccctgtctcaaaaaaaaaaaaaaagaaaaaaaaaaagacctggcgcagtggctcacacctataattccagcactttgggaagttcgagcccccagcctaggcagcatgatgaaaccctgtctctactaaaaatacagaaattagccaggtgtggtggcgcatgcctgtaatcccagctactcgggtggcagagacacaagaatcacctgaacccgggaggtggaggttgcagtgcgtcaagatcacgccaccgcactccagcctgggggatagagtgaaactctgtctcaaaaaaaaaagagaaaaaagaaaaaaaaaagatagctggactgctccagggttgcgttatatccagccagtactacagaagggaaaacagtatagatgtgagacacatataaagattgttttgtggcaagaaatgagacctgagaggtaggccacattctttcattgattcagcaaatatttattgaatagtacttacttactatgtgccaggcatttttctaggtgctaaggataaacaaggaatagaacaaagtcccttccctcatggagcttacattctggtgaggaagatagattacaaacacatacacataaaaaactggttatgtgaaaaaatctgtatatcagggtataggactgaggatacaacagcaaggagattcagctttagatggggtgggtcagagaagaatgcactgaggaagtaacaatgtagcagaggaggtgactacacagtagagacctagataataaagttattactcataatctgtaatgctaattagactgcgacttaatgaatcagtaaagaaatatgcaaaataggctgggtgccatggctcatgcctataatcccaacactttgggaggccaaggggggtggattgcttgagctcagcagttcaagaccagcctgggcaacatggcaaaaccccacctctacaaaaattacaaaaaaattagctggtatggtggcgtgtacctgtagtcccagcttctctggaggctgaggcaggaggatcacttgagcctggaaggtggaggttgcagtgagctgagatcgtaccactgaactccagcctaggtgacagagtgaggccctgtctcaaaaaaaaaaaaaaagaaaagaagtatgtgaaataataagaaatgcagtcatgtgctgcataatgatgtttcagtcaataatgaatggctatccagtggtggtcccataagataatagtctgtttttactgtaccttttctatgtttagctatgtttaggtacacaaatacttaccatgtgttacagttgcctacagtattcagtacagtaacatgctacacatttaggtttgtgtaagtatactccatgatgtttgtacaacaatgaaatcacctaacaaagcatttctcagaacttatccccattgccagttgacacatgactacatatattagtctctgctcctactctctggcacagaactcttacaacccttgtaatttcctgaatgataggggtgctaggagaatcatttgtcatatcatttgatcgctgccctgattcctgagacagagttcctaatacccttgtagataggagtactaggagtatcttttgttgtaatatttggtctttgaccccagttcctgacacagaactcctaagacctttgtaatttcctgagtggtaggagcatctgatacagagctcctaaatccctcaggatttcctgggtaattaggagtgacttttgtacaaatgaggtgacccttggtggactcctggatgggggctagtcaccagaaagataaagtcacgattgtaagcttgaagctttcagctctaccctctatccattggagatgggagaagggctggaaattgagttaataattaatcatacctctgtgatgaagcctccataaaaatccctgaactgtaaggtttggagagtttccaggttggtgtagacacccatgtgtcaggagggtggcacaccccaactctggggacagaagcttctgagcttggagcccttccataccttgccctatgtatttcttcatctggctgttgatcttgttcatctacgtcctttgttatatcctttaaaaattaactgataaacataagtaaagtgcttcccttttgctagagttctgtgagccactctagcaaattaatcgaacctgagtagggagtttgaggaaccccaatttatagctggttggtcagaagcagaggttacaacctggtgcttgcaactggcatgtgaagtgggggacagtattatggctctgagcccttaaccagtgggatctgatgcgatctcctggtagggtcagaatttattttttgctagtagggagaaatccccacacattttggtgaccagaggcagtgttttgtgttaaatggtgtacaagagttggaaaaacactttggttttttttcccattcttaataaagtgataccatcagaaagagaaccctagaagcagaatgtagacaaaactagaagtggaggtgatcctgaagagagagaggcagtaagttctcagaagttaccaccaaatccaggtgaaaaagaacaagggcggaagatagtggcagaagggaagggaaagaaatgataagcatgaataatattttaaaagtagatttggtgactgaggtttggtcacctcagtcagaggcaaggtactaatcaaggtagattgctgggatcacagtttgattgattgagtagataatgggtagagatttcccatccattctctgttttaccagcagaacccttttcccaagtaaaatcttacatggaatccaatatatcagttagacaaaatgaggctaatgtgggtggagcttcctgaggttattagcaatacttctaatgggaagtaggacaagaggcgttatatgcacataccctgaagagctctttttttaagatttaactgtttccagcttcccttgtccttgcgctcagatgtacagttggcaggggaaatttttgttacttttcccccttaataaaagagtaataaatgctcattaaaaaatacaaagaaaaatgagaaaaatacaaaatctagttcaaatacacaagattaaaacaatgtattttcttttattattttttatgtgcagcttaaaaataaggttataatcatatttatttctaatattttgaagttttgattaaaaatttttaaaattttttgtgggtacataatagatgtgtatacatatatatttatggagtacttgagttactttgatatagtcatactttatcaaatgtgtaataatcacatcatggtaaatggagtatccatcccctcaagcatttgtcctttgtggttacaaacaatccagttacactgttttagttatttataaatgtataattattgaccggctgggtgcaatggcacatgcctgtaaccccagcactttgggaggcaggcggatcacttgaggtcaggagtctgagaccagcctggccaacatggtgaaaccctgtctctactaaaaatataaaaattagccgagtgtggtggcactcgcttgtaatcccagctacttgggaggctgaggtgggagacttgcttgaatctgagaggtagaggttgcattgagctgagatcacaccactgcactccggcctgggcgacagagcgagtctctgtctcaaaaaaaataaaaataaaaaaatctaatatcaaatattatttattctttctgtttttttttgtactcgttaatcaccctcactccccctgccatccctgccacgccactatgtttcccagcctctgataaccatagtttattttctgtctccacgtgttcaattgttttagtttttagcacccacaaataagtaagaacatgtgaagtttatctttccatgccttgcttatttcacttaacataatgacctctggttccttccatattgtgaatgacaggatctcattttttttaatggccgaatagtactccactgtgtacatgtaccacattttctttatccatttgtatgttgatggacacttagattgcttctaaatcttggctattgtgaatagtgctgcaacaaacatggaaatacagatgtctcttcaatatactgatttcctttcttttgggtgtatacctagtagtgggattgctggatcatgtggtagctcaatttttagttttttgaggagctcccaaactgttctccatagtgtactaacttatattcctgccaacagcgtacaagggttcccttctctccacatcctcaccaacatttgttattccctgtctcttggttaaaagccattttagctggggtgagatgatatctcattgtagttttaatttgcatttctctgataatcagtgattttgagcactttttatatacctgtttgccatttatatgtcttattttgagaaatgtctattcagatcttttgcccattttttaattgaattgttagctcttttatattctggttataaaactcttgtcaggtgggtagtttgcggatgttttctcccattctgtgggttgtctctcactttgttgattgtttcctttgctatgcaggaacgttttacttggtatgttcgcatttgtccatttttgctttggttgcctgtgcttgtggggtcctgctcaagaaattcttgcccagaccaatgtcctggagattttccccaaggttttcttgtagtagtttcatagattgaggtcttagatttaaatctttagtccactttgatttgatttttgtatatggtgagagataggggtctagtttcattcttttgcatacggatatccagttttcccagcactgtttattgaagaaactgtctgttctccagtgtatgttgttggcacctttgtggaaaatgagttcactctaggtgtatggatttatttctgggttctctattctgttccattggtctatgtgtctgtttttttgccagtatcatgccattttgtttactatagctctgtagtgtaatttgaagtcaggtaatgtgattccttcagttttgttctttttgctcaggatagctttggctattctgggtctattgtggctctatataaattttaggattgttttttctatttctgtgaagaatgtcattggtattttgataggattgcattgaatctaaagattgccttgggtactgtggacattttaacaatactgattcttctagtctatgaatatggaatacctttccattttttgtgtcctctttaatttctttcatcagtattttatagtttttattgtagggatctttcatttctttgactaattcctaggtatttaatttcatttgtatctactataaatgggattacttttaattactttttcagattgttcactgttgccattagaaagctactgatttttgtatgttgatttgtgtcctgcaactttactgaatttgcttagcaattctaatagtttttttgtggaatctagatttttcaaaatgtaatatattatctgcaaacagggataatttgacttcttcctttctaatttgaatggccctttatttttatctcttgtctgaatgttgtagctaggacttccagtactatactgaataacagtgttgaaagtaggcttccttgttgtgttccagatcttataggaaaggctttcactttttcctatcctgtattttactagctgtgggtctgtcatgtatgccttttattatgttgaggtacgttccttctgtacccagttttttagggattgtatcatgaagcgatgttgaattttatcaaatgctttttcagcatcagttgaaatgattatattgtttttgtctttcatttcattgaaatgatatattacattgattgacttgcattcattgagccattttgcatctctgggatacatcccacttggtcatgatcaatgatctttttaatgtgttgttgaatacggtttagtagtattttgttgagggtttttgcatcagtgtacatcagggatatttgcctgtagttttctttttttgatgtttctttgtctggttttggcatctgggtgatacaagccttgtagaatgaatttggaagtattcatctctcctccatttcaatggtccccaacctttttggccccagggattggttttgtggaatacaatttttccatggactggggtgaggggtggtatggtttacagaatgattcaagtgtattacatttgttgtgcaccttatttctaatattattacattgtgatatataatgaagtaattatacaactcaccataatgtagaatcagtgggagccctgagcttgttttcctgcaactaggtggtcccatcttggggtgacgggagtcagtgacagatcatcatcaggcatgagattctcacaaggagcacacaacttagatccctcacatgcacagttcacaacagggtttgcactcctgtgagactctaatgtcgtggctaatctgacagaggtggaggtcaggtggtaatgcaagcagtggggagcatctgtaaatacagatgaagctgctttcactcgcccgccactcacctcctgcagtgcatcctggtttctaacaggccacggaccagtaccagtctgtggcccaggggtttgggacccctgctgtactttttggaatagtttgagtaagatggatatcagttcttctttaaatatttggtaagatttagcagtgaagttgtcaggtgctgggcttttctttactgaaagcctttttattactgcttcaatcttgttacttgttattggtctgttcaggttttggattactttatggttcagtgttggtaggttgtatgtgtctgggaatttatccatttcttctaggttttccaatttattggcatatagtagccatgttgctcctagtagccactaatgaatttccgtggtatcaattttaatgtctccttttttgtctctgattttatttatttgggtcttctctctttttttcttagtctgactaaaggtttgtcaatattatcttttcagaaaaccaactttttgtttcattgatcttttgcattgtttcctgtgtttcaatttgttttatttctgctctgatccttattctttcttttcttctacaaattttaggtttggtttgctcttgcttttctagctctttaagatgcatcattaggttatctatttgaagttttttcacttttttgatgtataagcacttataccatcaacttccctcttagtgcttctttcactatatcccataggttttggtgtgttgtgtttcttttatcatttgtttcaagtacattttaaatttctttctaatttcttttttgaccctctggtcaactggtagcatattgttcagtttccatatctttgtacagtttctagaattcctcttgttattgatgtctagttttattccattgtggtcagagaagatgcttcataatatttcaattttttgaatgttttaagactgttttgttacctaacatttggtctgctcttgagaatgatccatgtgctgaagaaaagaatgtgtattgtgcagccattggatgaaatgttttgtaaatatcttattaggtccaattggtctatagcgaaaattaagtctagtgtttccttgtggattttctgtttggaagatctgttcattgctcaaagtgggatattgaagtctccagctattattgtattgggggtttatctgtctgtttagcagtaatatttgctttatatatctgtgtgctccagtgttgggtacatatatatttacaattgttatatcctcttgctgaattgacccctttatgtaatgaccttctttgtctctttatagttttgtcttgaagtctgttttatctgatacaagtatagctacatctgctcttttttggtttccattgtcatggaatatctttttgcatctcttcatatatctgcatgtgtctttattggtgaagtatgtttcttgtgggcaacaagtcattggatcttgttttttatccattcagccactctatgtcttttgattggagagttgagtccgttttcattcgatgttattgttgataagtcggacttactcccgccattttattgtattctggttgttttgtgatgttctcttcattccttcttcccttccttcctgcgttccttttagttaaggtgatttttctctggtggtatgatttaatttcttgctttttattttttgagtatccattgtatgttgtttgatttgaggttactatgaggcttgcaaataatataacccattattttttaaacagatgataactggctggatgtggtggctcattcctgtgatcccagcactttgggaggctgaggcgggcagatcacttgagttcaagagttcgcgaccagcctggccaacatggcaaaaaccccatctctactaaaaatacaagaattagccaggcatggtagcgtgcatctgtaatcccagctacttgggaggttgaggcatgagaatcacttgaacctgggaggcggaggttgcagtgagccgagatcgtgccactgcactccagcctgggtgacagagcaagactccatgtcaaaaaaattaaaaataagtgagttttgtaccttcagatgatttcttattgctcattaacatccttttcttttagattgaaggaatttctttagaatttcttgtagaacaggtctggtgttgatgaaatctctttgcttttgttgtctgggaaagtctttatttctccttcatgtttgaaggatatttttgctggatatactattctggggcaaaaggttttttccttcagcactttaaatatgtcacgccactctcttcctggactgtaaagtttccactgaaaagtctgctgccgggtgctttggagcttcattgcatgttatttgtttcttttctcttggggctttttggattctttctttatctttgaccttcaggagtttgattattaaatcccttgaggtagtctttgggttaagtcagcttggtgttctataaacttcttgtacttgaatgttgatatctctctctaggtttgggaattttgctggtattatctctttgaataaactttttaccttatgtgtttctctgcctccaccttaagttattaaggccaacaacttttagatttgcttttttggaggctattttctagatcttgtaggtgtgcttcattcttttttattcttttttcttttgtctcctctgattgtgtgttttttgttttttgtttttgagatggagtctcgccctgtcacctaggctggagtgcaatggcgcaatctcagctcactgaaacctctgcctcccgggttcaagccattctactgcctcagccttctgagtagctgggattacaggtgcccgccagcacacccagctaatttttgtatttttagtagagatggggcttcaccaggttggccaggctgggactgtgtattttcaaatagcctgtcttcaagctcactgattctttcttctgcttgatcaattctgccgttagaagactcatacatttttcatcgtgtcagttgcatttttcaactctagaatttctgtttgatcctttttagttatttcaatctttctgttaaatttatctgatagaattctgaattccttctccgtgttatcttgaatttctttgagttacttcaaaacagcaattttgaattctctgtctgaaaggtcacatacctcttttcctctgggattggttactggtgtcttacttagttcatttgttgaggtattgttttcctggatggtcttggtgcttgtggatgttcatcgatgtctgaacattgacgagttatatatttattgtagtctttggtgtctgggcttgtttgtacctgtgcttcttgggaaggctttctaggtattctaagggacttgggtgttgtgattcaagtttttagtcatggcagctgtatctgcattagggggtaccttaaacccagtaatgctgtggttcttgcagacttgtagaggtgccaccttggtagtcttggataagaactgggagagttttctggtttaccaggcagaaactctgattatctttcctttctttttcccaaacagagtgtctctgtctgtgctgagctgcctggagataggggaggggttacataagtatccctgtggccaccaccactgggactgcactggttcagacctgaagccagcacaatactgggtcttgctcaaggccctggggctttacaatcagcaggtgatgaagccagctgggtttgtgttcttcccttcagggcagcgagttctcctgggccccatgcgggttgagagacgccatctgggaggcagggcctagagtcggaaaccttagaaatctacctgggtctgtattctgctatggttgagctggcacccagaccacaagacaaagtccttctcactcttctctcccctttccacaggcagaggagtctttcccccagccaccaccacaggtccatagagagtactgagaggccacttccagggtttacttaaggctcaagggctcttcagtcagcttgtggtgaatgctgccaggcctgggactcacccttaaggttgatgggctcctctctcatccagagtaggtccagaaatgctgttgaagagcccaggcttggaatcagggaccccaagagcccacttggtgctctacctcagctggtggctcagctggtacctaaactgtgagacaaagtctcctttatttctccctctgcttttctcaaacagaaggagtttctcatatgacccagcttggaatgttctgggtcatacgtgaagccagcatgtctcagagtctcacccaaggcccatgaagtgtattgcctgtctactgctactgattattcagggcccaagagctctttagtcagcaggtgaggaatcctgccaggactgggtccttcccttcaaggcagtaggttcccttctggaccatggtgtgtctagaagtgtcttctgggagctagggcttagaatgggctcatgattctgccaggtgccctattctactgtggctgagctggtatcctaattgcaatacaaagtcctcttaacttccttctccactcctcaagcagaaagaaggagtgtctttttcaggttggagctgtgcagcctgatgttgggatggggtggcgcaagcactcccttagccacccctgttgatgtctcactaggttgtgtgcccccgatgtccactggctctgagcccagcacagcactaggacttgctgaagagttgtagtctttttggcctagactgccttttaagtttgtttaggaccccagagctctgcctgtggtggcagagattgccagaactcaagttctgaccactgggatggacgattccttctgtctagagctgttctatatgttccctctgtgggtatcagctgagttctgcccagtgttgacagcactgagttccaatacagagtcccacagtcactgagctctccctcccccaggtgcatagattctctctttctgccacatggctgctgccaggggatagggaaggggtggagttggtagttcaagactctctttcctaccctctttggtgcctctttcagcaatatgaagttaaaaccaggtattatgatcgctcctgatgtttggttcttatgaacgtacttttttgtgtagatagttgttaaatttggtgttcctgtaaatggagggaccatgggtagaggcttctatttggccatcttgcttcattccccagctaatattttcaagtttgagaaacattttgtgacaactgaagaaactgcacacagaactacatgttaagtcataatcttagaatgttgattgaggaacatattgttaagctaatattacttcattaacacttaaaaattaatttgtgttttactagtcacaacctcatctatatatatagggaagatcgtttgcaataaatctaagattaaagattgaaaccactatcacattatttctatgtttcattttttttcatcttgccttaaacttgaaacatttcttccattttatttatagctgcatcaaaatattttaatagtcatatgctgttccattaagtggatatattacaatttacctatccattcccccattgtccaacacttagattgtctctatcttatttctgataaatggtaccacagcaaatatctttctgaattactttctggttctgcttctggtatgggtatttagcttctattggaccaaacctattgcaaataacaactagaaattctggataaaacttttttcttttttcttttttttttttttttgagacggagtctcactctgttgcccaggatggagtgcagtggtgtgatctcagctcactgcaacctctgcctcctgggttcaagtgattctcttgcctcagcctcccaagtagctgggattacaggtatgcaccaccatgcccagctaatttttggtattttagtaaagacagggtttcaccatgttggccaggctggtctcaaactcctgacctcaggtgatccgcccgcctcagcctcctgaagtgctgggactacaggcgtgagccaccatgccgggaaagccttttttttttttttttttgaggcaggttctggctctgttgcccaggctggagtgcagtgacatgatcacatctcattgcaaccttgacctcctgggctcaagcaatcctttcatttcagcctcctgactagctgggactacagatatgcaccaccacactggctatttttttttttttttttttttttttctgtagagacagggctttgccacattgcccaggcttgtcttgaactcctggtctcaagagatcctcctgccttggcctcccaaagtattgggattacagtcatgagacaccatgtgtggcctggatacaatatatttttttaaaagtatctcaaagcagtagagagggactaacagagttgtacttgtttagccaggtgagtttaccattttttagtttttagtttcagtcagaggacaggcactagtgtgctctacgcaggatactaaactttcgcagaaaaaacaaaatcttattggctggaagaatttgatggcagagattgaggcaaacatgatggctcaaaaggggagaaattaggttgttttgtttttttgttgttgagtttgaggagttctttatatattctggatattaacctcttttcagatatatcatttgcagatattttcttccattcaataggttgtgttatcacttctttatagtatactttgatacacagaagtccttaattttgatggattacagttaattcattttctcttttgttgcctgtgcttttcgtatctgtcatattcatgaaatcattgccaaatctgatgtcatgaagatccttctaagagttttatagttttagctcttaagtttaggcctttggtccattatgagttgatttttttaatggtgtaacgtgagaatccaacattattttgcatgtggatatctagtttttctagtagcattagttgaaaagactgtcctttcctcattaaatggtcttggcacccttgtcgaaaatcagtggattgtatttgtgatactttatttttgactttttaaattcattcattcattaattgttattttattttatttttttgagacaaagtctcactctgtcgcccacgctggaatgcagtagcacaatctcggctcactgcaacctctgcctcccgggttcaagtgattctcatgcctcagcctcccgagtagccgggattgcaggcacccgccaccatgcctggctaatttttgtatttttagtagagtccaggtttcaccatgttgttcaggctggtctcaatctcctggcctcaggtgatccacctgcctcggcctcccaaggtgctgggattacaggtgtgagccaccatacctggcctgtttttttaatttatatatttagagatggggtcttgctctattgcccaggttggtctcgcacttccagcctcaagcaattctcccgccttggtctcccaaagtgttgggattgcaggtgtgagccactgcacccagcatatttctgagttctttttttttgagatagaatctcactctgttgcccaggctggagtgcagtggtataatctcaactcacttcaacctccacttcctgggttcaagtgattctcctgcctcagcctcctgagtagatgggtttacaggtgtgtgccaccatgcctggctagtttttgtattttcagtagagacagggttttaccatgttggccagtctggtctcgaactcctgacctcaggtgatccacccgccctcggcctcccaaagtgctgggattacaggcgtgagccactgcacctggcctatttctgatttcttgattttattccatcagcctgtgtctgtccatatgtctgtatcataatgtttttattactgtagttttggtaagtttcaaaattgggaagtgtgagttttccaactttattcttcgtcatgattgttttgctatttagggctcttggaattccatgtgagtttggggatcagcttttctatttctctgaaaaaagacacttaacattttgatggagattgcattgaatctctagattgctttggttttattgatcttaatgctccattcaaatggaacatttatctagtctttaattcaccatttcatttgcagtgatgataatgttctggaattaaatagaggtgatggttttatgattttgtaaatatactaaaacctactttcaaaagtgaattgtttgcaagtgaattataccttgatttaacaagacaaaagcaaaaacactttcttcaacttgacgtctacttccagctgtgatttgttcttcctcttataatcagactttttggaagagggcatacgctttcagtgccattgtcacctctcattcactcctctgtccaatataatctggcttttgtttccattaattatatgaaactgcccttagtctttgtcttttttattttttttttttgcgggggggggggggttgtttgtttgtttttaagcatttaacacagttgatatctttcttttgtttttcttaataaccttttcattttagaacagctttaggcttacagaaaaattttgaagatagtacagagttactttatacccttcactcagtttctcctactatcagtagcgtacaaaactcagattgggcaatatggtgagaccctgcctctacaaaaacatttttaaaaattaactgggcatggtggcacatacctgtactcctagctactcaggaggctgaggcgggaggatcacttgagcccaggagtttgaggccacaggagctgtgattttgccactgcactccagcctgggtgacattttcatcacagcatattaaggcacatactatcaacatgacttatcactgttgatgtgaaccttgatcagctggccgatgtcgcttttgtcaggtttctccacagtaaagttagtctttacccctctccttttctgcatcataggctttggaaggaagtcattgtgtggattgcacacttgaggagcagggagttatgctctccctccttgaggggagtttctacataagttaaattaacatttacaccaattagaactctttggtgctctagatttgtcccttctcctctattgattcaatcatttatttagattagtatggactcatggatatttagtttatactctgggttataatccaatactacttttattttcttgctcacatttccagatatggccattggaagctctttcagttggtttccgtgtcccttggacacatcctagtcattgtgtttgtttttgatacttccttacttgttggcactgcaagatcccccagactcatcttgtgtatttcctgcccggtcctcagatcagtcatttttccagagtatggattccttgtcttggagaatgttattagaaaccagtatctcagtgctaaatgagctcattgctactggagtggtgcctttctttttgaatcactgttttatcctttgtgtctgtgatactacattttcttagtctttcatagaaggtagtatagtgtagtagttaagaacaagagctctggaggactaaaatgtaatcttggttccatttcttacacccagccaaatgtgtgatcttgagcaagttgatctttctaaactacagtgtccacatctgtaatgatacatattataatagtaggttgctcatagaatgtgtaaagattaaatgagcaactgcacatagtaagttatgcgtagcacatagtaagcattcattctgtgcttgcttttttctcttgtttataatattttcaccttcctttttggctgttccctgacagtctactctattagatttcctttgtcttctaaatgctatagtgttccatggtcttaggttttcttctcaccttgtgtattctccccaggtgatttcacctattcttatagctttagttgtcatctgttatgtatatgtatgattccgaaatctatacctgtggcccaaatacttgtcttaagattttgtatatccgacagcctattgggtaccttcatttgaataactttaatgcacctcagactcagtctgtccagaattaaagtaattattttaccctcccaaaatctgctgtcccccttcacctgccctttatcccagccagaaacagaggtgtcatctttaattcctttctctttctgtctactcccagtcaaatcacttacaaggctttttgattccacctaactctctgagccttcctcacccattttctctgccttcactgctgctgtaataggtcagactactataaaccatttcctggattactgcagctgattttctgtttcattctctgtactgtagctgcatactttttctcaaacacagatctgcacaaatcttttcatgttgtaaaacattttaatagttccttattgccctcaagataaagtccaaactacaatttaaatgatcctttatggccgggtgcggtggctcacgcgtgtattccttgcactttgagagaccaatgcagttggatcagttgaggtcaggagttcgagaccagcctggccaacatggtgaaaccccatctctactaaaaatataaataatcagcccggtgcggtggtgtgcgcctgtaatcccagctactaggggggctgaggcaggagaatcgcttgaacccaggaggcagagcttgcagtaagccaagattcagccactgcacttcagcctgggtgacagagcaagactccatctcaaaaaaaaaaaaactcctttaagataatggttcttgttttcatctgtactcttatcccagacacctatccttctgccacactgaactgcttttagttccctgttctcttttctctgtcttatttagcctttctatatgctcctctctgggtctggaattttatgcttccttgacaccatctttcatgccactcctgctatatttatacatatcacctagctaattcctgttcatcccttgcatctaagcttaggtcttatttccactggcctgtaagcctctcaaataaaaatatttaaaactcctaaatggaaagaagattaaaaataatggaaatggccaatgatgtaccaggagcaagaatataatattgatactaaataaaataaaacatacttcaaacctcaaggcattaaagggacaaagaggaatattatataatgataaataatcaaaacaacagtccaattttcaaaaaatggacaaaacttatgaaaagaaagttcacagaaatggaaatattaacagttcttacacatatgtaacggtactcaacctcattcataaggcatatgtactttaaaattacactgagggctgggcatagtggctcatgcctgtagtcccagcacttaatgaagccaaggctggagaactgtttgagcccaaagttcaagaccagcttgggcagcacagggaggcattgcctctacaaaagataaaaataaaattagccaggcttggtggcatgcatctgtagtcccagctgtttgggaggctgaggcaggaggattgcttgagcccaggggtttaggctgcagtgagccagctgtgttcgtgccattgtacttgtactccagcctgggtgaccctgtctcaaaaaaataaaaacactgatgtatcgtatttcactctataagattggtgagtattaagaagtttgtgcaggattgaaaaaaagaagtttgggccaggtgcggtggctcacgcctataatcccagcactttgggaggccgagatgggcagattacttgaggccaggagtttgagaccagcctggccaacatggcgaaaccctgtctctactaaaaatacaaaaaattagctgggcgtggtggcacatgcctgtagtcccagctactcaggaggctgaggcaggagaatagcttaaatttgggaaacggaggttgcagtgagccgagatcacgccactgcactgcagcctgggcaacagagcaagactccatctcaaaaaaaagaaaaaaggccaggcgtggtggctcaagcctgtaatcccagaactttgagaggctgaggtgggcggatcacctgaggtaaggagttcaagacaagcctggccaacatggtgaaaccccgtctctactaaaaatacaaaaaattagccaggcatggtggtggatgcctgtaatcccagctactcaggaggctgaggcaggagaatcacttgaacctgggaggcagaggttgcagtgagttgagatagcaccattgcacttccagcctgggcaacaagagcgaaactccgtctcaaaaaaaaaaaaaggaaaggaaaaatgtttgacaaaaacactcttgtcaagggtgtaaggtaacatgctttcctatactactggtgggaacataaattagtacagcctttatgagagggaatttgcaatatttattaatttaacattaacatatcttatgacttagcagtctcaattctaggaatttattttattgctaagctcacaaatttaggaaataaaagttaatctttacagtataatatgtaatagtaaagtattggaaacaatgtaaatccatcactaggatgtagttaaataaattgtgttcagtacatataatggaatgctatgcagatgtaaaattgggaatgagaaaggctatgtacaaatatagaatgatctagaagacacattgaattaacaaaagaaaccgcgcgcggtgtctcactcctgtaatcccagcactttcggaggtcaagtcgggtggatcacgaggtcaggagttcgagaccagcctggccaacatgatgaaacctcgtctctactaaaaatacaaaaattagccaggcatggtggtgtgcgcctgtaatcccagctactcaggagactgaggcaggagaatcagttgaaccaaggagacggaggttgcattgagccgacattgcgccactgcactttagcctgggtgacagagcaagactctgtctcaaacaagaaaaaggaaagaaaagtgcaaaacagtgatctgggtatataactattagtttaaagaagtgaggaacaggcctggcgtggtggctcacactgataatcctagcacttttgtaggctgaggcgggcagatccattgagtccaggaatttgagaccagcctgggcaacatggtgaaaccctgtctctacgaaaaattagctgggggtggtggtgtgtacctgtagtcccagctactcaggaggctgaggtgggaggattgcttgagcccaggaggcaagggttgcaatgagctgagattgtgccactgcactccagccagccagggtgacagagtgagaccctttctaaaaaaaaaaaaaagtgagaaataatgacacaacatacaaacttgaaaacatataatgtttcttgtaaggatacacagaaactgttgacattggttatctggtagtggaaaaacagtgtctttcacagaggagaaatttttaattttaatgaagttcaacatgaatttttctttcatggatcatgcttttgctgttgtatctaaaatgtaattgccaaaaccaaggtcacatagattttcttttttattgtcttctaggagttttatagttttgtattttatgttttaagtctagaatccattttggatttttatgacaggtataaagaatctgtgtctagattcatttctttacatgtagatatccagttcatttggcctcatttattgaaaagactctcttttctccattaaattgcctttgcccatttgtgagagattagttgaccatatttttattgttctgtttcagggctgtctgtcctgttttgttgatctattttgccgttcttttgccagtgccacactatcttgattattgtggctttatagttacagtcttttttttttttttttttaagctagagtcttactctgtcactcaagatggagtgcagtggcacaattacagcttgctgctgccttgacctcctgggctcaggtaatctcctcacctcagcttcccaagtacctggaactataggcacgtgccaccatggccagctaatttttaaatttgtttgtagagacagggtctcactttgttgcctaggctggtcttgaactcctaggctcaagctatcttcctgccttggtctgagtcagtgctgagattacaggcatgagctaccatgcccgacctacagtcagtcttaaagttggataatgttagtcctccagcttttctttactattgtgttggctcttctgagtcttttaccttgtcatataaattttagaatcagttttttgataactacaaagtaacttgcaggatttttattgagattgcaatgaatctgtacatcaagttgagaataactgaaatcttaataatattgattcttcctattcatgagcatggaatagctctacattaattaggtcttctttgatttcttttatcagagttttatggttttcccccagagatcttatatatatatatatatttattggatttatacctaagtatttcatttttggtgctaatgtaaatggtcttgtgtttttaatttcaaatattaattgtttattgctggcatataagaaggcaattaattgtatgttaaacttcatattctgtaaccttgctgtcattgcttatcagttgcaggagagtttttgattgtaagaggtattttaattttcagtttctagttcttctttgctaacatatagatatataattgctttctaatttcactggttaggactttcagcacaaggtttgataaaaatggtggcagcagaaatccttgccttgttccccatattaggaggaaagtgttaagtcttttatttttaggtattattttagctgtagattttttttatagctgccctttatcaggttgagtaagttttccttctgttcttggttttctgggaattttatacatgaatggtttttggattttgttaaatgttttttctgcccctgttgcaatgattacatggtggagtactgttaatatggtatattattacattgattgatttttatatgtcaaatcagccttggatttcctggataaacctcagttatgagagaagtacacaaattctccatttggagagtattggtgattagatcctgttttgtattatttttagtcctttatagtcttagagatgagtctggggtcccctgggtcacagcaaggaaccagctgaagttagagtccccagaagatagatgatccccaacttaacgatggtttgacttaaaaatttttgactttatgatggtgcgaaagtgacacacattcagtagaaaccatactttcgagtacccataccactgttctgtttttcactttcagtacagtattcaataaattacatgagttattcaacactttattataaaataggctttgtggtagatgactttgcctaattgtaggctaatgtaagtattctgagcaccttaaggtaggctgagctaacctataatgtttgataggttaggtgcattaaatgaatttccaacttacaatattttcatcttacaatgggtttatcaggatgtaaccgcatcatacttaccttcatagcatctatacatacatttatagtggcaccaattgtttcaggttttataacatttttgaacaaatcttcacagcctggaaacaggaataaaagaagcatattgtgggcaaagcattaggagcaaaaggaattcagagttctactgagagagttgctggaatggctccctgtagggaccataataatgcatttctggtgagatgcaaatgtgagaactgtgcttttcttgatgagagtaagataaagtttaaagggagttggaaagggaaaagagtagagaattggtattagaaattacttcagtgtttaaaatcttaaaaattcagtagcttatatgttttagagtttcatgtttacttaagctgctaacttttacctgcattacttttttggattttacttcacaaatttaagccccaaaatatctagtaagcctgttttattttgtattattttgagtaataggtataagcaatatttggttgctatttcaataaaaattctttggcaggtgtccaaatcccagcgctttgagaggccgaggcaggcagatcacttgaggtcaggagtttgagaccagcctggccaacatggcgaaacctcctctttactaaaaaatacaaaaattagccaggtatgggggtgtgcacctatagtcccagctactcaggaggctgaggtgggagcatcacttgaacctgggaggcagaggttgcagtgagccgagattgcgccaccctgctccagcctaggcgacagcgtgagactctgtctcaaacacacacacacacacacccacacacacacacacacagagtgaatggttctagctttcctctttttttggtttaggataactaaaattacacgcctgtaattccagcactttgggaggccgaggagggtagatcactggagctcaggactttgagaccagcctgggcaacacaaaaccccatttctacaaaaagtacaaaaattaaccaggcatggtggcctgtgcctgtgcagtcccagctccttgctccttgtgtggctgaactgggatgattgcttgagcctgggaggcagaggttgcagtgagctgagatcacaccattgcactctagcctgggtgaaagagtgagaccctgtctcaaaaaaaaaaaaatcttaatgatctgaaaacagaattccattctgcaaataattttatttattgaccagttcatcccagcgagttgctttacctgaaaaacctttaccatctgatcctttttcttgtttgtatttttcctgtttatcttcagatacattttatttaaattaatagtggtttgttaccatattaaataattagatactacaattcaataagaactaccttttaaaaatgaaaatcagaggagttcctgatttaaaacaaaaaataaaggaaaatattaaagtgtttttaaagagactaaggttaccacatcttttatcttcctgttaactacttttgcaacatatattgttgtgattaggtagaattatacaactttgctctgtttctttgattgcgtattggaaactcttattatcccttttttcagtgacgttgttttacattggataacatccagtgacacttgtgtattctttacatcctttagtgagtccatttgggacccatttacatatgaaaagcagcatgactgacactgcagacatgtaaatcgcaaatctaaaggaattagagaagatgaaaacattatttatcaataaggtcctcagtctcccaaatgaacaaagtaggcacttgagtaataatttgaaaaagtgattcatcttttttctactccctgattaataaaggtgatattttcttagtatgcttggaggttgggaatactttaagtcagtagttctcgaattttatcaagcatgagagtcacctagagggcatgttataaagattaccaggcatcacctccagagttctgatacagtaggtctggggtgggacctgaaaattggtatcgctaacaagttctcaggagaagctgatgtttactagcactggaccatactttaagcactactgttggccaggcacggtcatctcagcatttgggaggccgaggtggacagatcgcttgagcccaggagttcgagaccagcctggccaacatggtaaaacccatgtctataaaaacacaaaaattacctggatgtggtggcacaggcctgtagtcccagctacttggatagctgaggcacaagaatcatttgaacccaggaggcaaaggttgcagtgacccaagattgcaccactgcactccagcctgggcgacagagtaagactctgtctcaaaacaagaaaaaaactaaaaaccaaaaaactactggtatatggtagggtatatgaaagtggagaatgagcaacaagtaggatcagcctgattttcctgcctaaggttttcattcaattcagaaatttttttttttaagtacctgctatgtgtctaatactacgatgtcatcaagctttacatgtcttagacttttcgacagtggatcttttgctttattgagaggcttcaccaactaaggagcactgtctaaaataaaagactagtaaagaaagaaataaagttattcattttgttgctttttcaaccctctgtttttatgctaggtaatattttaccctttaccaattttaatgtgcaaacattatttctggcaattccacctctaggtagctatcctaaggaaataactttcaacaattgattaatgtagacacagacagagatgtttatcatagatgtttattataaagagcagaaaagtagctcctacactgaagtctgtagttttgcaattactaaataaactgtgtatgtatgtatatgatagctaattttgtagccattaagttttgcttatgaagagaagcattttaaagttaaaaatgcttgatatacaagaattattttatgtaagcatattttaataaaatttaagagctcagatttaagtgaaattgtattttaggttcttaactatgtgagatttatttatagagaaaaatgaggaaatataacaaattactttttacaaagtatctttagaatgtgagattatgattgactgttactatatattctcttctgtatttgtaacatatccatgactggatattacttttataattaaaatattcatgttttatatttacatattatttcaagttttatttacacacatatattagtgtacagctcagtgacgttttataagccagcactcatatctagaagcagaatataaccagcaccctagaagcatgccttgtgctctatttcaaggataactgctatcatgacttctaaaagcacagattattttctcctgtttttgtactttatataaatgtaatcatacagtatttattcttttgtgactggcttctcttgcttaagaagatgttgtgagatcaagcttagtaatcatagttcatcctttctcattgctatgtaatactccattgtgtgaataaaccattattcactttaatgttattgggcatttgggtaggtaattttaagtttgggaatattatgattagttatgtcataaatattttagtccatgtcctttggtgaacacatgtacgtatttctacagggcatacacctaggattggaactgtttggttggggttcagttttagtcgatactcccagatgatttttctcaaagtggttataccagttcacactcccactggcaacagatgaggatttctgttgctccacatccttgccaatacctaatgtgcattagtcagggttctccaaagaatcagaaccgctgtctctcctattggttttttatgactatatatatacacacacacacacacacacacacacatatatattatataatatatatatatgtgtatatatacagctgacccttgaacaacgcagtggttggggcactgacctccctgtgcagtcaaaaatctgtgtataattttaactactgatagctcactgttggccaaaagccttaccgataacatgaacagttaagtaacccatattttgtatgttatagattgtgtactgtattcttacaataaagtaagccagagaaaggaaaatgttattaagaagatcttaagggagagaaaatatgtgtaccattcattaagtgtaagtggtttgtcataaaggtcttcatccttgtcatgttaatgaagagtaggctgagaaggagtaggaagaggaggggtggattttgccgtctcgggtggcagaggcagaagaaaatctgtgtataagtgtacctgtacagtttgaacctgttattcaaatatcagctctgtgtgtgtgtgtgtgtgtgtgtgtgtgtgtgtgtgtgtgtgtgtgtgtgtgtgtagagagagagagagagaaattgattgattatagggattggctcatacagttatgtaggtcaagaaatcctgtgacctgctgtctgcaacctggagaaccaggaaagctggtgatgtcattcagtctgagtctgaaggctgagaatcacgggagccagtggcacaagtcccagctcaagtctgaagggctgagaactagaggggctgatggtacaagtcccaattctaggccagaggcctcagaaccagtgtgccaatttcacaggcaggaaaagatgaatgtccagctcaaacagaagcagattctcccttctgttgcctttttgttctctttgggccctcaacaggttggatgatgcccctctccattggagagggtgattttctttattcactctactgattcaaatgctagtctcttccagaaacatctcatagaccacccagaaacaatgttttatcagctatctgggcatcctttagctcagtcaagttgacacaaaagttaaccatcacagtatttttcatctgttttcttatacttagtgtggtaagtgtgcagtggtaatatatggtagctttaatttgtatttcctggatgattaatgaattgagagcctttcctatatttttggttgtaaattatgctaaaacgttgttgtagtttgcagctcagtatcagatatattttaactttatttcaaggaacttaattataagaagtattttacaaaatatatcaaaggatattataacttgatccaaggttatgtatgaaacttaaaaatagcatacatttaatttttaaagtctcaagtgttagtgtcctgtaatatggtacctaatgagatttagtttgagttgaattatacttttatgattgaatgttattttcctgttggcttcagctataaaaattaaagacgttctcatatgaaaaatcgttcagtagacggagttgaaattttttgccaaagacaaataagtaagttgataaccagtctctgtcggctgttgtcatcaggaacactgctagactcaagtaagataatatttgtaaagcactacccagatgtttgtgttacttttagagctttaaaatctttgaaatattcttaacatcttggttttctttctgttttatccactgataccttactcctaaccctccatgtgtagttctcagaatttattccattcttgctattgtcttgagtttttagaacaaggtagaaggcacagaacaacccaaaaactgcccccctccacacacacatttttatatatttaagtataatttaaataaataaatacagaatgctgctaacctcattggcattttaagatcatattgtaatggcaggctattgagacaacatgggacttgtacctagcatagtgcctgtctcacaggagctcactgtatatttgttgagtggataagacaatgaaaaaattctactgttgggtttttctctttttaggttttgttgggagcttccatttgttgtcccctacccaccagttttggatctttaattttaaaaagagtacttaagatggatatgagaaagttactgttatgctgggcacagtggctcacgcctataatcctaatgctttgggaggctgaagtggaaggatcacttgaggcaaggagttcaggaaagtttctgttagtaaaattttcaaagtggaactttctctcaagataacctcatatagacagtcagaaaggagaacagtaaaattgtaaaatgactggaaaataagtatacattttagtgattttttatgtggtacttattttgggagaatctaattattcaagtacccattaaaataaaaagcaaagttaatgttatctttatattatttaagatgtatccatgagataaattctataatatatattggattacttatgaacaaagagaactagaaaaaacgtgttttaagaggaggtaaataaaagaagttccaaatagaaggaaagaaagctggagaggggctggacacagttgctcaagcctgtaatcccagcactttgggaggccgaggcagtcagatcacctgagatcaggagtttgagaccagcctggccaacatggcaaaaccccgtctctactaaaaagacaaaaaaattagctgggcatggtggccgacgctggtagtcccagctactcaggaggctgaggcaggagaatcgctggaacctgggaggcagagattgcagtgagccgagattacaccattgcactccaccctgggtgacagagcaagactctgtctcaaaaaaaaagaaagaaagctggagagaacggtgacactatgtctcaatagcatctgttatcctagatgatgttaaaaagttctgttgaatgcttttttttcacaactctcttctactctgaattataaaatgtaatagtgtggtattagaaaagacagctaatcctttagaaattggtcgtatattattttgaccattggtcattgattattttactggccagtttgtgaagcttttcttgatttttttttattccagatctttagacctcactatgaaacaacccacttgttaggaaacattgatacagtcattggaaaatcttaaccatatgtggtagaatggccacaagcaaatgcatgaggcttaggcctgaagcttcagggctttgtttgatacatgtatcaatttatatagaattgatcaaagcatatctatgactgctactgattaccatagaaaaatagctgagtaactgttgctttattctgtaatatcaatgtgtataataaaaaataaattttgttcattgcctccagttctggcacacagttcctaaagccctttgaatctccaaagtaatgagtgtcttttgtactctaatgagaagattgttgactggggtcccctagatagctttaggatgggggctggtgccagaaagaccaaggattgaaactttcaaccccacctctgacttccagcagggagagagggcctggagatttagatgattaccaatggccatgatttaatcaatcatgcttacataaggaaacctctataaaaccccataaatgacagtttggagagcttctgggttggtggacacagtgaggtactgggagggtggcgtgcttggaggtggcatggaagctctgtgcacccaccccctacccctgccccattgccctgtcttacgtttctcttcgatttggctgttgccttcctgagttgtagtagccttttaaacaaaccagtaatagtaagtaaagtgctatactgagttctgtgtcattctagcaaattattaaatctgaggcggggtcatgggaaccctcaaatttgtagtctgtaggcagaaatgggagtagcctgggcatgtcatctgtggctagcagctgtggcaggcagtcttatgggactgacctcttagtctgtgaggtctgggctaactccaggtagttactatcaaaattgtattgaattgttagacacctaattggtgtctgaagaattggagaattggttggtgtgatttaaaaaaaaaaaaaaaaacccaaacatttggtgtcagaagtgttgtgagtaaaaacagttcattattaggtacttaaattcaaagatggtgtagattttatgtgtatgatcactggcttctctcttttaatatcgagggttagttatcaaggtaatttttaaatgacttggacatttaaaaaatagaataaaatactaatttataaataaacaagggttaaatcaggctgtataaatcagtggagatgtaagcactttaaggcaatatccttatctccgtttctgtgaaatttgagtgtggaatcttgtaagataattgtgactattttataggccataaggagaaaagtgacatctggtatatctggaccatagaccttaaaggattctaacacaaacacataccaagcttgattggtattgaactggcctggggaaaagtatgtcataatagcagaaactctgtgatggtatggatggagaactttataaagccaaggaactgaatccgggcaccgtggtcaaagaggaaaacttctagcgtctccctgtagccatacataattctataggtattaccattccctctcaactcattctgtattattagggaaataaagtctttctctaacgtttttcttttctcctaatatagtttgaaatgcagtcacttttacttaaacttatcttttggaataaaataatttatggaattcatagcactcagattgtttcaccagactacttgtagaaattctggattagttgattaaccacagttcatagcttcccagttgcacattatccttagatttcaaaaattcctttctgagtaagagatacaaaacaacccacccaggaacaaattattttcttggttggcagagcagtatcattcttagcacacatgaaatcgagctaagaaccagagctaatccaagattttagagttgtcttagctctgctaattttctttattattttgcttgtattttcattttcacacaactctctcaagtgattaagctgtacttaagtatttttttaaatttcgtctttaaaaaggttcttactgttttgtttcagaaaggacatgctatagctaatacactttttgtaatcttatggtggccatggaagtgtgccattcagacctcctgctggtgggaggcacaaatgactgacagtcccagctgtggtccctctggatccaccacctcattcttgctgaggtcacactgatggtgactccacatggccagtgaatgaatgagtgtaggcctgttcataagaaacacagttctcctctaatcagcagggcattacttcctattactgcataataattactctaaaatttaacagcttaaaacaaacattcatctcacatggtttctgaggatcagcaatctgggagtggcttacgtaggtatttctgcctcagggtccctcatgaggttgtagtcaagcaattggccagggctgtagtcatctgcaggctggactagggctggaagatgtccttccaggatggctcacatattcatacatggatattggcaagagcttacagttccttgctgactgctgttgacttcagatccttgtcacatggttgtctccacagggcagcaaataacatactttttcagggtccagatttgttggggacaagtaagagtagtttggtttttgtcttaggtatcatttattctgagatgctttttctaaacatcactcccaccaagggttgccagatatagcaagtagaggacaatatttggaacatacttctactaaaaaattattcattgttcatctaaaattcaaatttaactaggtatcttatattttatctgacagcctttctgggtttagtttgtcttctctgtgcacctgtgataccctgtgctatcccgcttctatatttaccgcactatattttaattgtctatttagttgccagtatcttcccactagggtgaaacttctccatgggaataaactgtctttttttttttttttttaattcactgttatatccccagtgccaagcactgtgcttgacctataataggtactcagtagccaggcatggtggctcatgcctgtaatcccagcactttgggaggccgaggtgggcagatcatgaggttaggagttcgagaccagcctgaccaacatggtgaaaccccatctctactaaaaatacaaaaattagccggatgtggtggcgcgtacctgtaatcccagctactcagaaggctgaggcaggagaatcgcttgaacctgggaggcgaaggttgcagtgagccgagatcatgccactgcactccagcctgggcgacagagcgagactctgtctcaaaaaaaaaaaaaaaaaaaaaaaaaaaaaaggtacttaataaatgcatgtgggctttccaagaatgaaaacacttggtcttataattgcatgcacttttctcctccaccttttcttgattgtcatcatgaatctcagtagaatgctaatgcagcaaaagggctagtaattccaagattcaagaacttgtgttatcactttatatataagcttcaggttcccctctggtagctggagataatatctgtttcctcttggaagcaggaaaaaaaatgataaagcctactattttctaggattgtactagcttcaataattggaagctgggctttatgtaatgataataggttttaaggacatggaatcaaataggtctgagtttaaatgttagccttgtcacatactaaaggtgacttcttgggcaaatttgtcatgtttcaaaatgtcgattttcttatctctaaaatgggagtgatcatgcactttcataagggctattgtgaggattaaatgataaaacaagtgaccttgcctagcagagtgcctgtttttggcacatggtaggtacacagcaaatccctaatgaagcttcctggggctaccatatgtcccgtgagtgattctgtctttggattgataggcatttataattccaccaattgtagattctcatccaagtacatataccaaatatctgaacctatgttttatctcttactgagatggattactatggccacaacacaccagaagaataaaattaacctgttttatgataatctaaaatagctcatttctcttatatgtagatgaacaattcaatgcttgttgaatcccattcccagtgataggaggagactgactgcattgcaggatcaaaagtggatgtttttatgattgttgtctgccacaaactagttatctctgtgatgacttttccaatatccaatatctgcttaaaatctggatcagaaagctcatgaggttcttctttctcagtctttggctcttctgaaaatcaggttcaagtataacttttggcccttcacgtctctggaggtttctgtccttaatagtcttacatgcattagaattgttgattgtaccatctcttatgtccctaacactgtctttccccacttgatccatgctttttagtttcatgaataagaaaagtgaatctcataaaggtaaaatgacttactgcagaccacacactgggatttgaacctaggtatgttgactgggatttgaacctaggtatgttgacaaatcacaaatcagctgggatttgaacctaggtatgttgacttcattgcaatatgcatactacatgccagttgtttcagtggatgagaattatgaaacctgtgcattgatatacaaacacgaggtgttaatattatgaagtgccacctgagatacacggtaacccctatagcagagggtttatagttgatttaaggagaactgatacataaataacaaaacatagtgtcaatgattcatataggcaaaaccagctactaaagtcataattatttttagccatatagaatattttttgatattttattaatctcattttgtgtctggattcttgtacttagcataatgttttcaagattcattcatgttgtgtgaatcagtagttcttttctattactgaatagtattctattatatgatataccaccatttgtatatccagtcatgggttgatgaacatttttgttgtttcacttgtggagcattattaataaaactgctgtgaacattcaaatacaagcttatgtgttgacataagttttcatctctctaaggtaaatacctagaagtggaattgctgggtcatatggtaagtgtatatttaactttataagcaattaccaaacatgtttcccaaagtgtttgtacaagttggcattcccatcagcaatgtgtatgagagttctagtgccctgtgtccttgccagcacttggtatggtcagttttttttgttttctattttagtgattcaagtgagtttggtgctcagtgtggttttaatttgtatttccctaatgactaatgatattacgaatcttttcatgtgcttatttgccatcagcatattttctttggttacataagtgtttaaatcttttgcagattttttattgagttgtttgtcttgttattgtcttattcatgttacaagtcctttatcacatgtgtattttgcaaacattttctcccaggctgtcatgtgtctttttcttctcttaactttttaaaggcttttccaatatctcctgcttaaaatccagattagaaagctcatgaggttctactttctcagtcttaactttttaaagttaagagattttgaagagcagacatgttttatatcttgatacatcagtctgtttatgttgctataaaggactcatgaggcaggataatttataaagaaaagaagtttattttggctcatggttctgcaggctgtacaggaagcatggtgccagcatctacttccggtgagggccttgggaagtctacagtcatagcagaaggcaaaggagagtcagcaagtcacgtggcaagagagggagcaagagagatggagggaggtgccatactgttttaaacaaccagatctcatgtgaactactcattaccatagggatgacaccaagccattcatgagggatcctcccccatgacccaaacacccccatcaggccccacctccaacattgaggattacatttcagcatgagatttggagcggacaaacatctaaactatatcacttaatgtgcagtttttcaattaaaaaagatagtttgtggttctttgtatcctatttaagaaatctgggctgggcgcggtggctcacgcctgtaatcccagcactttgggaggctgaggcaagtggatcacgaggccaggagatcgagaccatcctggctaacacggtgaaaccccatctctactaaaaatacaaaaaatagccgggcgtagtggcaggtgcctgtagtcccagctactagggaggctgaggcaggagaatggcgtgaacccaggaggcaaagcttgcagtgagctgagttcatgccactgcactccagcctgggcgacagagcaagactccatctcaaaaaaaaagaaaaaaaagaaaagggaaatctaagccaggcagggtagttccagctacttgggaggcggaactacccttgggaggggtggactacccttgggagggagactacccagcctagtagttccagctactttgggaggcggaagtgggagaatcccttgagcccaggagttagagaccagcctcagcaacatagtgaaaccccatctcagaaaaaaaagaggaaagaaaagaaatttttgcctaagccaataatactaaggttttctttttttttttctttgagacagagtctcgctcagtcgcccaggctgatctccgctcgatctccactcactgcaagctccgtctcctgggttcacgccattctcctgcctcagcctcctgagtagctgggactacaggcgcccaccaccacgcccggctaatttttttgtattttttttttttagtagaggcagggtttcaccgtgttagccaggatggtcatgatctcctgaccttgtgatctgcccgccttggcctcccaaagtgctgggattataggcgtgagccaccgcgcacggccaatactaaggttttctcgtacattttcctataagtttttacgttgctatattcctttattttcctagaactttcctagaagttttctaattttagctcttaaatttaagtctatggtaagttttgttttttgtgtttttccaagacagtcttgcttggccggagtgcagtagtgcagtcacagctcactgaagccttgacctcctgggctcaagctatcctcccacctcagcctcccgggtagctgggactacagacatgtgcaaccacacccagctaatttttaaattttttgtagagatgaggtctccctatgttggctaggctggtctcgaactcttgggctcaagcaatcctcccgcttcagcttcccaaagtgctgggattacaaacatgagtcactaagtccagccttatgataaattttgagttaatttttatatatggaatgagaggaaaggtttatttttgtatcatatgaatatccaatcattccagcaacaaccagtcaaaaaagattatcatttcccatagaattgctttgtacctttgtcaaatatcaattgactatgtaattgaggatctgtttctagattctgttctgttccattgatgtacgtgtcttatcttcatgccaatactgtactctcttggtagctcagtggttctcaatgaaggacaattttgcccctaggggacatttggcaatatctggagacggtttttttttttttgagatggaatctctctctgtctcccaggctgaagtgcagtggtgcaacctccgcctcccaggctcaagcaattctcccgcttcagcctcccgagtagctgggattacaggtgcacaccaccacgcccagccaatttttgtaattttagtagagatgaggtttcaccacattggccaggctggtctcaaacacctgatctcaagtaatccacccatcttggcctcccaaagtgctggattacaggcctgagccaccgcgccaggcctggagacatttttgattgtcacaacttggggggtaggcaggaaggttgcccctgggtagaggtagaggccagggatggtgctaaagattctgcaatgcgcaggagagtcttccagaacaaaaaattagctggtccaaaatgtcagtagtgccaaggttgagaaactctgctgtagctgcatactaagccttaaaaccagatagtgtaatctttcgattttgttattttacaaagttgtttgagctatactaggtcctttgcattttatataaattttagaatcaaccttatacatttctacaaaaaatatctgctgagatttgattaggattacattgatctatagataaatttgggaagaattgacatattaacaatttttaatctcctgattgattgattgattttttgagatggagtctcactctgtcacccaggctggagtgcagtggagtgatttcagctcattgcaacctctgcctctcagattcaagcagttctcctgcctcaacctcccaagtagctgggagtatatatttattttatttttatttttttgagacagagtctcgctctgtctgtcacccaggctggagtgcagtggcgtgatcgtgactcactgcaagctctgcctcccaggttcataccattcccctgcctcagcctcccgagtagctgggactacaggcacgtgccaccacacccggctaatttttttgtgtttttagtagagacagggtttcaccgtgttagccaggatggtctcgatctcctgaccttgtgatccgcctgcctcggcctcctaaagtgctgggattacaggcgtgagccaccgtgtcccgccactgggagcatatagaaaggctagaagagaaaacagggaactaaaagcaattcagtgtcgcagaaggataggtgtctgggataagagtaaagatgaaaacaagaaccattatcataaaggatcttttttttttattatttttttttttttgagatgaagtcttgctctgtcacccaggctggagtgcagtggctggatcttggctcactgcaagctccgcctcctgggttcaagcgattctgcctcagcctcccgagtagctgggattacagacgcttgccaccacgcccagctaatttttgtatttttagtagagatggggttttaccatgttggccaggctcgaactcctgacctcggcctgtgatctgcccgcctcagccttccaaagtgctgggattacaggtgtgagccaccacacccagcctgaatcttctgatttataaacatgttttttctctccattaatttgtcttctatagtttcagcaatctattgcagtttccattgtataactcttgtacaattttgttagatttatccctaaatatttaatattttatgctattgtaaataatatgtttaaaatttttaatatctgattttgttttgttggcagaagatagaaatacagttggcttttgtatattgaccttgttgcctgtgaccttgccaaactcactcctagtccatttatatagattctataggattttccatatagaccaatattttgtttatgtacaaacaaattttacgtattcctttcttattttatacctttcatttcctttattacactggctaagccctctagttcattgtcagaatagtaaaggtatacatcattgtcttgttcctgattttaggggaaaagcattcaatttttttaccataagtatgatttttagctatgggttttctatagttgctttttagcattttgagtaagttcccatctattccttgtctgctgagagtttttgtcatgaataattgttgaattttgttaaatgccttacctgcatctattgaagatgatagtgtagttcttcttttttattctgatgatatggggaattatattgattgattttccaatgttaaatcaaccttctgccattcatgggataaactcaggcatatgttatcctttttatatattctagaattcagttagctaaaatttcatttagaatttttgtgagtgttcatgagggatattgggccgtagtttacttaaaatggttttgttttgttattttctttgtttgtattccttttctgaagtaccttttaaccttagttgccatcttactttctctcactattttcagaggatgaacactttttataagaaatctgctgtgttttgagtgctatatgccaggaactacaagaagcccttcatattcgttatttcatataatcctcagaaccttcttcaagatagatgctattatgatgcccattttagaggtggataaaacggagactcagagcagttaatttcccaagtgatagaggcagttcaaattacgtctttcgggctgggcacagtggctcatgcctgtaatcccaccactttgggaggctgaggcaagaggatcacatgagcccaggagtttgagaccagcctgagcaacatagtaacacattgtctctacaaaaaaattaaaaattagccaggcatggtggcatactcctgtaatcctagctactgggcaggctgaggtgggagggttgcttgagcctgggaagtcaaggttgtagtgagctgtgattgtaccaccgtactccagcctgggcaaaagagcgagaccctataaaataaaaaatcaggtctttcaaatcagaggttgaaaacggctctgcatttatatctttctttagaaatattttattaatctgaaatattactgacaaaactaggaggaatttagaaaactatacctctactaatcttttttctcttcttttgattttttttttttttcccttaagacagggtctctctctgtcatccagactggagtatagcggtataaattcggctcactgcaatctgtctcccaggctccagcaattctcctacctcagccttctgagtagctgagatgataggtacatgccaccatgcccagctaatttttgtatttttagtggagacgaggtttcaccatgttgcccaggctggtcttgaactcctgggctcaagaaatgagcccacctcatcctcccaaggtgctaggattacaggtgtgagccaccacacccagctaatctcagagcacctctttatgctaattggttttgatattctctgtgtgcttatttttcagtttgaaagtgtctaataattagcatattagggccaggagtggtagctcacacctgtaatcccaacactttgggaggccgaggtgtgtggatcacctgaggtcaggaactcaagatcagcctggccaacgtggtgagaccgcgtctctactaaaaatacaaaaattagctgggtgtggtgacaggagcctttaatcccagctacttggcaggctgaggcaggagaatcacttgaacccgggaggcggaggttgcagtgaaccaagatcgcgccactgactgcactggagcctgggcaacaagagcgaaactccatctcaaaaaaaaaaaaaaaaaagcatattagttcactaatttgcaagttttatcaagcacacattattgtgaattaacttgagtgtttctaattggatatgtcaacctaaaatgaagaaatggaggcaaaactaatataagtggagagtttatttgggccaaacttgaggattacaacctgggaacatagattcaagtttccctgaatatacactcctgttagcagcagttacaagtggagtttgaaaggcaaaatagggggacagggggtggactgtacaaagttgtttgctaggaattctcactggtttacagaaccagtgagaattgattagtgattgactatacgttgttaacctataaggtatggattatagtgttattataattcacacctgatgtggattattaagctaatttatggctacttatggcaatagtaagcagtttaaacagatgaatacatagctcaaaggaggggagtaggcatgattgtaatctcattttaatatctatctgggcctgatatttaaaaggacttgcattcctcagataaaagttcttttcttttctcagttgctacagtgcttcagtttaaacttcacatctattggaagtctttcaacgttgttaatctggattagagatccttgagagaaaatgccactttcttttttactatactgtatttaatatgctcaatagtatcaataggcatatttctgtttatgtaagattgtagtgtggctgaaggctgaaggggggcaagagcacatgagaagctattgcttccacttatctgcttttcccaggttgaatgtgtgctagattattttaggaccttttgggctcaaaaaatcaatggggaagcctgaatttagatgatagctagctggtgggacccaacttaattttctgtcttatgcttcggtcaaatttgggaatatacacaaaaaagcaaagctacaaatagagattggcaatacagattaaaatgtgccaggcaacaggaggaatttcgatgagtagaaatgaagattgatccctgagacaaaatagcggggacaggcaggaaaaaggtagatttctacccttctctacttcatacctacaaatttaaggaagtaggatctttaccaaccagaaacttggcagcttcccaccaacaccaacgccgtgttgcaactgctatctgcaacatccagggctctttttctccctcccatctctcttatcattacctctgtacttcccttagtgaccacagctctgtaaaggcagtggcagaagtggatttgttgggggtacgttttcagatgtgatgaaggtagtggtgagaaggggcaaagagaagaaaatccatgggagtagtatgccttttctcaggccctactttagacagacacacagattaagctttttattatggaaaatttcagatatttacaagagtaaagagaacagtttaataaaccagtcaccaggttaaacaactcttggttaggtcctgtttttgactaggggagaactatattctgtttcaaagtatgtaggattagattgccaatcacgtgcacatggaacaagacaacagggtcagaagatcttccttagtttatcagcgccatagtaaatcaggggatccctacattagatccacaaattgactttaagtcatgacaaactgaattgatgagcaaaattgtgtgctctagatagtatataattttaatttgatcctcaaagggatctttaatcctccaaataggtgagagccatagtattatgtgactgctcaatactaggtctggcttgtgtggataaagtttaaagtcaggccaggcacagtggctcacgcctgtaatcccaccactttgggagaccaaggtgggcggatcacttgaggtcaggattttgagaccagcctagccaacatggtgaaatcccatccctactaaaaaaaaaaaaaagtacaaaaattagccaggcatggtggcatttgcctgtagtcccagctacttgggaggctgaggcagaagaatcctttgaacccgggaggcggaggttgcagtgagctgagatactgccactgcactccagcctgggtgacaaagcgagacttggtctaaaaaaaaaaaaaaaaaaagtcaaataatacctaggtggacagagaccacctagaatttacttaacttttttcttagaaaacaccaaacctggatagatttctcaactttcaaataattgacagaaatttttaaaggcatcgtgggatttattaagaaattcttcaaaacacgaccaggtgtggtggctcacacctgtaatcgcagcactttgggaggccaaggtgggcggatcacctgaggtcaggaattcgagaccagcttggccaacatggcgaaatcctgtctctactaaaaatacaaaaattagcccggtgttgtggtgggcacctgtagtcccagctactggggaggctgaggcaggagaatcacttgaacccgggaggcagaggttgcaatgggccgagatcgtgatcgtgccactgcactccagcctgggcaacaagagtgaaactccgtctcaaaaaaaaaaaaaaaaggaaagagattctgcaaaataaaagaaggacatctgatatttaagaaacagaaaaaaattatactttgaaaaagttgagaaaggaaacaatattagatggtattttctttattctcatggggtttgtttaatgaatctgaaaaatatgtagaagatagcagattgccatagaaggaaaccaactgagatgtcagcaattataataataataactaaatatatattgagtaccagattctatattaaagccttcatgaattagctaattaaatctaagtaaatggttattcccaagaacacggaggtaaagaggttaaattacttccctaagattgtataactaataagaaggaggtctcagatttgatcccaaatacactttgacttcagggacctagagagagaagaaataaggatgatttcacaggatcttggatcatcctttgtactcttctgtgttggaattttaaaagaaattatttagggccgggcacggtggctcacgcctgtaatcccagcactttgggaagccgaggtgggcagatcatttgaggtcaagagttcgagaccagcctggccaacgtggtgaaactctgtctctactaaaaaatacaaaaattaggccgggtgtggcagctcacacctgtaatcccagcactttgggaagccgagatgggcagatcatgaggtcaacagatcgagaccatcctggccaacatgatgaaaccccatctctagtaaaaatacagaaattatctgggcgtggtggtgcacgcctgtagtcccagctacttgggaggctgaggcaggagattcacttgaatccgggggaggcagaggttgcagtgagccaagatcgcgccactgcactccagcctggcgacagagcgagactccggctcaaaaaaaaaaaaaaaaaaaaaaaaaacccttttgctgctgccgccgccgcagccatgagtatgctcaggcttcagaagaggctcgcctcttctgtcctctgctgtggcaagaagaaggtctggttggacccgaatgagaccagtgaaattgccaatgccaactcccgtcagcagatgcggaagctgatcaaagatgagctgatcatcagcaagcctgttgacagtccattcctgggcttgatgccggaaaaagaccttggcccgccggaaggcaggcacagtggcataggtaagcggaagggtacagccaatgcgcgaatgccagagaaggtcatgtggattctgcgccggctgcttagaagatactgtgaatctaagaagattgatcgccatatgtatcacagcctgtacctgaaggtgaagggaaatgtgttcaaaaacaagcggattctcatggagcacatccacaagctgaaggcagacaaggcccgcaagaagctcctggctgaccaggctgaggcccccaggtctaagaccaaggaagcacgcaagcacggtgaagaacgcctgcaggccaagaaggaggagatcatcaagactttgtctaaggaggaagagaccaagaaataaaagctccccctttgtctgtacatactggcctccgtgattacatagatcagccattaaaataaaagaaacctttatctgcttgtaaaaataaattagccgagtgtggtggcatgcgcctgtaatcccagctacttgggaggctgaggcaggagaatcgcttgaacccaggaggtggaggttgcagtgagccaagatcgcaccactgcactccagcctgggtgatagagtgagactcagtctccaaaaataaataaataaataagagtaaaaataagcggccgggcgcggtggctcacgcctgtaatcccagcactttgggaggccgaggtgggtggatcacgaggttaggagatcgagaccatcctggctaacacagtgaaaccccgtctctactaaaaatacaaaaaaattagccgggcgtggtggcaggagcctgtagtcccagctacttgggaggctgaggcaggagaatggcgtgaacccgggaggcggagcttgcagtgagccgagatcgtgccactgcactccagcctgggcgacagagcgagactccgtctcaaaaaaaataataaaataagcatcgccgggcacggtggctcacgcctgtaatcccagcactttgggaggccgaggcgggcagatcacctgaggtcgggagttcgagaccagacttaccaacaaggagaaaaaccgtctctactaaaaatacaaaaaaattagtcgggcatggtggcccatgcttgtaatccgagccacttgggaggctgcggcaggagaattgcttgaacccgggaggcagaggttgtggtgagccgagatcaagccattgcactccagcctgggcaaaaaagcgaaactccgtctcaaaaaaaaaaaaaaaaaaaagcgtccaggcaagaggtagaaaagagactgctacaaaaagctatatataaaattcatcacagattttctgctgcactaataaatggtaaaaaaaaaaaaaaaaaaaagaaaagaaaagaaaagaaagaaaaagaaacactggccaggcacagtggctcacacctgtaatcccagcactttgggaggctgaggcaggcggatctcgaggtcaagagatcgagaccatcctggccaacatggtgaaaccccgtctctactaaaagtacaaaagtacaaaaattagccgggcgtggtggcacatgtctacagtcccagcttctcaggaggctgaggcaggagaatcacttgaacccaagagatggaggttgcagtgagccaagatcatgccacaacactccagcctggtgacagagcgagacttcatctcaaaaaaaaaaagaaacactatttacagtgttattaggaaaaagaaaatgtctgcactgttattagcaaaagacaataagcgatagtgttgaagagcagtgaacataatagagtgacaaatataagaccaccttattagtaattagaataaaaatgaatatgttaacatataagtttaaaagatagactcaggaattgtcaaaaaccatatctaagactcacattacctgatttttgaggcctactataaagctgcagtaatcaagataatgtgttattggcaaaagaatggacacatatatcagtagaacagaataaagagtgcagaaatggactcacccaaatatagtcacctgatctctgaaaaaggagcaaagacagtttaatggaagaatgggttttttcaacaaatgatgctagaacaatcaaagtccgtatgcaaaaaaatgaacctaggcatagaccttatacctttcacaaaaaattaactcaaaagggatcatagacctaatgtaaaatataaaactataaaacttctagaagaaaatctgtgtaaccttgggtttggcaatgatttttagatacaacgccaaaagcatgattcatgaaagagaaaactgatgttggtgtttgttaaaattaaaacttcttgtattagtccattttcatactgctatgaagaaatacctgagatttggtaatttataaagagaagaggtttaatggactcacagttccacatggctggggaggcctcacaatcatggcagaaggcaaaggaggaacaaagtcacgtcttacatgatggcaggcaagagagcgtgtgcagaggaactgccctttataaaaccatcagatcttgtaagacttattcactatcatgagaacagcatgggaaaaacccgccctcatgattcaattacctcccacctggtccttcccatgacacatggggattaagggaattacagttcaagatgagattttggtggggccacagctaaaccatatcacttctactctgagaaagatactgttaagagaatgaaaagacaagtcatggactggaagaaaatactttcaagatacatttctgttaaaggactttgtggttagtcaattgcaaagttttgaagccatgcacaagtcagccctcacttatgacatcagttgcaagttcaggggtttccagaacttcctttaggattgataattcactaggagaattgacagaactcattgtaagctgttatactcacagttacagtttattacagctgaaggagacagattaaaatttgtcaaaagaaaaggcacataggacagagtccaggaaattatcaaatacagttataaaccccacaatacatttttagtggttgctttagagtcttgattatcttttttttttaaaaggtcttgctctgtcatccaggctgcagtgtagtgttatgatcatggttcactgtagcctcaaactcctgggctcaagtgattttcctcccttagcctcctaagtagctgagagtacaagtgtgagctagcacacccagctaatttattttttattaaaaaaagttttagctgggcgtgatggctcacacctgtaatcccaacattttgggaggccacggtgggcagatcacctgaggtcgggagttcaagaccagcctgaccaacatggagaaaccctgtctctactaaaaatacaaaattagccgggcatggtggcaatgcctgcctgtaatcccagctactcgggaagctgaggcagaagaatcgcttgaacccaggaggcagaggttgcggtgagctgagattgtgctattgcactccagcctggataacaagagcgagactccgtctcaaaaaaaaaaaaaaatttgtagagatagtgttttgctacgttactcagggtggtctcaaactcctggcctcaggcagttctgcctaagcttcccaaagtactgggattacaggcagaagccactgcgcctaccatagaatattagttatcttttgaagtgattaaaaagggaaaagattttcttccagtttaatgatgagaaaagtgaaagaacagttattttaaagcccctgatatttccaacatctaggtcataaatgagtctcgttctgttgatagctttatctcttggtaatgtgcatgcctgtgtgtgtgtgtgtgtgtgtgtgttttattttgtgtatgtcttataatttttagtttaatggcaaacatcatgtatacaagaacagtagagactgaggtagatggtattttgtgtctggatataggcacgcctctcccatcaggccaattgcctgtgacattgagtcaacctagtctggagttgaggtggatttggattttgatgttggtatcattatgttcagtgtacttgggctgctgttacctggtacctggagcctggggtaccagatggtttttcttcagtgtttctgttccactgttggctttcctcagtcccatcatgcctccatcacagagggggagtctctattcatatccttgccccttcactagtggttgactgatgctgcttgttactcagtgctaggcttatggtggtgtcataggtggttttctattgtcctggttcagccttagctttaggcagtccctgttcatttgaaccccaggggtggtacttaatctgccctttcctgagcagtagcaaacctctgcttggcatcagaatcctgggccaatgaggattctctcctgctctcccagaaacaagatgtttgcttctacctctcccccagcagcaatagggtatgtgagaggtgggaggtttacttgaacccaggaggtcgaggctgcagtgagccatgatagtggcaccacactccagcctgggtgacagagcaagaccctgtctcaaaacaacaacaacaacccaaaaaactgtcaaggtcatcaggaacaaaacatagccaatagccaagaaactgtcacataccagaggagactaaggaaacatgatgactaaatgcaatacaaataaaaaaataaatattggcactgtaagaaaaaatagggcagcagaatgggtaattcacaggagaagaaatgcaaatggctaataaaaatatgagtatgaattcaacttcactagtaattaaactcaaatgtaaatgacaaaaactgatttttgccagtgacattagcaaaggattgtttttgttaatactagcatttggcaaggttgtagagaatatgggaactcagaataatacagcctctctggaggataatttgcgcagtatcatatcaaaaggcttaaaattgtacaaattatttgacttagccatgtctgtgccgttgatttatcttaataaagtaaaggaagatctgtgggaagatttagtcaaagggtgcctatcacggcattgttaataataatgaaaaattgaaagtagcatgataattaacagtatattgtgatattcttgtatggtgatattctgtagatattaaaagttaaacaatttgttaagttcaaaaagttaaactaacatgtatggtgtgatccccttttttgtaaaaaaaaatatgtatcatagaaagactcgatatgtgtacacaaaacattaattgtaatttttggatgattgaattctagatgatttttgtttcctcctgtgtgcttttctatattttgcagttttttctgacatgagcatgtgcagtattttggacattatataaaaagctatttaaaaacgaaatctttttcctctatcaattagcaaagattttcttaaaattattacctttgttggcaaaggtatgagaaattggtatctttattttatatccacttcttattctacatctatttaattcttctcatctacagtatttctacttattctcttttttttttttttttttttttttgagatggagtctcgctctgtcgcccaggctggagtacagtggtatgagctcacctcactgcaagctctgcctcccgggttcacgccattctcttgcctcagcctcctgagtagctgggactacaggcttccgccactactcccgactaatcttttgtatttttagtagagacagggtttcactgtgttagccaggatggtctcaatctcctgacctcatgatccacctgcttcggcctcccagagtgctgggattacaggcgtgtgccactgcgcctggcccttctacttcttctttatatctacttctgtaggggatcagcacaagcactcttgggaagcaaattggtaataaatgtcaaaccccttaaaataatttatattctttcactcagtagaaaggcttctgggggatttgtcattagaaaagaatcagagatgtgggtggagacatgtttattacatgataatgtataactgcaaagtatgaagactgtaaatatccacttaaaagggaaataaaatatgacacaactgtatagtggaatattatgcattcatgagagtatttaaagaatatttattgatgtctgataatcttcttgcttcttagtcttctgctcagaatggcatccatgattatgtttctttccccatgttttttactgtagtcccagataagaaagtaaggactggattccctctcttactttgtgtaaataaccacaactagtaaattacttttccccccacaaaaccatttccttatgtgtatttgtcttcctcagtttcaatttatttgctttactttaattatgggtattatgtgagcctttgcacagttctgtttttctgcctgaaattatcttctccctgcttttaccatggctgagacctcttcaccttctaggttgcagcttaaataatactcagagaggtcttcttggaccaccttatctataataaaagagcatacaatgtattactaataccctttaccatctctctaatgcccactagtttttttcattgcagttaacacagttgatgatgtttttgtatttatttgcttgtttataatgtgtcctccagtagactgtaacttcctgaggctaggaattatatcttcacaagtatatttttaggtcctctcctaatgtctggcacatgtaaacagtcagcaaatatgtgtagattgaatgaacaaactaaattttgcagttttgatgacagcttattaagaatttatcatgttacttagttgaaagttgtcataccaaagttattcttataacacatatttattttagctatattggtttgatatttaatatattttatgtaggaatgtagaggaagaagtttaggttacactcgaggtcatagagagtcttataacgagttcagactaccattggacgctgaggagtgtgtagaatttgaagagacaaagaagagggggaaagacattttgaacaagactgccccatgagttttttaagacaggacagcaggaatatctttagcatgtttgggaaaacatgacagagaattgtgggtgactaatggagctacttgctggtaattataaatggaatgttactagttagaaaatttcatctaggtctaatcattaagagcctggaaagaaggccaaggtagttggaatatcttttgtattcagggcagttcttttaacagatgggaagctactgaaggtatttgatcaagtgaaggtcccttgtcatttattaatttgtttattaatagatatttattgagtgcatgctgtctactatgtggtcttctagatgaggagggtacagagatggaataggagggctggagagccaaaaaccggctgtggaggaactcgcagactgtgggaagtgacagacatgcaaattacaaagggttgtgataaatgttgtaataaatgcacatcatcaatactgtgggaactcaaaataggaccaggtttattcagatagttgtgaatatcttaactaaggaggtgacattttctatgggttttggaggataagcattaatttaccaggtaaagaaaattctgaccttagcagtaaagtcatggaccattcagggaatggtaaataagtcatgcacctggaattgtgggagatgagcctagaaaaacagttatcctaaaacagttatccattaaggaccttgtattatctatttaatgaggaaccatcaaaagttctcatatagaggactgaagtgatcttctttattttttttcccatccagaatagtttacttggcacaaatggactagtatatgacatggagaacagtattaggctttagttagctttttgattaaaatctactcattgaattcatatctgtaattaatactgatagtcaccaagtatgtggactttgagaagtcaagaacttgattagtatttagtccattttcacactgctgataaatgcatacctgagacatggcaatttacaaaagaaagaggtttaattggacttacagttccatgtggctggggaagcctcacaatcatgctggaaggcaagaaggagcaagtcatgtcttatgtgtatggcagcaggcaaagagaggagcgcttgtgcaggaaaactcccacttatagtaaccagcagatctcatgagtcttaccattacaagaacagcaccagaaagacctgcccccatgattcaattacctaccaccaggtccctcccacaacacatgggaattcaagatgagatatgagtggggacacagcgaaaccatatcagttagaatctcagttttaccacttgctagcatttatgcaagttatttgatattagtaagcctacgttttctcatctctctcaatgaggcttatgagtggtttatgggcacttttgaccaaggagatgtaatgaggttgctgttagatgggggagacagtcaaatgagactcttgattagacatactattgtctcagtgtactctgagtgctgagtgaagacagaccttgagacagccataaaaagatagaaatttaatccataaatgcaattagttcaaagtaggtttttgtatggcatgcttaaagatttggaggcaggaactactgaaagtttttaagcaggaatccatatgttccacttttcccaaacagctcctaattatttatggtgtgcccctttcactcctaatggtaattcagtttagataataaattatgtaatcagtcaccttctgaaacaacagtacagcaaaagagatggctgtggttgagccatttagaatacaagtaataagaaaaaaataaaggaaccactccacaagttttggggtggaaacagagaaggaatagtctttataaaagccaagagaaggctgggtgtggtggctcacacctgtaatcccagcactttgggaggccaaggcaggcggatcacgaggtcaggagatcgggaccatcttggttaacacggtgaaaccctgtcactactaaatatacaaaaattagctgggtgtggtggcgggtgcctgtagtcccagctacttgggaggctgaggccgtgagaacctgggaggcagagctttcagtgagccgagattgcgccactgcactccagcctgggtgacagagcaagactccgtctcaaaaaaaaaaaaaaaagccaagagaagattgttgtaatagtattaagaagatgggatttgtaagatcagcaaggccagatacagcaaggctatggagcataagcacacattattagatttatcaaggcagagctcattgtctgctttagacaatgcagttcatttgagcagttggatagaagccaaattgggtttttgtttttttgttttgttttattttttgaggataaggacaatgtcttgtttatttttctctctctagtgcctaactgtggttgtgtcagaggtacttggtgcatttttgaagatttaataattaattaatagttggtgcaggccaggcatggtggctaacacctgtaatcccagcactttgggaggccgaggtgggcggatcacctgaggccaggagttttagaccagcctgaccaacatggagaaacgctgtctctactaaaaatacaaaaaaaattagccaggcgtggtggcgcatgcctgtaatcccagctactctggaggctgaggcgggagaattgcttgaacctgggaggcggaggttgaggtgagccgagatcacgccattgcactccagcctgggcaacaggagcaaaactccgtctcaaaaaaaaaaaaaaaaaaaaaagttggtgcaaaagctgagatagtggctatagataccacactaaaaaattttagtgattaaagagagatgggaagtatgatgtttttagtttggttagcagttagaagggaacaatctctgcatttgaaatgttaagatgaactcagtgggaagagaaatattaaagtttctgaagagggaagtaagtttgaaagctaaagcccttgttgcctacaaaagacccttttgcaaagtggaccctcctggttcagttatctcaccctttgggattctgtgtgccagctgagccaactaattcctttcatgttaaactagtttgagttcgatttctgtcccttataactaaacaaatacttgaatttggatgaagtattctgactctaatgctcatgctgtctccactgtaccatatttcttctctaaggctaaaggtattatctccaaaattttgtccctccctaacttgtgggggctttagtgaactatttctgtcctctctagaatctttgctttctttccctcctatagatccctcgccacgtagctcgtgtaggcctcccttatctttgtgaagccttaaacttaattctgtgggccccactaagttgtgataaagcatgcataggggttttggtagaagataacgttaacacaggtagattggagctgggtctatgttgaaaaaaatttggattactaatttaagtggtttgccattgatttctagatcagagatgtttaatagaactttcttcagtgatggaaatgttctatatctacagtgttcaatacagtagctgttagccacatgcagctccatagagcacttgacatgtggctagcatgactgagaaatcaaattttaaatttaattttatgtatttatctatttttataagacagagtctcactcagtcgcccaggctggagtgcagtggtgtaatctcggctcactgcaacctctgcctcctgggttcaagtgattctcctgcctcaggctcccaagtagctgggattacaggggcctgccaccatgcccagctaatttttgtgtttttagtagagaggggtttcaccatgttggccaggccagtcttgaactcctgacctcaggtgatccacccgccacagcctctcaaagtgctggaattacaagcataagccactgcgcctggctgattttatttaattttaatcaccttaaatttaaatggccacatatggctaaggctaccattttggatggtatagctctagacatcagaagttatatttctcattttgttttgtttttaaactgggagaatgatatatgttagaaaaaaaatggaaacaatgtgggcatttgggtggtgaggatgaggcaagaagaaaatcactttctgttcttgatattaatgcctttaacaaggatgaggaacctaggaggatgagtgggtttgggaaggtagacaggaagttcaatactgagttgagattatgggatatataaacagagatgtccaataggcatctaaagaagagtttacagcagaacagaaaaagccagggctagaagtataaatttctgtagtcatctttgtagaggtgataaagctatagaatataggtcacatcctctagagtgggagtgtagatcttgaagaaaagagcattgagcacagaactcagaaaaatgtgcatattgaaagagtcgagctaagcgtagtagctcacactcgtaatcccagcactttggagggaggcaggaggatcacttgagcctaggagttcagcctgggcaacatagcaaaaccctgtctctataaaaaatacaaaaattagccaggcatggtggtgcacacctgtggtcctggctgcttgggaggctgaagtgggagggatcacctgagcccaggagattgaggctacagtgagctgtgatcacaccactgcacatcaactccagcctgcatgaaagaacaaaaccctctctctcttaaaaaaaaaagagagagagagagaaagaaaaaaagtggaaagaggaagagcagcaggcaaacaggaaatatgaaatatttactatgcaatgtttttaagaaattggcacctaaccatgcaagtgatagcagaaagtttttgctttaggtgtagtgcttgtcaggaagattcaatattttacttgaaaatgtaagtacaggtacaatgtaactaatttctactgcttcattatatagatctgatagatagtttttatttggccaatgcctgccatcattacactattatagtgttatttctgcctatagaatcataaatgtgtctgttaaatgggcttaatatttgggcagattgccaataaatgtcacaaactccagtccaaataaatcagtttataaacctaggagaatgtccagctacctttggtgttttccagataatcagtagttgtaattaatgatgtttaaatggattttctacataagattaaggagaaattgtttgacacaacctatataatctgcatttttatcatctgagtgggaagtcttattactttccccacactgtgtcatacacttgcagaagaacataaaaggtagtgattatgctacgtgccaagaaagacatcagagcagattgaaggggtgtagtatgagtaaagaatttgagaccagagaaaaggctctggaaaggaaggcaagcatggagaaggaaacttgaaggaatagattggctgaaggtcagatctgtggagtagacagtaggtaacaggtcaatttgttgcccagctcagtgcctgatacataataggtgctcagtatttattgaaggaaggaatgggaaaaggaaaattcattctgcaagaacagtagaatcctactttggccccaccttattttatttgtcacttgacctcagttatcacatctttctgaccttgggttgctgttaggtttattgttaaaacatacactaaatagtttatattttaacttgtaattgttgtctagctctggacaattggagggccgggggggtgctctcctatttagagaacacgggaatacgccgggcgcggtggctcacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaaaaaaaaagagaacacgggaatatacttgagtacttggatgtttaatttccttttgttttaagactataacagagtaggtgtgaccatatctagcccctgaatattctggccttgggtgacacaggtgagcacttctagctgatctgacaggttaaaggtgtacacttattttctctgtaagaagcgtcatctggtaagatgatcaagaatggtgcaaagcaggatggggagtttaaaattgtttccaaatgtgggaatgtaaatgaatataaacatgtaagattttaatataccaaactgatcagattctgtgtaatttccaagtttcttttttctttcaaaactcctctgaaatctgactgtccacaaaaacttactttatagaattttatgtgatttatttactcagatattatactgacctcacatccagtagtgaaaacagattttattgtagaatctggaaagatagagggccatataggttgtattttcagttttgtttatactaacacgtgtttacaacccagtttaatttacaccctgtattgtattattgttgtcatatctctgtatgcatgtaagtataatatgtgttggcaaaggaaaattttgagtaagaagaagctctctgatctatttgattcaatatgtatttgagtgtctaacagacactgttttagacactggtgatacaacactgaacggagcaccaaatactttacagcgtctcctggagctgttgtcaagacatactttccaaggggaatatttcagaataggtgataactagtcaacgaaggaaaagtaccttagtcatctaggagagttgtacttagagtgaactgaaataaactaagctcacgaaagacagagattttttgtttggcttttgtctgttgcattcactactgtatctccagggcccaaaatagtgctcggctcataataagtattcagcaaatatatgttgttgattggagtgtttgttttgaatttctgtaatcaaacacataccttggtaaattatctttacatcttgctagttgaaaattttatctcagttgctttgtttttaatgttaccttgctttttgtttctacttgtgccatacatcaggatgctggaaaagcttattaatattgacagtcatatggttatctgatattgaaaagaatagatttggaaaggaacctaagaggtcatcttttgttcagcttcctgcctaggaaaactaagtaagatgattaggtatgtatatttaattagtcatttaaaaaaaaaccaggacaacataattgagttccctcttgagaaaatggagaaaggtacttaaccctagctataaagggactaacctggaaattttagaacttctgtgtgggaaagtggaaaaaaaaaaaaagcacaactaagctgctctttgttgatatcagaaatgggcctgtcattcattttggcattgaagcatagcctcctatctcggggcaggactgggacatttttttcctcccacaagagctggacagttattacaggttcaaaaagccccgaccagtttttcaagagtttctcctcctcttttccccctgaaactcgtggtgcttttgctctgctttcaagatgcattaagtctcctgctttgtgactgctttggagccagcagatactctgatatgtataattcaaattatgcaggtttcacgagtaagtttaatcttattttttaagttagttaaaaggcaagtgatatttagaaaaatgttaacttgtagttatttcaccctttttactttaagcatttttattgcttctcggccttttggctaagatcaagtgtgtactttaagcattttttaaaataaaaatatccttttaatttaataagaaaacaaggttctacatagaaaagccccttcatctaagacctgcacttttcaatttcttttgagatgtctttgttgtaaacagtattcatatgtcttttgaaagccagttaactaaacagttttcttgagcatctttttagttttactgagaagtattttaaattgagcttttctgagctcgattgcttacgtctgacacagtctcaagtttccactgaatggtaacaaagactgtagaatgttgttggtactgcagtgagaggcatgcttccttagaccaggtaagagagatcagtttgtttctcactgctgggtgagtttttacagctcttattttatattctttaagcagcagcaatattaaattgataaatagccaggagcacgctgatttcaagacgtccttgcttgttgcagacagaaaaactacagggttatgtatgggggttggggtggggggggaggggaagaattagtttattactcagttacttatataaattaattaaaatgtgaaaataattctggagctcagttttcttaattcaggaactaaagcagcagttgaggaaatcagtaattttaaaggtacttcatggttattacttgtgaaagcaattcaaaggatagtttttactttcatttttttccccagtagttaataaaataagctttgcccttaactaaacattttttccacttacgaaaacttttaaattgccaacagcaaaatatacttcccaaggatccttggaaatcaacctgacacttgaaaaatatttcagcttttatagctgtttcattcctttttttccctagtacatttttcttaaaagtatttgtgctttgaaaatgtcagctgtattctaatgaagcttaggcattgtttgctcataaaggggccggtgcattccactgctttatggtttattatgaggcacagtgtgagagtgtgggtggcaccatttggtgtctgcctcttggggtagtgactgccattatgttagccttggactggcaaagaaaatatagcatacaagatgctatatgaatctggatactgtgaagaaaatcttacccctaaacaattcttaatgaccccggaatatatgacaacttgattgaattgatcatttcaattatacccttgaagtttgcattttagttacaacgtatattctattagacacgtcttattttttgatatataatagcatttagtcattctttgaagttcaataaggaagtgaatgtttctaaactatgatgtttttaatagatacagtgaaattttaaataatacatttacttaaaaaagttttaaggaacttagtgtgggtggggagcgggagtgggagagggagagggagagggagaggaggtcaggcagagagtctttcttctttcagttaggaaagccctggtgaagaaaaaaagcaacagatgtttcttctgttacaattgaggttgtttcattcaaaactcagagtagctggaatggagagaggaggtcataaatctgatttaatcagtgaataaataaaatttagtcatttaaaatttattattttatattcaggaattgaaagtcatagagtaacaaaatgagtaacatacccaatatttaaaaaaaaactttaaatattgcctgtagcctgtataattaatgaaaatgtgagaaaattaattctgttgaacttcacttaaggaaaaaattgataattaaatcatatagaccatttttttaaagcctaagccatctaaaatatagaggaaacagttgcaaaagtttatcactagacagtaggtacaaaatctcaaaatgaaaataaaatgagaaacatcagttacatatgttgatagatgatttcatcttctgtgagaagctgaggcttattcctaagacctttgcataagaaatatgggagtaatattttgggtttaattgaaatgatatgttgcagtttgcctctaaaaagaaagataataagcttggattggttgctaatggaaagaggagaatgtttatctgctgaaaagagtaggaatgaagagtgtggaagcattatgcgtgtaatgaaagcagtcaaaattttgaaaaacagtttttgaatttttggaattcataatgaggaaagtgaaaacctttccttttacaagtaacacaaagaagtcctatgctgttgtataatgtgcgtgtatacacattacaactttattcatttcttaagtttgctcttgaaaaatcagtgctgagcaccagctctttcacatatgaggcacttattcaatatttgccataccctacactggaaaattcgtagtaatttacagtagccaataaagtttttgagctatagtttaaaatttgcatatggattaattattatacagttttctaaataattggcctaaggagagagaaggctggaaaagatatcaacattcaagcagattattaaaaattcctcttgctgttagctaagatctgtgggcttacctgaagttatttttttgttgtttttttttgttgtttttttgtttttttgagacggaatctcgctgcaagctctgcgtcccaggttcacaccattcacctgcctcagcctccccagtagctgggactacaggcgtccaccaccacgctcagctaattttttgtatttttagtagagatggggtttcatcatgttagccaggatggtctcaatctcctgacctcgtgatctgcccacctcggcctgatggtctcgatctcccgaccttgagatccgcctacctcggcctcccagagtgctgggattatgggcgtgagccactgcgccggccagaagattttcttttcttcaaataatgatgaccaaatttagagattttgaagtttgtttgttttttgagatggagtttcgctcttgttgcccaggctggagtgcaatggtgtgatctcggctcactgcaacctctgcctcctgggttcaagcgattctccttcctcagccccccaagtagctgggattacaggcatgcgcccacacgcctggcctttgaagtttattgaatcattatttcaattaagattcagattctaaaacttatctatgtacattttgcttatcttaaggaatagcaacatgtaatggttgaggttttttctctctaaaataagtaaaacaatttacatggactttaaaatggatttacaaactatagatttgcctaaagaactttttttacaattctgatcaaagaacagaaattttgatggaatagacaggcttaaaaaaaagttggtcactccacatgtaatacataactgtgacagcatcatagattgtgattataaaaaatgtgtatcacttacaattataaatgtagacatgacaataagttacttaacaaggaaaacagtatcagcaacagcaacaaggacatagtttggactcctagcccttcaaattgagaaatgaagaccaaaatcagttgaattattttaagatgaattcccactgcctctgtatgtgtaaattatcttggaattattgaatgtgtggtcaaattatggttgagaagagcacattagttttagcatatatggagtatagaacatagagagtataattttctatattatattgttgatttatactctatgagaaaccaaaccattcaagtttgttacctggaaattggttgggagtgtctgaaggaaaaaacaaacaaaaactttcctaattcatctgccatttagaggtaattccttaattgtctttaatttctagtaaatacttccagtcataatcaatttaaatattaaattaaatctttttttttttttctttgagacagagtctcgctgttgtcgcctgggctggagtgcagtggcacaatctcagctcactgtaacctgtgcttcccgggttcaagcaattctcctgcctcagcctcccgagtagctgagattacaggcgcccgccaccaaacccggctaatttttgtatttttagtagaaacgggatttcaccatgttggccaggctggtctcgaactcctgacctcaggtgatcctctggcctcgacctcccaaagtgctgggattacaggcatgagccattgcacccggtcttaaattaaatatttaaaatgtatactgaaagaagacttcaggagtacctgaagttcttgctttatgtatgaactctttatcacaaaactgaggtcttagaggaacctgagccttacctatttattgtaacccgattcagaatacccagagaggtcaatgatttagccttttttttctgccttatatatacatatgcaactagaaataacagccaccttgaaatttctcatctctggagtggagtaagaggggagatgtgcctgatgcctatatttctctgaagagaaaaccttttacattgttgaggagcaggtagaccagtatgagtatggtgctttgagtatattatgaattaactatgttttgtgaactgatccaggaacctgtcatgtaattatgttgtttctttctaccaagtttcaagaaaccaattttcaaatgaatttttacatggtaactctaaagctggagactatcaaccggggactttggttttggcactttgctcacttgtagtgaaaatttggcaactcttggcaatttctctgacagaaaaatgaacagaccactaagtgagcacttactgtgtgccaggtagacacagtagaacttatttataaaagttctcaaaaatcttttaatgggctgggcatggtggcacatgcctgtaatcccagcacctggagaggtaggcagatcactttaactcaggagttcaagaccagcctgggcacatggcaaaatcctgtctctacaaaaaatacaaaaattaactgggcatggtggcacgcacctgtggtcccagctactcgggagaatgaggtgggaggatcccttgagcccaggtcagggctgcagtgagtggagatcatgccactgcactccggcctaggcaacagagcaagaccctgtctcaaaaaaaatttaaaaatctttaatggataaatttttaatacaaagagattttgttgacattgatgtctaactttaagatttcttgcatttcacaatgtgatttaaatgtagcttcagtaatagccctcaagtagaatatattgttgagattataatatcaataacttactgcagttttgagtgagctacttagtgcatggtattataaaacaacgatcccctcttttatttgctaaggagaagaactgctttggaactcttaattcatgggtggtccttggtccctttgaatttgtatcctaaagttttacgtttattttaagtaccccccagccaggcgtggtggttcacgcctgtaatcccagcacattgggaggccggggcaggtggatcacttgaggtcaggagttcgagaccagcctggacaacatggcgaaaccctgtctctactaaaaatacaagaaaaaaaaaaagccagatgtggtggcacacgcccataatcccagctactcaggaggctgagacaggagattcacttgaacgcgggaggcggaggttacggtgagctgagatcacgccactgcactccagcctaggtgacacaacaagactctatctcaaataaataaaaaaacttattttaaaaacccaactttttttctttttcttttctttttctttttttttttttttttttttgagacggagggagtctcactgcgttgccaggctggagtgcagtgacacgatcttggcttactgcaacctccgcctcccgggttcaagcaattctcctgcctcagcctcctgagtagctgggactacgggcgcatgccactgcgcccggctaatttttgtatttttactagagatggggtttcaccacgttggccaggctagtctcaaactcctgacttcgtaatccacccgccttggcctcccaaagtgctgggattcaggcgtgagccacctgtgcccggcccaggaacccagctttttaattcaaagtctgtctgcagtcatggtcacctcttataaatattagaaaaatatctcacttaactgtaaatttaaaaggatttatctgttacccctgtctggctaccctctcggactgtgagcttcttcatgagagtaatttccagtgaagtactcttgggtatttgagtactcataaattctgatccttgtggttgcactcagctgtcttgatcaactctagccattcagtggctgttggtatgagataaaatgtgctgctttctgtgctttctcttttactaggcctgtaaacagtgtctgtgtgccatctggtgggtgtattgactgttgtgatggtgctaacagtggtgattgaaaatgggctaaacagtgaaaaaatataacacttaagaacaagaaacagaagaaataagggtcactcagactcttttaaaatgagaatagaaataagttcagtgtactagagtccacttgcatttcgttatttccttaatttgaacaaagagtcttaccagaccataagaatcatctgaggcacttaaaaatacaaattctccacctaatttttgaatctttaggtgtccagtggagctcaggagtgtgtgttttgaataagagacacctctcttccctttgtagtgaatcttgtgatcactcatatttgggaagaactgccgggaaggattgggaggatcaagttgtttgaggacatacagtaaacttcctcaattattaatcagaagatacatttcaaaactaggaaattttagttgagcaggtggaagaaaaatgagaaattgaacaattaaaaagtttccttgactgaatatgctaacagaaaaaagatttcaaaaggacatattttaactaaagataaagaagccaatgaaaaaccagcagtatcaaacctacagatgagacaaatgtttttgggtgaacacttaaaaaattattgaaggagaagggccctgcaagtgaccttagtgatttctaagatcttttaggtttgatgaactaaatgaaaccaattataatattccagataccagagcttgaattgaggagtttgcttaagcaatgaggagatactgtttaaatcttgcaatgtggtaagatggagaagaaaaaatgtttttctcctttcaaatttaagaatttagggcattcatggttctagatacaagaaaaggagggagctagctaatcgtttttagaaagtgtcccctaagtgaaaatgttcaacaaagccaagagaacaggtttgatcttctagggaaagtatgtaggaaagactgacatataagatttattcatttagaaatatgaccatagagctataaatacacttaatattatggtcatttcaaggatcctttggaaagattctggttaggtgatccatttgggtgaatcctgaaagttctctatgttctggcagctgcagaaacattcaggcttttccttccgtgtatgtgatatgtaggaatgtgcgtgtcagattttctgtccttatctttgcacaatgggatgcctgatctccatttagaaccaaatagaaagaggaaggttccagaggtcactttaaccattatactttggagatattatgaacttttttatcttctctttgtcacccatcccaattatagtgatgttgaggtcattcagttaaaaagttttgtaatagtgattaactttgtatttaatcttagtgacttttggcgaacatggttcagtacaaatgcatcaaaataaaacataacagtggtgtaatgtgcatgtgcaggtaggtaatactagttagtaaataaagtgaaaactatttttttttttttgagacagggtgttgctttgtcacccagatgggagtgcagtggcatgaacacagctcactgcagcttcgacttcctgggttcaggagatcctcttgcctcagcctcccatatagctgggaccataagtgtgtgtcactacacctgggtaattttattatttttttgtagagatgaggccttactatgttgcccaggctggtcttgaattcctggactcaagcaatcctcctgcctcagcctcccaaagtgctggaactgtaggcatgagtcatcacacctagcctgaaaactttttttttttttttaaagaaaaaggtatatgagtatatttaaacataaaaatgaaggaagtcagagtaactgcaaagtttgtttttatttcatttacataggtgatgctgttgacctacagagcctgagttactttcttctttctttcttttcccccccgagacggagtcttgctctgttgcccaggctggagtgcaatggcaccatctcggctcaccgcaacctccacttcccgagtgcaagcaattctcctgcctcagccacccaagcagctgggattataggcacacaccaccactcctggctaattttttatatttttagtagaggcagggtttcaccatgttggtcaggctagtcttgaactcctgacctccttatccacccaccttggcctcccaaagtgctgggattacagacgtgagccaccgtccctggcccaagagttatttttgaaatacaggtgatagatatcccctgagtcatccatatcctttctccctagtctactttgttttcagtggcatatattgctttctagatggctggctaaaattagaaatacagtcttaaggttgtgaaatcatttctctttgcaaaacaaattgccccttctagaattgacctgtgacttgacctcttcagtactgtatttgaagctaattgatagtcttttacagtagttattaacagatagttaaaaggtagtacaggaaggaaggaaatgctctgacactactttctttttctgactcagcttattcttttgtggaactgttaatcatgaatgaaacaaaaccatggggaactgacatatgaagaggcagatcagtggagcagaatagaaaatcaataaattgacccaaataagtaaactcaaggttgcatttcatatcagcatggagtggattattcattaaaagtggctaactcagggggaaaaccttggatctgtcacttcttatatcagataacttccaggtgggtcaaggatttataatttaaaatgaaggctttaaaattgtataagaagatgttggggggggtgtttaatataatcttagtatacattctaactgctgataattaatttataagaacagcatatccaactggaaatataaaacctatacgataagtaaaatgcagcatgtttaaagtgcatgtataaagtacacttccagggagcaaaggtaaatttaggaaaaccctggcaattagtctcacttccttcatttttatatttaaacacacacaggcctttttaagtttgacacaaaagtcattaaaaagttacaaaattgactacattcttaaaaatgtgcaaataggccgggcgcagtggctcacgcctgtaatcccagcactttgggaggctgaggcgggcgggttacctgaggtcaggagttcaagatcagcctgggcaacacggtgaaaccccgtctctactaaaaatacaaaattagttgggcatggtgacacatgcctgtaatcccagctactcaggaggctgaggcaggagaatccattgaacctgggaggcggaggatgcggtgagccgagatcgtgccattgcagtccagcctgggcaacaagagtaaatctccgtctcaccaaaacaaaaaaaaaaaaaaaaaaaatgtgcgaagaataatatataaaagcaaacactgttcaattgggggaaatatttgcagcaagtataatagaataaacgtatttcttcaatatttaaagacgttctaccaaaaaaaaaaaaaaaaactcaccaaaaaccaataggtggacataattttcaggaaggaacatttacataacttttaaacaaaagatgctcagtgttcagccatactcataacaatatattaaaaccaaaataagaccaaaatgagttactatacttaattttaaatgtaaaagttgtcaaagaaaataaaatttaaaaacacattgcctgggtgcagtggctcacacctatagtcccactttgggaggccgaggtgggaggattgcttgagcccaggagttcaagaatagcctgggcaacatggtgagaccctgtctctacaaaaaatttaaaaattagctggatgtggtggcgtactgaggaggctgagtgggaaggatgacttgaaccctggagtttgaggctgcagtaagctgtgattgttccactgcagtccagcctgggtgacagaaggaaaccccgtctctaaaaaaataaaaaaataaaaaacagtagattaatgaggatatatgtaaatggagactttcatgcatttctaaagggagaaatacacagttgatacaagtaatgtgggtaaagaaatatgtatagtcattgcagtagtatatgtaatactaaaacttttccattactcaggagctcaataaatagactgctggagccataaaagggaatactatgtagctaataaaataaacattgaggcctggtacggtggctgacgcctgtaatcctagcactttgggaggccaaggtgggcagatcacctgaggtcaggagtttgagaccagcctggccagcatgacgagacccctgtctctactgaaagtataaaaattagccaagcgtggtgatgggtgcctgtaatcccagctcttcaggaggctgaggcaggagaatcgcctgaacccaggaggcggaggttgcagtaaaccaagatcgtgccactgcactccagcctggacgacaagagcaggactccatctcataaataaataaataaataaaatattgaggcaacactacatctacagatatggaaaggcatctgagatggatataaaagcaacgctcagactgatagaaggatatctttggctgggcgcggtggctcacgcctgtaatcccagcactttgggaggctgaggcgggtggatcacgaggtcaggcgttcgaaaccagcctgaccaacatggtgaaaccccgtctctactacaaatacaaaaattagccaggcatggtggcatgtgcctgtaatccaagctactcaggaggctgagacaggagaatcgcatgaacccggcaggcacaggttgcagtgagccaagatcatgccactgcactccagcctaggcgacagagcgagactccatctcaaaaaaaaaaaaaaaaaaaaaagaatatttttgcatatgtgtttgcatatgctgaggatatttttggaagcttatctacaaactggcaccacagctgtcactaaggaagggaatattttggtggtgattcgggatggcaggagactcagttttcactgtacactctagttttatgaatttgtatatatacttccatgtagacattcatgtacttaccaatttattcatccaacaaatattaagctctgctgtatgctagtgttggagacacctagctggagcaatgaatgagatgacaaagcccctattgttgtagaacttaacattctgagagtgacaagacagatagtaattatataagtaaatataaatatgtaatgtgtcatatagagataagtactatggtggaaaaataaagtatagtaaattaggaagtgctgatatagggtggtagatatctctgctgccgtgtcaacttagcagacttgaaggaaacgggaataagacgtaggatatctgggggaggattacaggcagaggagacttgaaggacaaaggccatgaagtagaaatttggttggcatgggttgaagaacagcaaagaggtcagtgtgaatgcagaggaatgaagtagggagagattgacaggtgacaaggtcagaaagaggactgcagatgatatagggctttgtaaaccctcattaaggactcaagctaactgagatgtgatgccagttggagagttttgaagaggactcctccatgtagtgggatcactctgactgctgtgtggaggataaatcagttgggtttcctagtataatgtaatccacttatgtaattgcaaattttctagtagcaatattttaatactatgaagggacaggtgaaatttattttaatgatggattttattgaacccaaacatttattaaaacattatacaaacatttactaaaacttaccatctggccaggtgtggtggctcatgcctgtaatcccagcacttagggatgccaaggcacatggatcgcttgaggtcaggagttcaagaccagcctggccaacatggcaaaaccccatctctactaaaaatacaaaaaaattagccaggtgtgctggtgggcacctgtagtcccagctactcgggaggctgaggcaggagaattgcttgaacccaggaggtggaggttgcagtgagctgagatcgcaccactgcactctagcctgggtgacagagtgagactgtcttaaaaaaaaaaaaaaaatgttgctgggcgtggtggttcacgcctgtaatcccagcactttgggaggccaagtgggtggatcacgagatcaggagtttgagaccagcctggccaacatagtgaaaccccatctctacaaaaattagctaggtgtggtggcaggcccctgtaattccagctactcgggaggctgaggcaggagaattgctcgaacccaggagatggaggttgcaatgagctgagatcgcaccactatactccagcctgggtgacagagcaagactccatctctaaggaaaaaataaagaagttgaaaacatcatccaacatgtaatcaatataaacattattagtcagatattttatagtttttttgtgctaagttttcaaaatctgatgcatattttatacctagagcacatctcagtttagatgctacattttcagcaattgaagtgaaatatagccctaccaaaatgataaagttgtgtttaatgggaaaatacttcatttactttagttttaaaatatgttaattaaaattaaattaatttaaaatctaggtctaaccacatttcaagtgctcagtagccacctgtgtctagtgagtgctgtattagagagcatggaaatagagttgtggggtagggtgggcagcagcatggagctgcgtcaggaacctattgcagtaattgaagccaagatgttggccgggaccagagtgttagcagaggagtaggtgagaagtggttgtattcaagctgtattttaaagatccagcttgcgggacttatgaatggattgaatgtgggatatcagagaaagtgaggtctcaacagtaatcttttcagtctgagcagttgaagaatagagttttcatttactgagatgaagaaggagatttctggatggggtgggggcagtccagagttagattttggatatgttaagtttgagatacgtgtaagacatcaaaatggagatatgagaagatagtggatatgtgaatccaaagttcaaggaatagatgtaatctggagaaatatacacgagagtcatcagtgtatttaaagccaggagacttagatgggatcatctcatgaggaagggctcacagacaagagattggaggaccaagctaaggggctcccaaatgtttagagagaaggagccaacaactaaggctgagaaggaatggccagtaggttgggaggagaaccaggagaaaatggtggcttggatatcaagtggagttagtgtttctaaagaaggtgtgattttaaaaagtgtcaagagtagatggaaggttaaagtaaattgaaggccaagaatttcagtggaattgtgggggaaaattgggaagagagggttcaaaagaaactgagatgtggaggaagtggaaacagcaaatgctggcagattttgtgagtagttttgctgtagagggcaacaaattagttggtaactggaggaccgtggatggtcaagaaaagttggttttttgtttttgagatggaagaaattatgcatgtttatgtgctgatgagaatgatctgacagagagggaaagattgtgatgatgcaggagactgacttaaaagggacagtagttgaagggatgttttttagacaagaagatgaactacctgtatttttttttaagggccagttgaggtgacagaagaagaaaagcaagaagatggtgtaatctatagttagcatcttactaattaatatgaactcgcccaagttacatttttccatcattttattaaggtatagtttacatacagtagaatcaccccttttagcctagtgttctgggacttcagcaaacacatacaccaccacagtctaggtcattttaacttatttatgctgggtgtggtggctcatgcctggaatcccagtgctttggcgaggtgggaggatcgcttgagctcaagagtttgagaccagcccgggcaatatactgagaccccctccctacaaaaaataaaaataaaaaaaaatacctgggcatggtggtgcacaccaattgttccagcttactggagagctgaggcaggaggataacttgagccaggagtttgaggctgcagtgagctgtgatagtgccactgctctccaggctgaatgacagagcaagatcctgtctcaaaacaaacaaaccaaacacttttattttgggcaataggttagcttgttctgggaagttggaccctgtatatatgggatataccattgcttctaatttaagagatttataaacccacaaaaaatatgtattatttcttatagtaagttaccagtttggttcttgtaggaggatgtgatgtaggcttgggtgaagaaggtttttcctaaagctaattcaagcaaaaaaaaatttttttcagaaagtctgtgccatgaaaaaaaagttatattagcatcatatagacaaaccacaattatgtaactggatattttttttcattttagttggacatattgaaggtgattaattgtaactggaaccccctaaagaattatagtggaaaaaaaaatatgtggtgtctagacaattctagtggaagacaaaaatatttcagttactcaataaattgaaataatatttgagccaaaatcttgtgcctgtgccaagatctggcataagtttttagttctgtttcttagccacttctctaggtgattgatctcatttagttaattgagggaattgccagaaccaaaatccaggcaacattaaaaatcgttgtttttaatacactgagtcccaggaatcagtttctggacagtgtcgagctcctattgccaaggagctatgaatttaggccatgcacttaggaaaaactgtttagactttacttctctcagcctggctggaattttggttgactgaatctttataatctatttaaaggtgtccttttgagtcaaaaacatagctgatttgatggaagtaagttttgtctaaacatgtggcttttatttctgggtattacaactattggaattctagtggaatccttttaactacttttaaagcaaatttcatttttactacttataagaatcatttctagatcttcaacttgttttagtagctatggctgattcattctctctctctttttcagaatgacagtaacttttatttttatttatttatttatttttaagatggagtctcgctctgtcacccaggctggagtgcaagtggtgcgatcttagctcatggcaacctccgcctcccgggttcaagtgattctcctgcctcagcctcctaagtagctgggattacaaatgcgtgccaccatacctggctaatttttgtatttttagtagagacggggtttcaccatgttgatcaggctggtctcaaactcctggcctcgtgatcctcctgcctcggcctcccaaagtgctgggattacaagcgtgagccaccgcgcctggcaacagtagcttttaaaattataaaacaagtgcatgcatcttcataaaatgtttttttaaataataaaatgtataaaacaaatgcttcctccatgctactcatcagtgctaaccactattaaatttgtagtttctcttggcagactttttatgaatatataaaaatatatgaaaaatatatgtatatgtagtttttcaggtaaatgtaatcgtgttctcttataataggacatttttccatggcaatacgtgcttgtatttttagggactatataatattccatcatacacatgtaccaaaagatgtttaaacacttaaattgtttgtaggtctttgcttttctccacaatgctccaatcccaggacatgtagaattgttcttatctgcctagtttattagagtatatttccaccagaggaattgctagtcagagggtatgcccattgtcaatcatgatgtcacagaagccagacattagcttgccacttaggcaacagagggtatttgttgaaatggaaaaaagctttaaaatgtgtagaattataggccgagcatggtggctcacgcctatgatcccagcactttgggaggccgaggcaggcaggtcatgaagtcaggagatcgagaccgtcctggctaacacagtgaaaccccgtctctactaaaaatacaaaaaattagccgggtgtggtggtgggcacctgtagtcccagctacttgggaggctgaggcaggagaatggcatgaacccgggaggcagagcttgcagtgagccaagctcacaccactgcactccagcctgggtgacagagcgagactctgtctcaaaaaaaaaaaaaaagaaagaaagaaagaaaaaaaagtgtagaattatttttaaagcatttatgtagaattttgtattctaacaagggtcagtttattcctctctaattaaaatcaacacattgtcagaacctccagaaaggctctacagtattcccttcactaacaaagtatgttagtcccttgagtgcagggaacagtgttacttgttcactgaatatcctaatgcttagccttagttcttgacatagaatagtaggtgccaagtcagtacttttaaaatgtgcctgttttgccacatccttaccaactcagtgcattatcagacttgttaattttttatcagtctagtatgcaaaaaggtttcctttttaaaaaagtttgttgttttttttttttccttgttttcctcacttcttttttttttttctttttttttttattatactttaagttttagggtacatgtgcaccttgtgcaggttagttacatatgtatacatgtgccatgctggtgcgctgcacccactaactcgtcatctagcattaggtatatctcccaatgctatccctcccccctccccccaccccaccacagtccccagagtatgatattccccttcctgtgtccatgtgatctcaatattcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagacgagtaggttgcgaaaattttctcccattttgtaggttgcctgttcactctgatggtaggtttttttttttttttttttttgagacagagtcttgctctgtcacccaggctggagttcattagcgcgatcttggctcactgcaacctctgcctcccgggttcaagcgattctcctgcctcagccccccaagtagctgggattacaggcacacgccaccatgcccagctgatttttgtatttttagtagagacggaatttcaccatgttggccaagctggtgtcgaactcttgacctcgtgatccacccaccttggcctcccaaagtgctgggattacaggtgtgagccactgcgcccggcccaaaagttagttttttaattattaaaatcaagcgtcttttcatgtgatgactggcatctgtatttcttcatataccggatttatttttatatgggagtattgcctttttcttattgatttataagagtaggttaaataaacaaaaatttttaagaatggtaatcaaatgacctgtgccttgcacatttgtttaccagcctgacatttgtcttctaagtatattaagtcttgctatagagaaagttttgatttttaaagtagtcagatccatcagtcttttcacttaagatatctgaattctgtaacatggtgaggagggcctttctcattccaggattataaaaatattattatattttttcttctaatacttctataaagttttaatttttatgtttcaatatttgatttttctgaaatttatttttgttcagtgtgaaaaattgaaatctaaaatttcttttatccaaatggatagtctcttgtctcaacattattggtttgaaatactacctttatcatgtacaaaattttcatgtataggtgaaattatttctggactgtaatttttgttttgtcaatttctttttctttttctttctttttttttttttttgagacagagtcttgctctgttgttgcccaggctggagtgcagtggcgctatcttggctgtctgcaacctccacctcctcggttcaagattctcatgcctcagcctcccaagtagctgggattacaggtgtgtaccaccatgcccggctaatttttgtatttttagtagagacagggtttcgccatgttggccaggctggtttcgaactcctgacctcaggtgatctgccctgcttggcttcccaaaatgctgggattacaggcatgagccaccgtgcccggccacattttgttttaagaaaatcagttgcacaattacaaggtagggaaactttatttgataataccagttcagtcatgttaaaagcaaaataaacaaaggacctgctgtttaaattgatttcaaactcaggatgagttatgatcttggttggaaaaataataagggttgtaattaaactgtattgcaggaagtttggcatccagattaggaaaggtaatactttcaatctttgctgatcaaacagtttttatcatttgtgcacctgttttgtgccaaggactaaactagatgctgggatacaaagctgagagacgtagcccatttataatagaattgcaagtcagtaataacaggttttatgagaagccagaagaggaatatccagaatttagaccacaggggatgggacagcttttaacaagaaggagatgcatagagcagaggctttggaggtggagctgtcggcttcactactatgggaccttgtatttaatctcaatctcaatttcttaatgtacaaaatagggtcactaataatctatttcacactgttgtctgtcctaagcatcgatgaggaaaaaatatacacacatacatacacacacataaaatgtatatatatgtgtatacttttttcctcattgatgcttaggacaacagtgtgtatgtgtgcatatatatgtgtgtgtatatatatatacactttatatgcgtatgtatatatgtacatacgtatatgtatgtatatgtaggaaacctctgaaacactctggggacataataattgctcagaaaatggtgtggaatccatccattttgaagtgctagtaggtaggagttggctcagtagagaagggccttctcagcagaaggaaaggtgtataacaaagccaggtggttgaattggggcctctctggaaatgtaaagtatttaatctggttggattgtggggtacatgtggagggagcagctgaagatgaaactgtgaaaggaggcaggggtgggatctccactgcgagcttttgtgccatgttgaggagtctgagaggcatttaggaagtgttgtggagtccttaaaaaccattattaggggagtgttcagaacagttttgccagttgaaagactggtttgttatagatgcatggagtggctaggaaagctgttagaggtaggatatctagtaagagccgtggtgctcagccctggctgcacattggaactgtctggagaacatttaatggcccgatgcccaggttcaccccagatcaattatatcagcagctctaggattggaacctaggaattggtattgttcattgttccccaggtgattccaccggacagccagtattgtgaatcactgagttagagggtaactgtattcaaaccagatatgaagttgcaaattaaacgagtgccagcagcataaagcaggggtccccaactggccaccaggtaccagtccgtggcctgttaggagctgggccacacagcaggaggtgagtggcaggcaggcaagccagtgagtgagcaaagcttcatctgtatttgcagccactccccatcactcgcatcactgcctgagctccgcctcctgtcagatcagcagcggcattagattatcataggagcacaaaccctattgtgaactgtgcatgtgagggatctaggttgcacactccttatgagaatctaatgcctgatgaactgtcactatctcccatcactcccagatgggactctctagtagcaggaaaacaagcccaaggctcccactgattccacattgtgatgatttgtataactaattcattatatactacagtgtaataataatagaaataaagtgcacaataaatgtaatattctggaatcattgcaaaaccatacctcccttcacccctgtctgtggaaaaactgtcttccacgaaaccagttcctggtgctaaaacggttggggaccactagcataaaggaactagaataaggaaataacaaatatggtggtcagttgaatgaggaggagatggagtgaagatctgaagatcatttctagattagatcactgggtggattcgatgatcgtataagagggctcagtcatatatcgagtgagaacaggaaggagaagcagatttgggtactaggacttgctgagtgggtacaagaaatagaatttgatttttatatgtggaattagggggaaaattaactctataatgccaaatgggcagaaaaactgaagggaaagggccaatggaatagttgaaaattccggagacagagtagataattgatgggtgagatccctgaagaggcagaaagtgcagagcagagatgaaagaagtcatttagggccaggcgtggtggctcacgcctgtaatccagaactttgggaggctgaggcaggcgattacccaaggtcaggagttccagatcagcctggccaacatggtgaaaccccatctttactaaaacacaaaaattagccaggcatgatggcaggtgcctggagttccagctacccaggaggctgagacgagagaaccacttgaacctgggaagcggaggttgcagtgagccaagattgtgccactgaactccagcctgggtgacagagcaagactctcaaaaaaaaagaaaaagaaaaagaagtcatttaggctgggtgccgtggctcaagcctttaatcccagcactttgggaggctaagggggagaactgcttgaagcccaggagtttgagaccaggctgggcaacatggcaagaccccatctctacaaaataaaaaagttagccaggtgtggtgatgcatgcctgtggtgtcagccactttggaggctgaggtgggaggatcacttaagccctggagtttgagcctgtagtgacctgtgattgcatcactgtcctctagcctgggtgtcagagcgagacccccatctcaaaaaaaaaaaaaaaatagtaagggaattaaagagtgtggtcaagttttggaagatgggggtcatctgaggaaggcaactaagaaggaaatgtctttgttgtcctacccttaaatgttgcttgtccccagggttttagtgttggccttctttcacatacttcatggatgatctcctttgatatattttgttacactgttaacttctgagagaaacattgataagctgaagtttgttgggggaattaagtagttgatgttatagttcagaaaataataggttggcttttccttttggggggaattttcttggtagcagtttgctatgttaatttgaaatttaaaatactgaaatcacttgaaaacacggtacagatcccactgtttctagtattaataactagttagcaccatgttttttctctagttataaaaccctaaagcattaccaatttgacagtttgaaaatatgttagcttttagtctcagtgttttatactataaagaaatctgaatagttattttacttttcatgttatgtttcatcatcaagtatattatttgttctgttatgtctattaaagatctctttctcaattctgatataaactgtgatttgcgttacatattctctaaaaattttttcttctaaaagactaactgaaagtttcgtagttaattgtcagataattggaactatttattttatagagtttcagtaaaatataaataagattagttatgcagcaaaattaattgtattccttacaacaaagcagtcattagtatgacttttcagtaaggtgtattttgttcataatatgcttcctaagataattataaattacctcaacataatgaattaggaccatgggtgtgtatatagctagaaaatggccttggtatggcagaatactaacttaatgttttgatatcatttcaggcaacatttcatttgttgcatttccagtttccaataccaactcacctacaaagattttaccaaaaaccttaggaccaataaatgtgaatgttggaccccaaatggtaagaaaattatcaaatcttagaattgaaactttgtttagccaagactaatttaaagaataattgcattaaatatatttgatcagatattccagttaaaccaggcgcggtaggtggctcactcctgtaatcccaacactttgggaggccgaggcaggtggatcacttgagcccaggagttcaagaccagcctgggcaacatggtgaaaccctgtctctacaaaaaacagctgggcactgtggcgcatgcctgaagtcccagctacttggaggactgaggcgggaggattgcttgagcccaagaggtcaaggccacagtgagccgtgtttgcaccactgcactcctgcctgggtgataaagcaagaccctgtctcaaaaagaaaaagaaaaaattatagttaatttcagttatctgagtcacttttaaaaaacgttctgtttttatctgaatgtatctggtcaagttttgagcttgagaaacattgtgtgctctttgatatttaattttcacatatttgaatctgtggattctggatgtgtagtattaagtcttttcctctttatgtgaggtttctcttgtattgtttaaattgatttgaaatgtgttatgctttatgtcttcctgcttttttctttttcttataaaataacctttactactctaaactatgtattctcacataaatggaatctgtgacccaacagttaatttacatctggagttattaatttaaaactcctttcattaaggacttttggggaaaaaacaatataccaatttattttaatctgtagcagtagaaataatgaatgaaaaatggaaaacaactgtttctctaaagacattcattaattatgctagagcatgaagtgtgtagcactttcagaagacttatttataagcaaggttgcattccactactctgaaactatgtctaaatggcctcacccaccattagtaaaagtactcaaacatttaagcaataactcttcattgccggtgttttcatcttttcatctatagagcaataaggataaattttacccataatgtacaacagcactgtggactatgttaaatgcaaagttatttagacaaagatatcttttaacatacctaatggtttcagaaagtctctaagacttcaggacacattctagacatgatattttccttggttagttgaggactgtttatcatctgcagaaatcaagctaaagatacaacacaatttactgtaactatgtgaagaatgtagtctagctccaaacctcatagagatttaagctcaaataagagccctcatttcaaggtagctcaggttatattttcagacatttgctaagcatttgcccctcctcagccactactataggtgcaaatgagataaagcacctgacttaaaaatctgcattttgaaatgtgattatataagcaccaaaattaaacatactcaaatttttatgagtcttgcccttacagtactcttctgttttgagagattattttctattattttttgtttaatgctgctataccccaatttgaatttctcctttggaagcatgtataatttttctcccattgtcagtttgaactaatgtgcattttggcccttacacagtccagttctgttaataataagtagtgatgtgtgctactaactcagttactgtaaatctcaggatcagcaaaacaaaggtcacaagaaggagaggcgatttggaactctaccttcaactgggccatcccaagtacttaatttgtccccctacttctgaggtccttttttcagttctgagttcttgggcaggaatcagaattttgtttttggtttcctaattgttgtaagattccattgctgtctcttgaatgtgtccctccaaaattcatgttgaagcttaatccctattgtggtgctattaagggatagagcctttggggaagtgattaagctatgagggcttcattctcattgaggggattagtgaccttataaaagaagttgaggctgggtgtggtgtctcacgcctgtaatcccagcactttgggaggccatggtgggcgggtcatgagatcaagagactgagaccatcctggtcaacatggtgaaacccatctctactaaaaatacaaaaattgccgggtgtggtggctcatgtctgtaatcccagcactttgggaggccaaggtgggtggatcacgaggtcaggagatcgagaccatcctggctaacacagtgaaaccccatgtctactaaaatacaaaaaattagccaagcatggtgacacacatgtagtcccagatactcgggaggctgaggcaggagaattgcttgaacccgggaggaagaagttgtagtgagcagagatcgcggcactgtactccagcctgggtgacagagcaagactccatctaaaaaaaaaaaaaagttgaagggagctctttgcccccttctgccccacttcatgtagtgaagacactacaagaaggtaccatctatgaagcagagagtgagccttctgaatttgctggtgtcttgatcctggacttcccagccaccagaactataagaaatacatttctatcatttataaattacctatgctaaggtattttgttatagcagactaagacaaaaattagtgccaagaactggggtgtggccataacaaacacctaaaactgtagaagtggctttggaactggataatgggcagaggctggaagagttcagaggaacaggctggaaaaagcctcttgagatgaatggaccattaagggtgattctggtgaggaatcagaaaaggagagctatagagaaagcctcacttttcttagagattacctccgtggtcatgaacagaatgttggcacaaatatggatggtaaaggccattataatgaggtatcagataggagtgagggacatgttattggaaactggaggaaaagccatccttgttacagagtagcaaaaggctgggcccagtggctcattcctgtaatcccaacattttgtgaggccaaggcagaaggatttcctgagcccaggagttcaagaccagcctgagcaacatagtgagacctcatctttatcaaaaaaaaaaaaaaaaaaaaacactaaaaataaaaaattagctaggccgggtgcagtggcttatacctgtaatcccagcactttgggaggccaaggctggcagatcacttgaggtcaggagttcgagaacagcctggcccacatggtgaaaccctgtctctactaaaaatacaaaaattagccggacatggtggcgggtgcctgtaatcccagctacttgggaggctgaggcaggaagatcactcgaatctgggaggctgaggttgcagtgagcagagattgcaccactgcactccagcctgggcaacagagcgagactttgtctcagacaaaaaaaaaaaaaaaaaaccaggcatggtggcacctagccactcaggagactaaggagagaggatcacttgggcccaagagtccaaggctgtagtgaccctgacagagtaagactctatctcaaaaaaataaaagaactaaacaacaaccaaaaaagtggcaagggacttcactgaattgttttcctgttttaatgttttgtggaaggaggaacttaggagccgtgaaattggatatttggtcaaagaaatctctaagcaaagtgtttagggatcaacatggcttctcttggctgtttatagtaaaatgtgagaagagagaaatgaattaaagatataatttatcatcagaagtgaagatttgggaaattctcagcttggccatgtaaagaataaaaaagcatgttttggagagaacaccaaaagagtggcctagtcaccttttgataaggagattagcgtgcatgggtggaagcttggtgttgttcatcaaaacaatggaagaataaacccatagcatttcagtgattaccggtgctgctcctcccatcacaggcccagagtgccaaggcatgggggacagaactatcaaaagaggggcttcaggcgctaatgaaaccctggcaatcccttcctggcactgtgtcaagtctgctccccgaattttggcacagtgctccttagccattccaggtgtggctccagtaggcccaagtatagtggctgctcctctagagggcacaggtggtgaaccttggcagtgtctgagtgatgccatctccagtgggtgcagagtgtacaagctgcggggtatgataacttccacctagatttcaaaagatgccctggagagccttagcagatcctggcagagaattgctacagaggtgaggccaccattgggaaccctcaccagggcaaagcttggtggagctgaggtgcgcggggttgctccctgaggccctagtctagtagagcttccagcatgcaactccagcctgggagagccacatgcagaagactcaaactctaacccaggagaactgcagcatgggctgcccccaataaagtcatgggggtgggggcccctggtaccctgggggcccaactcctgctccagtgtgtccagaaggcaggatatcaagtcgaagattattctgaagccttaaaagttaatgtttgccctgttgggttttgtattggttgggacctattatccctttcttcttttctattttctcccttttggaatgggaatgcatgttctgtgcctgtcccatcattgcattttggaaacaggttggatttcacagactcacagctggaggggaatttgcctcaggatgaattgcacctttgagtcttacccatatctgattttgggaaggagttaagacttgtgagactattggaatgaaatgaatgtattttgcctgtgaaatagacatgaattttagagggccaggaactggatgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtggtttgtaaattacccagttttgtactccttgcagaagactttaaagaaaattaattaattacccagtctaaggtggtttgttatggtagcctgaatggactaagacacccagttacagccatttatcgcttctcctctaactccctcatccatgatttttaaaaaagtttttgtttagttaaagaattcttggattaggctgggcgtggtggctcacgcctgtaatcccagcactttgggaggctcaggcaggcagatcacgaggtcaggagatcgagaccatcctggctaacaaggtgaaaccccgtctctactaaaagtacaaaaaattagccgggcgtggtggcaggcgcctgtagtcccagctactcaggaggctgaggcaggagaatggcatgaacccgggaggcggagcttgcagtgagctgagatcacgccactgcactccagcctaggcaacagagccagactccgtctcaaaaaaaaaaaaaaaaggaattcttgcattacaaactcacccatttgcttcttagccttctttttgtgcttgccctttgaactttacatgtcttttggaagccaaatcttaatggtagatagaaatttcaaaaggccccatgaaaagttttgtgtggttatggaaactagtttagcagtacctattttagtttgagatacttgcccttttcttacaggctgtcttatggttatatgttatagatcttaagattatttatacagttgacctttgaccaatgcaagggataagggcacagcccctgtgcagtcacaaatccatgggtagcttttgactcccccaaaatgtaactattaataccttattattgactagaagccttactataacataaataatcaaataacacattttatgttatattaatgttatttcatatgttaatatgtattgtatactgtattcttacaataaagtaacctagggaaaaatattacaaagaaaatcattaggaaaatacatttataattcattaaatggaagtggattatcataaaagtcttcatcctcgacgtcttcacgttgagcaggctgcggaggagaaagagggaggagttggtctggctgtctcaagggtggcagaagtggaagaaaatccatgtataagtggacctgcccagttcaagcccatgttgttcaagggtcaactgtataagataatctaatggctgtcttattttagaagagtaaaaactgcatgcttcttatagtgaaaaccaaaattccatcaaatagtgaaatctcttaatataccactttataattttgtaattttttttccctttagaatacatatgctgtcttggctttttttaactgtagatggcagtagcacataaaatatgttgattgagggcaggaaaatgttcagagtaatgttcaattgctatgtgattttcccagagtaactaattctattgtcagagaaaccacatgataacatttaagttaaggatgtctggatttttggtaggaggactctgaaatttaaaactccattttccttagcatatcaagtgaatattaaaagtatatttttacctccaacttcagtacttcaaattttttttcttttttgacagagtctcgctctgtcacctaggctggagagtgtagtggcacgatctcagctcactgcagcctccgcttcccaggttcaagtgattcttctgcctcagcctcctgagtagctgggattaccggcgtgcaccacaacacccagctgattttttttgtatttttggtagatatggggtttcaccatgttggccaggctggtctcgaactccctacctcaaatgggagcctacctcacctgccttaggctcccaaagtgcggggattataggagtgagccactgtgcctggcctgggatttcaaaattaaggttcagggttagaaagcatgaccggctcatcaccctataaaccaattttcttatattctgtggctgttcaagtcttaccgactttccttctgttttatttcttacgtttcactctcattatcctagtttaggaacttactgtatctcacatactcttaggccttatctttcctattcaggtgcgtcatctctctaatttgttcatgtaggaaatgtttattaaggaattgctatgtaccaggccctgtgctaagagaaaggagcagagtgttgctaatcactctccgatcagccgcagctaacaatctgacaatgagggagggaaaaaaagaaaatgtaaactagaattcactttcaaagtcattttcataaagatagccagtttttctctatgtcctctttcccttccttctctctttttttcctttctttctctttttttttttttttttttttgagatggagtctcactctgtcgcccaggctggagtgcagtggcatgatctctgcttactgtaacctctgcctcctgggttcaagtgattgtcctgcctcagccttccaggtagctgagattataggtgcccacccccacgcccagctaatttttgtatttttaggagagttagggtttcaccatattggccaggctgatcttgaactcctggcctcaaatgatccgcctgcctttgcctctcaaagtgctaggattacaggcatgagccaccatgcccagctccttttttttttctacaaagtcctgtaaatcagcaaaaccaagcatgtaggctgctaataccatatagaaatactgcagtagtaatacaatctgtttcaagggtaaattggaatgcttagaatagctttgtagacactgctgttcaaggaatagggttgaccagaggctaatcaaataactcacatttttctttataagttgtccatccaaggtcagcatgatagagaatgtgatgtagtgattggtggaaactatgctgtatttttttagtggattttatataaaccttttagcatatcaataaatgaagttactttttcccctattattttaaaaattgagtattttatcccagttagtaaatatttattgtacctttcctatgagcatcccctaccactgtgttaaaccctgcaaaggacatagtttagcaaggtactcgccacccctaaagatcctgcactgaaatgggggatgcactgaaagtggggatgtgggaccagatgtgtggagtgggaagtgcaagcatacttggaatgcaaggcagaatttgatgagaggtacagacacattgtctgtttttatgttttctcatgaggcaaacttctgagtgccttatttaatacccttggtgtattgtacataatcagaactctccagacatctgtcagtattattaacttttgtttttatttttttaaactatggaatgaacggattgaaactatttcataaacatttctaggtgctaacatcttcctagccccaagctaacatagtcaaacataaacagactctaactaaggtcttaaatacttggtaaatgaataaatgttgactagactttaataactaggtctgaactatttttatgcttcagaggttattgtttgactctttccttcaaatgcaaataaagagcttgaaatgcttattaatccttcccttcagttatgtatggagcaagttagcaatgaacttaatgattcaccctggctgcagaaacatgtttcatttggtcagggagataaaaattaattagcattttgtcttgcataaggcagtagaaatagaactatttctcttgtttgaggacttattaacaattacttgtagtccctgtagatatttttcattctcagttgggacttaaaacttactatcatgaacactttcaaaactttacaaaaatagaactatatacccagcagttgcttcaacaattatccacataggggccaatcatgtttcattaatatccccattcaccggagcatgcctcttcccctttttttacatgaaaatacttctaaagctattactaggctgctagtttttttgtattaattattataaatgtctttgggaaaaacatgttttgttttgtaaccagtgaaaattttaagacctggtaacacatataaggtacctttctaaaaaagtctttaggggttccattaatcccctttctggagtctagccttaggaaatagaaattaagggcaaggtctttgtacaaaaatgtttatcacagcattctttataatagtgaataattaaaaatgcatatatatctaatagagaataataaatccacatggtagaatgttttatggtctttaaactatcttcaaagagtatttaataacatgaatactcttttttttttttttttttttttttgaaatggagttttgctctttttgcccaggctggagtgcagtggcgtgatctcaactcactgcaacttccaccttccaggttcaagcgattctcctgcctcagcctcccatgtagctgggattacaggcgcacagcaccatacctggctaattttatatttttaatagagataggttttcaccatgttggccaggctggtcttgaactcgtgacctcaggtgatcctcccacctcggcctcccaaatgctgggtttacaggcacgagccaccgctcctggtccaatactcttttaaaaaaggataaaattgcatctatataataatccaagctggatagtatctttgtgtatactgtatgatggactgtggaagtgtgatttgctgttgccctggttctagtaaatcaagctgtactgcaattcatttcctcagtttcaaagaaagcttttcatttttctgatttttaaagcattatcagttctctacttaatccttccaaattgccatttatttgctgaaacctgcattgtgacctcatgtcagtattcaggatacttgtgctttaagatcctaggatataagtaaatcaaaggcattgcttatatttttagatgactgacattaagtgccttttaggcagcaaggtttcctcatatgtaggttagcaatcaatgttattttctgcctgtaggcttttcttaataattaagaatattatattctttgttcctaactttacagattataagcacaccacagagactaaccagttcaggaagtgttctgattgggagtccatatacccctgcaccagcaatggttactcagacacacatagcagaagctactggctgggtccctgggtaagagtgttgcaagttactatttttaaaaccttaaaaaaagtttagacatttttttcttactatcttgtcttctgttcttgttttagtttagttcttaaaaacaaatgtttttcctttaaaatcacctattttatttcactttatatcttagatataaataatctctggaataactatttttaaacagaaaaaaacagtgcaataactcataactaaaccctgtgactttttaaactctggaataggactacttttattattataatatttaactgctttggagatataaaaactatatttttatatatttttaactcacacagaaaaggagttaaatattaagtgttggctatactcagaatttcccctatgaattacttccataaagaccagaaaagggtaggaaaagaggccagataaattttttattaaatttcctcttctttttaaacgctgaacaattgaatcaatatcccttctgttactaatttgtcacttttagtacaaacttctatatgtttcatctttgcatgtaaaatacttatacctttctccactctttatcattttagtacctcatacttccataaaagaaaaataagtaagataaattactcaaaacctcattttgttaccttagacgttttgttactttagaagttatttacatggtggaatactgcattggtgattctgtcatatgtgagtttgagcaagcagatggtaagtcttagttaagtaagaatctccttgcttcaaggatattaagtgaattaataatcctggcaaagtgctttaatatgcatacatattaatatacataaatacatgcctacacacatgtacaaacacaaatacattaaagacagaagagttttgtatatgcatacttttccattatcaaatgagctgaaatgacagaattacctggaatcctatgggtgttattcaatccttatgaacattcttatgtagatcaaaggttaccctggatttctctatagccttgaaagattataacgtgaaagccaagcctgtgccagcagtgctggcccactttggaaatgaccagggtctggatgttttcagccccatttgtgctttatattggaggtggcaggattgtctggtgtttttatagtcagtatttcgcagagtgaagaaaatttttctctatcttgtttgcaagtctgcagtgttttcctctctagctagtcattgagctcttttcaacttatgattattaagttgtgataccttgttcacatgataaaattaagatttattttatgtacctatcttttgtatttgctagttttagtctttgaatatattcagtgtataattttagacaagttataataaagtattaatgaaattaaattgtatttaagtatgtattgtttttatgctatcttttttcctttttagtgatagaaaacgggctagaaaatttatagactctgatttttcagaaaggtgagtataagtctaactattttgtttggaagatttggctatatagagaggctgttggcattgccactgctctggtttaatgcgatgtttttcttcatgtaactttaacttctttcagttcttgccattatttcattctgcattgagtgccccagttcactcatagtatctgtatggtttcagtagaaattaccctgtgagcagattgactattggtagtatgtcctttagtctctcctctctttccatctggtaaatgaagagttctatcaaagtgaatactccacattaccctaacatgcccaaagtttaacaattttttcttttttcttttttttgagatgaagtcttgctctgtcacccaggctggagtgcagtggcgttatcttggctcactgcaacctctgcctcccgggttcaagcaattctcctgcctcagcctcccaaagtgctgggattacaggcatgagccaccacacccggctaagtttttcttaaaacatttataaatcataacaaacttgcttctttcttaagcaatatgttgggcataaggaaagttcatgttatcttagaatattaggacagtggcttctccattctggctgtgcatcagaatcacttgtagtctgttaagtaaaaaataaatgcctgccatgtcagaaactcctacattttctaatttgctatctctgatttgctgtgccctgagaaattagatggccaaatatgttagaattcagtctaaaatgaaagtgactaggttctgagtgagaaccatgggaatatgtataaaggatgtgtgttttcttgccctgacactagtgctgtttcagttccttggtggcttttgttgtttgcttcttggtgctaatcgttttcaacagatacaatcacttctgaggagctgctgtatcatagaaatgaaatgttctttactctctaacagaaagtcctctttccaactcaaactggtctttactggtgtttatccttcgaaagggcaacagaacaagttcttgcagaggtatttagcaatgtttaaggccttaaaatggaactatttgtcagttatgattggtggcacctctgcactgcaaacagtacaaaaaccaagattctctttattctcctttgtaagtaagaattctaaagatctataagtgagaacacataaaagtgttaggttaaatttatagtgtagccattggttcaactttctctttctacatttggttcagtggctttttttcctagcattttttttttatcattttttaaaaagttttgaatataacttttctgtaatgtatccccaccacccgtctgtcaaaccacgaagattgctacatgtatttttctttattccttgttctaaataagatttagcacagtggtgtttcatttttttctttatgctttttttttcttctttctttctttccttccttccttccttctttctttctttcttttctttctttttttttttttttgagatggagtcttcctctgtctcccaagctggagtgcaatggcttgatctcagctcactgcaacctccaccttctgggttcaagcgattctcctgtcttagcctccagagtagctgggattacagacatgcaccaccatgcccagcaggtttttgtctttgtgtagaaacagggtttcaccatgttggccaggctagtctcaaactgctgacctcaagtgatcctcctgccttggcctcccaaattgctgggattacaggcatgatccaccacgcccagcctcttttgtttttaagacagggtgtcactctgttgcccaggctggagtgcagtagcgcaatcttggctcactgcatcctctgcctcccaggctcaagtgattctcctgcctcagcctcccaagtagctgggactacaggcgtgtgcccgctaatttttgtatttgtagtagagatggggtttcaccatgtggccaggctggtctttaactcctcacctcaagtgatccacccaccttggcctcccaaagtgctgagattataggcatgagccaccacacctggccttttttttattttttacttttttgctaattaggtcaagggttaattttataaacaagactgaaatattttgttgatttaaatgttctggttgactctctttttaacaagaagtgaaacttttactatatattttatataactccttattaaaatgaaatacatttattgcaatttatacttgagatacaatactatacatttaagttgtatattacttttgtaaaccataaaaaaatttattgggaaaatgtcaaaagatggtttgtagattctagttacgtgcctggaaagaaagaaaaatacttttttattatttgggtgtaattcttttgaaacttcaaaggaaataatcaataaaatgtaacatgcttttcaaaccatagtatattagtggggtttgtttgtttgtttgttttttgagatggagtctcaccctgttgcccaggctggagtgcagtggtgtgatctcggctcgctgcaacttacgcttcctgggctcaagtgattctcctgcttcagcctcccaagtagctgggattacaggcgtgtgccaccatgcccggctaattttttgtattttcagtagagacggggtttcaccgtgttagcccaggatggttttgatctcctgaccttgcaatctgcccgcctcagcctcccaaagaattgggattacaggcatgagccaccgtgcccagcccagtccatcttaaattggaagctctctatttaaatcttaaatatataaggtttatacatttttttagaacctgagctctttcaaacaccaagaccctctctttccaaataacgtcaaaatttggccacaggatgtaaacactctataagttcataaaccaaacaaagaaaccaggaggaagcattctttatcaaaggaactaaattaagaagctaaaacctaaataagaaaataaaaccacagactgggcacggtggctcacacctgtaatctcagcactttgagaggctgaggttttttatggtgaaacttgtctctactaaaaatacaaaaattagttgggcatggtggtgggtgcctgtaatcccagctactcaggaggctgaggcaagagaatcgcttgaacccgggaggcagaggctgcagtgagccaagatcacaccactgcactccattttgggcaacagggtgagactccagcctggtcaacacagcgggactccgtctcatgtttactccctacctccctcatgctcactgctaagatcttattgaaattttagtataaaaaataattaaaggggctgggcatggtggctcacgcctgtaatcccagtactttgggaggccagggtggccatatcacttgaggtcaggagttcaagaccagcctggccaacctggtgaaaccctgtctctactgaaaatacaaaaattagtcaagcgtggtggcacatgcctgtaatcccagctattcgggaggctgaggcgcaagaattgcttgaacccaggaggcagaggttgcagtgagccaagttcgtgccactgcactccagccccggtgaccgagggagactctgtctcaataataataataataattattattattattattaaagtaaatctgtaaaagtgctgtaaaaaatgataggggtatagattttccaactagaaaatgaaagctagtgttattataatgaaaagtgaaagtagagaaatctacatcgcatattgcgtggaagaagtcagcatcagaaatggtagccattgtaccctacattgtcacagagaggctccaggcttaaagttgacctgcgtagaaagcaagaatgaattgttggaggaagtaaggagggcgattgaataaagacttttagcagctgggccagctgaaccatcccaacccttcaaatccccttgtacctcttatcccacctccatacacagagcagttgccccaaaaacatttctcccctagggctgaaacttggagaactgatcccagggaaacaactgcctgcttcagctggtttaagaattttagtatgccccagaacaggttttcctcatactggcatttgtatttgtgggaagagagagagaccagactggctgcctgcttgtctgcttagcagcaaatacaacctgaagttaagcttgttgccagcatggcccactcacatccagagaagttgtggttagccctccacaagtgggggaaccttcttaggaaaacaagcgtgcatacaagaagctcatgtaaactctatatattgaaaacttgaatccaacattcgtgaacatgaaagaacaggacatttttggaaaactatgatgaaagaaaaggaacaagatgaataaacaaaagttatgacccaagaggatgtaagataaaaaagaacaataaaataaagttgtaattatcaccctttgagaggtctgaaggttcctgagaagagataatattcatgaaagaaaaagaagatcctatggaaaagaagcaaagaagaaaaacattctatgaagtttaaaacatgattgccagccgggcgtgttggctcaggcctgtaatcccagcactttgggaggctgaggcaggcggatcagttcgagaccatcctggcccacatggtgaaaccctgtctctactaagaatacaaaatatagctgggcatggtggcgcgtgcctgtaactactcgggaggctgaggcaggagaatcgcttgaacctgggaggcagaggttgcagtgagctgagattgcaccactgcactccagcctgacgacagagtgagactccatctcaaaaaaaaaaaaaaaaaagaaaagaaaagattgctaaaaacagttcttcaagatattaaaacatgaaaacagaatttttattttaatgaaataacttggcagcagtctagtgttgctgcagagaatagctgggattgtgttatttgaagataccagaaatctactgaggcaggagaactagaggggctaaaactagatcaggaagaacctcagaaagttgagggacttccacagtagcttttagatatggggtagtttgctgtttgtgggcaggaggctgagaatctaggattttgtacaaaataaaggagaaaaatgttatgatcagttggtacagaaaaaagcacatgacttgattaaactctactcattatggtaagtggcaaactagtaatagaagggaacttagtatgttaaagacaattggcaaaaaccaacagcaggccaggcacggtggctcacgcctggcatcccagcactttgggaggccaacccaggcgattctcttgcgcccaagaattcgagactagcctgagcaacatggcaaaacaccatctctagaaaaaatacaaaacttagccaggcatggtggtatactcctgtagtcccagctatttgggaagctgaggcaggaggatcgctgagtataggaggtcaaggctgcaatgagccaagatcaggcccctgcactccagcctgggtgacagaatgagaagaatgtcattttctttttcttttcttttttttttgaggcagggtcttgctctgtcgtccaggctggagtgcagtggcacaatctcagcccactgcaaccactgcctcctgagtttaagcgattctcctgcctcagccttcggagtagctgggattacaggcacctgccatcatgcccggctaattttttttttttttttctatttttagtagagactggatttcaccatgttggccaggctggtcttgaactcctgacctcaagtgatccacccacctcggcctcccaaagtgctgggattacaggcatgaaccaccgcacccggccgagaagaatgtctttaaaacacacacacatgcacgcacgcatacacacacacacacacacacacgccaggcgcagtggctcatgcctgtaatcccaacactttgggaggctaagttgggtggatcgcctgagctcaggagttcgacaccagcctgggcaacatggtgaaacccagtctctactaaaaatacaaaacattagctgggcgtggcaggatgcacctgtagtcccagctactcaggaggctgaggcaggagaattgcctgaacctggaggcagaggctgcagtgagcagagatcacaccactgtactgcagcctgggtgacagagtgagactctggctaaaacacacacacacacacacacacacacacacacaaatctgacagcaaacattacatttagtagtgaataaaaagctttcaacttggcataagaaacaaggagaatccctagttaatcaccacctctattcagtattgtagtggaaattcttgctagtgcagtaagccaagaaacaaaatggaaagccttaataaaagaattgtaaatgaagaaataaaatggcactatttgcagatgatgtgattgtataccaagaaaaaacaaaagaatctacagacaatttatgagaaaaatgaatttagcaaggttgctggatataagggcatataaaaatgaacagaatttttttattctagcaaaaaatacaaacgggccagtaaacatgaaaaagtgcttatcagcattaatcattagaaaaatgcaaatgaaaaccacagtgcaataccactttacatccatcagaatggctacaatgaaaaggatagacagtgctaagtttggcaaggatatgaagcatctagaatgctcatacactgctggtggcaggaaaaactggtacagtcattttgggagttagcagtgtctgctgaagttgaatgtacacatacccgtaactcatcaattctgttccttgtgtatgctcaacagaaatttgtgcacacattcaccaaaaacatgtacaagaaagtttatagaaacactattagccttcaactagaaacaaaccaaatgcccatctgcagaatggatgaatgaattgcaatgtattcatacaatgaaatgaatgaaatacagtcacatgaaaagtgtgaatgaatctctcaaatagtgttgtcagatacaaaagggtacatactatatgattttaatttaaagttcaaaatagggaaaactataatagaagtcatggtaacagatattcttgaggtgttgggtttgggtggaactgtaactagaaggagacacttaacacagttggtttgcgtacttttctttatgtgttatgtacgtcaatgaaaatttgcatttaaaaactcaggaagaagttaaacactgtagccaggtaactctcaacttgtaggctgtaagtcactagacgatgggacaggactacataagaagaaaaggaaagctttcttcctcatgttgtgggctcctgtggtgtattcctagccatcttttatagactaagctcagactaaggagtggaattgctgggtcatacagttactctttgtttagcccttttgagtatggctagactgttttccaaagtggctgtaccgttttacattcccataaacaatgtatgagtattccagtttctccacgtttttgctaacacttcttgtgaaatggtacctcattaataaaaattaactcaaagcattttgatttgcattccttgtatattctagatggaaatcccttattaaatacatgatttgcagagtttttctccaatctgtgaattgacctttcattcttaatggtgtcttttgaggcacaaatgtttttaattttgatgtttaattaacttatttttttcttgtgttacttatgcttttgtgtcatatatctaaaacatctttgcctaatccaaggtcacaaagacttaacacctacgttttcttctaagagtttgataggtttagctcttacatttaggtctttgctttgagttaatttttattaaggttaatttgtcaaatgtaacccagaagcatatagaaaatctatgaagaaaaaataggtgttttttttttttttttttttttttgagacagcgtcttgctctgtctcccaggctggagtgcagtggcgcagtcatggctcactacagccttgacctcctaggcacaagcaatcctcctgcctcagcctcctgagtagctggcatatatcaccacacctgactaatttttacattttttgtagagatgaggtctcactatgttgcccagcctggtcttgaaatgctgggctcaggcgatctgcctgcctcggcctcctaaagtgctaggattatagacttgagccactgtgcttggccaaaatagggatttttgacatttatttttataacatttttacagttattttaatttttcaaacaagcctgggtttattatttaaaattatcagctaaattagaaaagtaaacttttattttaatcctcattttctaatggtgagataagcatcctgaactatttttttcaagaaaaggcatacctattctgaaggtggcagcagtagtagttaaccagatgtgacaatggaagtaacttaaagaatgaagaacaggctactctgggcacgttgcctatggggtagtcctgctccacaaggagcaatgtaaaaaaaaagaagaagaacagtaaaatgaatacaatagagtttgtattagttttgctcagaaacatgaccccctctcatattgaatttggttttgtagccataattgatgatgaaatacataatacataaactacagcatcttatttgcagaaatacactggctaataaagccatgaaatcatcaaaacttaagcatcaaagacaacaaaacataagtcagttcaaaaccaaaagaaccatggagaaataataaattgttgggcaactatcaccactatccatcttgagaactttttcatcatcccatattgaaactctgtccccatgaagcaacaacactacatttaccactcccccacaatccctctgttctactttctatgattttgactataatttgatttcatataagtggaatcatacaatatctttttattttttttttgagacggagtttcgctctgtcgccaggcgtgtacggtggcgtgatctcggctcactaaaacctctgcctcctgggttcaagcagttcttctgcctcagcctcccaagtagctgagactacaggcacgcgccaccacaccagctaatttttgtatttttagtaaacggggtttcaccacgttggccaggatggtcttgatctcttgacctcatgatccgcctacctcggcctcccaaagtgctgggattacaggtgtgagccaccacacccaacccaatatttatctttttatgtctggcttatgtcacttatgtcttcacagttcatctgtagtgtagtatgtatcagaattttattcctttttaaggatgaatgtatttcattatatgtatataccacattttatctgtttatccattcattggtgggcagttgggttgcttccacattttacctattgtgaataatggtgctatgagcatgggtgtacaaatatctgttgttcctgctttcagattcatctgggtgtatacccaaaagtgaaattactggatcatatggtaattctatgtttactttttttgagaaattgccatattgttttccacagtggctgtatcattttatatttccaccagcagtgcataatgggtgcagtttctctacatcctctccaacactttctcgttttcagtttttgtttttttaatagccattctaatgggtatgtagtggcatctcattatggttttgatttatatttctctaatgatgagtgacgttgagcatcttttcatgtactttttggctatttgtatatcttctttggataaatgactattaagtcttttgccctttttttttttttttcttgagacattctcactcccaggctggcgtgtgatggcgtgaactgcaacctttgcctcccaggttcaagtgattctcatgcctcagcctcccaagtagctaggattacagatgtgtaccaccacgtccagctaatttttgtatttttttgtggagatggagtttcaccatgttggccaggctggtctctaactcctgacctcaagtgatccacttgccttggcctcccaaagtgctgggattacaggcacgagccactgcacctggccctttgcccatttttgaattgagttgtttcgttttttgttgtaattctttatatagccttttgccttttagtgttctttaactagagacattttttgcttaactttcaaagtggcttactggattggttgcaggaccaaatctctcatctgtgtatggcaggtgttgactcttttaacctcctttgttgaattttaatgttgatgttaattgagttttggcatgatattctattaaccttccaaataataagcttaatttcttgatccagccattgttgaatagtgccctttggttttatattgcttatgaaaattctagcagctcatgaaggggataagatcacttgtagtgtaccatatgttatatgcatttcatcctcacaacttgtgagatgtgtattctgcatttttcagatgaaggactgtggatcagagttaaatcgagtaaactgctcaaaatatgtatctgatagtttactaatgttgatatttaaccaagttttcttcaagtttattatcaatttatgcactgaactgattttataaaactcttacatgtaggcttgtatctacatttcaagagtatagccatcactgttttataatagttgttaaaattgtagttgttcctacttaaggactatgtttagtttcttcctttaaatattatccaggtatgactacaaatattatccaggtatgactatagagagccaattagctaagtgattgcccgaaaccaccctatcttattgctgcctttaacaaaaagaccaagaattggatgaaaaacaaccctgcttcactcttggcttttcaaaagtatgtaactggctggcctgaaggtagtgagttatctcaattgatggttcacaatcagttgaacacagatcaaactccttgttctacactttaccccctacttgagtagggggtaaagactacttgagtagtcttttaaaaaaaaagaagaagaaaaaagcatataaccactaagttgagaaatttatttactttaagccattaaccagttcttttcctggctatataatcccatacacaacattatttctgcccaatagaaattttaaaagaaaataaatatctgaagttaattttaatatttttaatttagtccaatatatccaaaatattgtatttcagtgtgtaattaaatataaaaatcactagtgaggtattttacattcattccttatattaagtatttaaaatccagtgtgttaaacttacgacatatctcaattcacacttcccacatttcaagtattcaatagccacatgtgagttatgcctaggggtattggacagtgctgattaggaggtttaaaatgcaactcataaatttaattcatctcttcgatctcagtaaatgacccttctttctagaggtcattctactattcctctcttccttaccctccacttcagacaattttattgattttttgtcttttaaaattttgtaaatccatctttttatctcctgccctaccacagctccagtttggggattcatattctcttacctggactattgcaataccctctcagttggtctttgtgtctctgcttttgcctcataaatttcacttctactgttactaattctgattccaaaatctgctttgcagtgagaatgtctgcctaactgaaaatgtcaccattctactccactacttaataccattcaatatattttagtgatttcacattatttcaaataagtagtctgtgaggtaagataagtatgctgtcctatactatcacaagggatgcatacacaactctttgggaatgtagggaaaggagagtagatatccttttctcatattccttttaaaactgcatgtttagtatctctttctatgtacataacatagaacatgtaaattatttatcagtaaatatattcacagtcccacatcacttaatgaggggctatgttctgagaaaggcttcattaggcgatttcatcgttgtgtgaacatcatcaatgtacttacccaaacccagggtggtatagcctgctacacacttaggtacttggtatagcctattgccccgaggctataaacctgcacagcatgttactggtttgaatactataggtcattgtaacacagtgataagtatttgtgtatttaaacatacctaaacatagaaaaaagtagagtaaaaataccttgtaaaagattttttttaatgatacacctttatagtgcacttttcatgaatggagcttgcaggactggaagttgctctgggtgagtcagtgagtggtgagtgaatgtgaaggcctaggaatttactgcacactactttagactttataatcactgtatacttaggctacagtaatttattttaaaaagatttttttcttcttcaataataagttaaccttagcttactataaattttttactttataaactttttaatgttctcaaactgttttactcgtgtagtaacacttgacttaaaacacaaacaatattggccaggagcagtggttcacatctgtaatcccagcactttgggaggccaaggcggatggatcacttgaggtcaggagttcgagaccagcctgaccaacatggtgaaaccccatctctactaaaactacaaaaattagccagtcatgggggtaggcgcctgtaatgccagctactcgggaggctgaagcaggagaatcacttgaacccgggtttctcagtgagctgagatcataccactgcactccagcctaggggatagagtgagactctttctcaaaacaaacaaacaaaaaaaacacaaacatattaatgggtccaaaaatacacttagatacaatgaataatatctagtatttggtagtacaataggttgctgtagttaacaacaattgattgtatattttaagtaactagaggaatggaattggaatgttcctaatacaaagaaacaataaaggcttgagatgacggataccccaattaccctgattaatcattacacattgtacagctgtacaaaaatattttctttatatccttattccataagcttttttctgtttgttttttaatttctaattttttttttttttttttacttttgaaacttttttgttgaacactgagacgtggctgggcagggtggctcacacttataacccaacactttgggaagctgagatgggagggatcacttgaggtcaggagttcaagagcagcctgggcaacataatgagaccctgtctctacaaaaaagaaattagcgaggcatggtgacatgcacctgtaattctaactacttggaaggctgaggtggaaggatcacttgagcacaggaggtttaggctgcagtgagccatgacggcaccactgcactctagcccgggcaacagagtgagaccctgaatccaaaaaaaaaaacccaaaaacagaaaactgagacagagggccaggcgcagtggctcacgcctgtaatcccagcactttgggaggccgaggcaggcagatcacctgaggtcaggagttctggaacagcctggccaacatgatgaaaccccgtctctactaaaagtacaaaaattagccaggtgtggtggtgcacacctgtaatcccagctactcgggaggctgaggcaggagaatcgcttgaacctgggaggcggaggttgcagtgagctgagatcacaccactgcactccagcctaggggatagagcgaaactctctctccaaaaaaggaaactgagacacactatcctaggcctacaggggggtcaagatcatcaatatcactgtcctccacctccacattttgtcctactggaaggtcttcaggggcagtaacacacatggagctgtcatttcctgtgataacaatgcgttcttctggatacctcctgaaggattgcctgaggctttttacagttaactttaatttataatttgaagaagtacgctctaaagtaatgatgaaaagtatagtttagtaaatacagaaaccagtaacatagtcatttattatcattatcaagtattatgtactgtccataattgcatgtgctagacttttataggactggcagagcagtaggtttgtttgccagcatcaccacaaacatgtgagtaatgcattattactcacattaaccattacgatggttacatcactaggcaatgagaatttttcagctccattgtaatcttattggactactgttgtatatgcggcccatcattgactgaaatgtccttatgtggcaaatgactatagttttaatttcagtaaaaaactataatctacatagagtaggaaaagataagtctgttagctgtacaagggcagagtttttgtgttttttcactgacttattctcagtgtcaataacagtatccggcatagaatagtaactggtcaataaatatttgttgaataaataaatgctgtgcatagaaaaacactctaactttatactttattagacctttaaggcaaaaagtaagtttaaataaacattttctcatctctattcaatttaaatttttgacacttgaagtaaaacttaaattactgtcttcttgcattatcttacagagatttgtaaagaaagtctctaatatgtataatggagtaaaaaaaacttttttcccttctagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggtatgtaaatcatgaacctgacattgattttgatggatgatgctacttctttgtgttatctttgttatagatttgaggaatcacgactatacttgagggttttatcctttattttgggggattttttgttgttgttgagttttattttggagggaattcctttttttttgttttttaggcggaacctcactctgtcgcccaggctggagttcagtggcgcgatctcggctcactgcaacctctgcctcccaggttcaagctattcttgtgactcagcctcccgcgtagctgggattacaggcgcacaccaccattcccagccaatttttgtatttttagtagagacagtgtttcaccatgttggccaggctggtctcaaactcctgacctcaggtgatccacctgccttggccttccaaagtgctgggattacaggcgtgagccactgtacccagccttagttgttttttttgtttttttttgtttttttttaacatttaaaaaatatttggccaggcgcggtggctcacgcctgtaatcccagcactttgggagtctgaggtgggtggatcatgaggtcaggagatcgagaccatcctggctaacactgtgaaaccctgtctctactaaaaatacaaaaaattagccaggcatggtggcatgtgcctgtaatcccagctactcaggaggctgaggcaggagaattgcttgaacctgggaggcggaggttgcagtaagccaagatcgcaccactgtactccagcctgggcgacagagtgagactccgtctcaaaaagaaaaaaaaaattggtcgcctatccaataattttttattgtttctgaatcttattgtttcttcaatgtctaagtcaacaagaaaattttatttttaattggaaaaggaatacataaatatgtttataaaaaattcagttgtctggcagagtctcaaataaatggaatacagtggtgcagtttcggctcaatgaaacctctacttcccaggttcaagtgatgcttgtgcctcagcatcctgagtagctgggaccaaaaatggcaaggctctgcctctacagaaaaaaaatttatttctttatcttttttttttttttttgatatgaggtctcactatgttgcccaggctgattttgaactccttgactcaagtgatcctccagcctcagcctcccaaagtgctgggattacaggcatgagccaccatgcctgacctctacaaaaagtttttttttttaaattagcgaggtgcagtggcacaaacctgtagtcccagctactccagaggctgaggaggattgcttgagcccaggaattcaatcatgccactgcattccagcctgggcggcaaagcaagacttcgtctctttggggggaaaaaaaaaaaaaaaaaaaaaatatatatatatatatatggctatgactgtttctctagagcactgatttagccctatcctattgattctgatatattattctttagatgttctttaattttggttttaatttgttctttgacctaaggattgccttagaaagagttcttatagttccaagttttgtttgttgctttaaagttttacttttattacttaatttgtccagagaatatgatttgaactatttcccttttttttttggattacattgagattttccttgggagccattatatgtgattttctttttcttttcatgttctctaggcacttgaaaaaaaaagtctatagcattctgtttctgagtgaaagccatggttctcacaatgatctgcaagcccctttgtgagcttgcccaccattacctcactaatctcgtcttctgctatgcactgtctcatttactaccctccagccacatgtcactatgctccagctacatgttttgtccctgatcaggccattacactgctttgcctagagcagtctttgctaggtattcatatggcttctctctccctgccttgtgatcttcactcacctgtcaccacaatgaagcatttcttcttagcacttttcaatatctaaaatacatttttactaataccctatcaccaccaccttcccaggatataaacaaaggttgagtttttttctctttattcactgctttgttatttttctgataatttagaatgcttgtagtctcagttcttcagttggttacctttataacttaagttccttgagttaccacctgtagacagtatctattggttatgaagaaaaacatatgtttttttctgtcttccatttttctcttctaccatgggactcagattagatatattagtatatttgttaaaaagaataatactactactataggccgggtgcagtggctcacgcctataatcccagcactttgggaggccgaggtggacggatcacactgtcaggagttggagaccagcctggccaacatgatgaaaccctgtctgtactaaaaatacaaaaattagctgggtgtggtggtgggcgcctgtaatcccaactactcgggaggctgaggctggagaatcactggaacccagaaggtggaggttgcagtgagctgagatctcaccactgcactccagcctgggcaacagagcaagactctgtctcggaaaaatagttgtttttattactttaaataaatagattgtgctgaaccctttattattatttaatctgctttgaacaacatccatatcccttccaatatcaaaaagaggaaattggcatacctatcacattgcctcctcccagtacttgttgttacagtatcattgtttctacagggtcaagatttctttttttttttttttttgagacagagtctagctctgtcacccagactggagtgcagtggctcaatcttggctcactgcaacctccatctcccggattcaagcgattttcctgcctcatcctcctgagtagctggcattacagtcatgcgccaccacgcccagttaagttttgtattttttagtagagatggggttttgccatgttggccaggctggtcttgaactcctgacctcaggtgatccgcccaccttggcctctcaaagtggtgggattacaggcatgagccaccactcctggcccattgtcaagatttctagtatttacattcagttctataacttaaatcccccacttatttagatctagttttatatttaggtggattcagtgttctccaccatcctttattatcgttgcatttcctgaggaccttgttccacaatgtaaaccaacatggtttccttgattaagtcttactatcaaaaaatagaagaaaaaggccgggcatggtggctcacacctgtaatcctagcactttgggaggtcgaggcaggcagatcatgaggtcaggagttcaagatcagcctggccaatatggtgaaaccccgtctctactaaaaatagaaaaattagctgggcgtggtgatgtgcatctatagtgccagctacttgggaggctgaggcagaagaatcgcttgaacccgggaggtggaggttgcagtgagctgagattgcgccactgcactccagtgtgggcgagagagcgagacactgtctcaaaaaaaaaaaaaaaaaaaaaaaagaagaagaagaaaaatggtcagctgaactgaacagtgtcccttgtcatatagaggattatattttggtacaagttcctagtcccattgtagattggagacagtttgcagatcagcagtggtcaaggaacacattttgagaagcacagttttacccagaacttgaataaatgtccttgatttttttaagtctaaaatcctcccagataatgcaagggcttagaacactttacctccaatacctttttctgttaatatgtatactatttgttgtcatgtatattaagttctgtattctagactccataaggcattattattgttttatacagtgaaaattgagatttacccacatatttacttttttgggttggtcttcattctatcctacatacctaagctcccatcttagatgatatttcttctacctgaagaaatccctttagtatatttcagtgtagatctgcaggtaacatgatctttatttttaagattattttgttttatattgtttgaaagtatttttatttcatctttaattttgaaggatattttctcggaatatagaattcttttggatgtttttgtcagttggctaaataaaaaaatagaatccttccagcactttgaagttgtaatattaatttgatatattcatatcatgtgactgtatcttaacccttaagatttatcactcagtgaaaatattttttagcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggaggtaagtgagaaaatctgtttatgaatagctgtttgcattattttacatcacaggcattttaatttaaaaatgtaattctaatataaaatatttccaatttttcatgtataccatgtcattttttaacagactgtagaattttagaattggaaggcgccttataggtatagtctgcagtttaatttgcaaatgatgaaactgagggatataaaagttgaataacaatttgattttactgtttcttagagaagatttttatttcatcctaagttaattctgagcactctactaataaacttttggtgaaatggtatcttatttgatgagatgcttgctgtatgtatccaaaaaaaaaaaaaaaaaaggatcaagccggctgtttatttcctttattggttacacaatattctgaatatagctgtggaagtcagacttttactttgaaatagtagcaacagaatgaatagtgtttcatttgtgtctttaccagaatggatagaattttggaatgatgtatgcagaagcattttaagttctgttaactttaagcattatagaaaactcttcctaaatgagcatgttccctgacatactgtttctaaattgacttgacataattttactatcatggccataaatggagtaaactgaggttaaatatggcttctgggccaggggcggtggctcacgcctgtaatcccagcactttgggaggccgaggtgggtgtcaaaatggtaaaaccccgtctctactaaaaatacaaaaattagccagtggcagacgcctgtaatcccagctacttggaaagctgaggcaggagaatcgcttgaacctgggaggcagaggttacagtgaaccgagatggtgccattgcactccagcctaggcgacaagagcaagactccatctttaaaaaaaaaaaatatatatatatatatatatatatatatatacacatagctttgggagataattaagattggtttcctgtttttctcagtcttttctccccagcaattcagttatttggtattattatacttatggatggagagagaaaccagatattcatcagaagctatataatatttttcatatgctacagtggaaatatcctccttttcttgtttttcttccttctcatagagtggaatttgagcatcattttcatgaccagtaatattgagctgataccaaagactcattaagcaaaaaaaccctattcacatctaccttgtgcttaatcacaggttatacaaggcaaatctctgaccccaaggtactgtcattctcaccggggagaagagaaatgtaaaagagttaccgaaaatgtgattactcctaagaaagaaatgtacagattctctgcaaagagggctgagggagggctttaccaaggagataatcccagagctcaggcatgaggtgggagtagtctgccaagtggataagggtggggagggccttcaaggcagaggtgccacatgggctgagacaggcatgagaaagcttgcctggagctgggtgtggctagggaacaggcatggagaaaggaggatagatatctaagtgttaagcagtggagacctgatcctgtaaacaaagggaagcagttgataaattacaaagagaagggttgataggatgttttttaaaggatcactctgccagtgggttggaaataaaattaacaggtagggaaggaaatggaatgggggaggcggattagagatggtctgagttacggcagcggccatgagattggagaggtgttttagaggtacaatcagtgcagcttgacctggttggatgagggacaggtaaggggcctggcttgtcagagcttctgataaagggatgctcctacaacatcttttcaaatgcagaacgccacacagattttacagtgaatcttaagtaatttaaaagtaaaacgtggtggatagaggaaccatgaatggaaactgctagtatagactagactggatgtggagcaagtaagagataatctgctggagcagacaagaaaaatgtcttatttgatgattgaaagacaaaattgtaacaaatttagtttaaagatcttaattgccttttatttgtgattctagaatctggcaacacctcactagtaagtagaatgagtattcctataagctgagcagaagaggttgaacattcttcagtgttttaaagatagagaagcagcaaaggcggatagaggcagaaacagaacaaaaagcagactggacatatcaatgtcactttccttgtaagggtaaaatagagaagactctcttatgccagctgcaactggcctgtttgggtagtttgctattctctttctctcctgatttcctaggtcagataaacaactcagttttggcctggtggcatttcagcatgagtgactccatttttgtttggtctgttgagcttagtgcaggagctcagtccaaaccaatgggctcctataaattttctttttttttttgttgagttggagacttgctctgtcacccaggctggagttcagtggcgcaatcttcggctcactgcaacctccgcctcccgggttcgagcaattctcctgcctcagcctcccgagtagctgggattacaggcgcctgccaacacgcctggctaatttttttttttttttttttttttttagtagagacgaggtttcaccttattggccaggctggtctcttggccaggctggtctcgaactcctgaccttgtgatccgcccacctcggcctcccaaagtgctgggattacaggctgagccaccgcgcctggccataacttttcttaataaatgtcattggcttttgcccaaggagacagtgaggaactcaactgcaaggaagttcagaccctaatgtctgttttctctgagtagttatcagattgagaaaaaaagcagtagtttgaagctggaaaatttgtccaataagcatgtttctttttttttttttctttttgagacagggtcttgctttgttgtccaggctggagtgcagtggcatgatcttggctcactgcaatctctgcctcccaagttcaagcaattctcgtgtctcagcctcccaattagctgggactacagatgcgcgccaccacacctggcttttgtattttttgtagagatagggtttcgccatgttggccagactggtctcaaactcctgatctcaagtgattctcccccctcggcctcccaaagtgttgggattacaggcgtgagccaccacacccagcctaccatgatgtgtgagatatctgtattatcagctgtcctcattggagagtcagctaagctggaattgtaaataagatcttgccttattcttagaggagtaatataacaaagtaattaataatagagtccctgtaaccagaggatttaggttcaaatcttggctcttgccattcactagctgcgtgaccttgggtagttacttaagccctctatgcctccgttcccttcgatgcaaagtggataacaacaggacttaactcataaggtttttgtgaaggtgaattaagataatgtgtgtaaaatgcttacttttgtgttggcagatagagtgagtataaactaagtggtactattactttgattagaacttgaataataattgcaacaagtactgctaacaagtattcattaagtgtatgatttcatttttaatgacagttgccacagatctgatgttgtgtctacttgttcactccagcccctgccccctacaaagatatgatttgtctttattcatattgttaaaatgggttcagtttctctagggaaaattgttatctcagaatagggacctggaaagtgaacgatattttatagtctacctatgttcatattattttgtaaccaatgttttaaagatagagaagcagaggcggatagaacggataaagcagaagcgggcccagctgcaagaacttctcctacaggtaaagataccgagatgttttcattaccttccctgtttctccacttgctgccttttggagtcagtgtgttttctaattgtggtgcctctgagtggtgtgtggtgagcccacgccagggcagcctctctcacctcctagcttgttgccatccacgtgctctgccttaagatggtcccatctgttgccatcatctcagctccacagtagcttccctgccctgtgtgtgacttacgccaggcagcagttcactgttgacactcaggcctctctaaacataaactgtcaggggtctttttgtgtttgtttattttagcccgaatttggaatatccactagtgaagctagttaaattttaggtgcttcaagtacagtaatcaaatctgcctgtaatacttaattttatcagtaaatgacagaatggcatgaaatagttcagtaagatttttgttgttgttgttttttgagactgagtctcactctttcgccaggctggagtgcagtggtgcgatcttggctcactgtaacctctgcctcccgggttcaagccattctctgcctcagcctcccaagtagctgggattacaagtacccgccaccatgcctggctagttttttcgtatttttagtagagacggggtttcaccatcttggccaggctggtcttgaactcctgactttgtgatccacccgcctcagcctcccaaagtgctggggttacaggcatgagccaccacactgggtctgtttcagtaagatttatagaaataccaaaatttaggccggttatatatatatatatctcatatatatgagatatatatatgttatatatatatatatctcatatatatgagatatatatatatgttatatatatatatctcatatatatgagatatatatatatgttatatatatatctcatatatatgggatatatatgttatatatatatctcatatatatgagatatatatatatgttatatatatatatctcatatatatgagatatatatgttatatatatatctatatatgagatatatgttatatatatatctatatatatgagatatatgttatatatatctatatatatgagatatatatgtgttatatatatctatatatatgagatatatatgtgttatatatatctatatatatgagatatatatgtgttatatatatctatatatatgagatatatatgttatatatatctatatatatgagatatatatgtgttatatatatctatatatgagatatatatgtgttatatatatctatatatgagatatatatgttatatatatctatatatgagatatatatgtgttatatatatctatatatgagatatatatgtgttatatatatctatatatgagatatatatgtgttatatatatctatatatgagatatatatgtgttatatatatctatatatgagatatatatgttatatatatctatatatgagatatatatgttatatatatctatatatatgagatatatatatgttatatatatctatatatatgagatatatatgttatatatatctatatatgagatatatatatgttatatatatatctatatatgagatatatatgttatatatatctatatatgagatatatatgttatatatatgatatatatgttatatatatgagatatatgttatatatgagatatatgttatatatagttatatattatatatattatatgttatatatagttatatatattatatattatatatattgttatatattatatataattatatataatatataatatataaataataatgttttgtttgaagagaatattgtgcagctttaaaaaaaaaaaaagctgaaactgacagtttattcctatgctcctgcctgtagaattctaccaaacactcctccttgaactcctgtgctgccatcttcttccccccggcagcctctctgttgtccctgtccctgcacagttatctgcagtatcccctaagagctcatgccccaaaccctgtgctggggccctcctggaatttcttcaaaaccatggaacattttggagcttaatttttttggcacgttatttttaaaaacctgtttatcagcatgccaacagtcatctgcctatcagaaagaatggtgctgggcaagatcaccctcatgtgtgtaggactttcctgtctctagatgcctgatgcaaagaatgaaaccatattttttccctgcttacctctgtaccatgaacattgtttttttattttttaaagtcttgaacttcttttcctctactgtctctcaaaccaaatatttgtagaagagttccacccaggggcaacatggctgtcaacattcatagaaacaggtctctctaaacattaaagtgaaacccaaagtataactgaaatcaacttgtggtcttctggtaaacttaaaacttatttccaaaggccggatgtggtggctcacgcatgtaatcccagcactttgggaggcggagacgggcagatcacctgagttcaggagttcgagaccagcctgaccaacatggagaaaccccgtctctactaaaaatacaaaaaattagccaggcatggtggcgcatgcctgtaatctcagctacttgggaggctaaggcaggataatctcttgaacctgggaggcagaggttgcagtgagctgagatcgccccactgcaccctagcctgggcaacaagagcgaaactctgtctcaaaaaaaaaaaaaacaaaaaacttatttcctcctagcatttcagtttttttcctttcatcaaataaattaagttgtcatagaaagtaaattaagcagccaggcacagtggcttactcctgtcatcccagcacttggggaggccgaggtgggcagatcacgaggtcaggagtttgagaccagcctgacaaacatggtgaaaccccgtctctactaaaaataaaaaaattagccaggcatggtggtgcacacctgaaatctcaggtactcaggaggctgaggcaagagattcacttgaacccgggaggcggaggttgcagtgagccgagattgcaccactgcactccagcctgggcaacagagcaagactctgtcttttttttttttttttttttaataagtaatccatttgctgtggctaagctcacttgatttttttttataagctcatgtcacaactcactcatgtcacatgacacaggtaactattacctccttgctaccacctctcttttatttttggtaatgtagaagaatggagtgagtaaagcaaacctgtagataatcccaatatcctacttttatctctataattgccctttccagcccttaaaccttttccataataaacgcataggaaaatgaatgaacacacttaaagctgttcagcctctggaatagatgttaatgagtttgaaaaagaacaaaaggccaaaggaaatcaatcaaagggcaacaaataagtcagttcaaaataagtgaattatttttccttttactatccaaaataacattatatggtatatgaaatttgtgacagtgttaaaaaaaacattattatgaccaggtgcagtggctcatgtctgtaatcccagcactttgggaggccgaggtgggcagatcacaaggtcaggagttcgagaccagcctggccaatatggtaaaaccccgcctctactaaaaatgcaaaaattagccaggcatggtggcgggtgcctgtagtcccggctactcgggaggctgaagcaggaaaatcatttgaacctgggaggcggaggttgcagtgagctgagatcgtgccactgtactccagcctgggcaacagagtgagactccgtctcaaaaaaataataataaataataataataaaaacattatgtttttactgctctcttcacttgaaaaaccattgatactattaaatgtacacagcattaaatagtgaatcacaaatacataagggccattagttatcactgcttatattcccccatataccagggtcctcttgtggcactagggacagacaccaagttaggcaaagtgtaggaacagctcttgagatgtgtattctagtaaaagggaagagaagctatgcaggagtatttaagcatgtaattctttttctcagttccacagtttaatcataatttttcctcattattaaaggaattaagcaatgaattcgttttttagcaacagaaaataatgaaatgtaacctcaataatgtttggtaatgatattgatagtgctagttattgatagtgatttttggacacacttaggtctacaataaattggtgttcattattttttgtgcttttcaaagagtaaatcttccccttttggggagatagcactcagccattttaagataatagtaatcttttcttttcttttcttttttcctttcctttcctttcctttcctttccttcccctttccttccccttccccttccccttcccctcccccttccccttcccctcccttctcttcccttcttttctttcctttttttcttttctttttcttcttgagaaagggctctgttgcccaggttggaatgtagtggcacagtcatagctcactgcatcctccaactcctaggctcaagagaacttcccacttcggcctcccaaagtgctgagattacaggtgtgagctaccatgcctggccaataatagtaatcttactgaaactttagttaaggtccagaacctgaaataaacaatactgatcataagattgctaaaatgtaaaaaataaatttatcactactgggtgacaagattataacaagctaatgaaggggaatgaatggctctgacttgaggaacttttaaaacgttatctgtttcttgagcagatgaaaaacttgaactgcatacagtctttctagctgtgaaattctatcgtacatttaccttattaaaaaaagggagatcacttgtttgtttgttggttggtttttctcagacagagttttgctcttgttgcccaggctggagtgcagtggtgcaatctcggcttactgcagcctccgtctaaaagggagatcactttctttggcttttgagtaatggttataactaaaagtagcggcaagatccagtaaaaaaatttaggccttgatgtatcttataattagtgctgagcctcagttacctcatctggaaatgtctggttggggaaggctggggctggattccaaactgtgcccagaggctgctgagaagttctgtggaggtgccttagaaaccatgtggctgtgcttgagggcagagatggcagagcttaggacctggcctcactgcagccagcctcaacagcaccacttccatctgttttacatgagtttttttttgttttgttttgagacagggtctcattctgtcacccaggctggaatggagtggtatgatctctgctcacagcaaattctgcctcctggattcaaacaatcctcccacctcagcctcctgggtagctgggactataggcacataccaccatgcccagctagtttttgtattttttgtagagatagggttttgccatgttgcccaggttggccttaaactcctggactcaagcaatcaacctgctttggcctcccaaagtgttgggattacaggcgtgagccactgtgcccagcctccctcgagattttatttgaagaaacaattttgtgcctttaaaatgtttgcatatccctgggctacacatcctaaagtttgggggcatatttgaccccaaactgtcaggagtctatgttagataaatggtatcacccttgctgtgtcatttgctgaagagttccaggtgcctactggttctttcccagattgtgaggtcctgtttctatggatgatggaaaaatgtatttattgagttggatcattctttcttaaatgtttaattttttaaattaattcattagtgcaggcgggatgtctctttaaactctaattttaaactatatttaaaggtattatcttaattcttttaaattccaactcacttatgcacaattgaccatattgtttttattgatcattacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtgagtggagaactagggatgggtgcagggctggccttctgttaacattttcatatcatttgcaaactcaagaaggatgcactttattagttgcacccctcaaaggctggcttccttggggcacatgaaacacctcctgaaccatgggtgcaatcttccactagtgtgcgctccaaccctcaccctctgtggtcccctgtcttgtgccaggcactgtgctgtctgtattatatgtgtgtggcagtgtctgggcccaacctatgacgtgctgcatgtatgtggtaactctgagcaagtaactgtgataagttagcccagcactgtgggtctgggacaaggtagattcattggtgattcaccgtcatagtttattacggaaatattttaggtcaacatgtggcattaaaccaattatttctttgttttgctatatcatagttatgcatgcttctgtttattaatgaatgtatgaatagacatgaaaatgcctggcacattctttgcttcctttaaattgtgtttttacattttaactaagatcaatgataatattcattatggcaaataagaagtagcacttttcaaaatatagaattaatttgtgatgtattttaccattcatgaaaaagtttctctcagtggtcttcaggctgtgaccagtaccataaaagagttaagagtatatatagggtgcagagtgagacggatccatgtaccgcttatggctcccccacttcgctgctgcaaagctctgttttctcaagaacaaataggaatgatactgggtcccctatgacttcccagccttgtgaggattaaatgagttaatgtctataatgacttgaggtaagtgttttttaaatgttagctgctgttacaaaaggtcagcctatagtttattgttcaaatagggatttattaatgcaaaagaagactctataataattgcgtcagtaccacaggcataccccagaactgtcccagggataccagaacttcctgtctcctagggccctgacattgcccttgggcttcactgctacttgttttcccactcttcttcctggcgctcttgcgccccctgccggtctctgttgtgtccagagattccgggccactccactaagaaggcacacacacaaaagaagagttagccaggcgtggtggttcacacctgtaatcccagcactctgggaggccggaggctagtggatcacctgagatcaggagttcgagaccagcctggccaacatagtgaaaccctgtctctactaaaaatacaaaaattagccaggcttggtggcgcacgcctgtagtcccagctactagggaggccaaggcaggagaaacgcttgaacctgggaggcaggggttgcagtgaaccgagattgtgccactacactccagcctggacgacagagcaagactctgtctcgaaaaaagaaaaaagaaaaaaacagcaggaatttcaaaactatttgataattgagactatagacacaaaaagaaatagtagaggttatgaagtaaaccagaaccaataaatttttttttaagagtggattcttggccgggcgtgttggctcatgcctgtaatcccagcactttgggaggccaaggcaggcagatcacctgtggtcaagagtttgagaccagcctgaccaacatggtgaaaccctgtggctactaaaaatacaaaaattagcgtgatgatgcacacctgtaatcccagctactcgggaggctgaggcaggagaatcacttgaacccaggaggcagaggttgcagtgacccaagattgtaccattgcactccagcctgggcagcaagagcaaaactccgtcccccccaaaaaaagagtggattctcactgttctcactgttgcccaggttggagtgcagtggctatttacaggcacgattatagctcactgcagcctcaaactcctgggctcaagcggtccccctgcctcagccttcctagtagccaggactgcaggtgcacacttccttggccaactaaagctgatccattttttaatcttctaagtttcttaacctctctgagatcatgttcctttctccacaaaaataagaattatagtatttaccttgccagtttcaaaaagttatgggtaaattaatatacaacccagcccagtggtcagtaagtggtagatatctgaattattttccacacacttgcaaattctttataaatatatgtcaaagaggaccattaacatagtctcagaaaactgagaattcaggccgggcacggtggctcacacctgtaatcccagcactttgggaggccaaggtgggtggatcataaggtcaggagttcgagaccaacctgaccaacatggtaaaacccccatttctactaaaaatacaaaaattagccaggcatggtggcacgcgcctgtactcccagctactcaggaggctgaggcaggagaatcacttgaacccaggaggtgaagtttgcattgagccgagatcgtgccactgcactccagcctgggcgacagagcaagactctgtctcaaaaaaaaaaaaaaaaaaaaaaaacaacaaaaaactgagaattctggaaaatggttagcatcttttcagataaaaaacacaaaacttagcattctagttactctctcaaattagtctcttgttttgtatggagaattataaaactatcttaggttagtctcttaagtctaaaaagaatgatgggaaaatctgggaatcattggcctagggtattgtggacactgttcccccaggctggaatctggtgaggcttccatctcttgggtggtccctgactcatgccctttccttggccttcctttgagtggagggaaggaggctctgagtagcttgtacaagcttgttatccgacgtaggtccaaaaaccctttcagttactttggtgatgcagtctttccccataattagccaagaggctttccacaatgaggattacatttacaaaacgatctgcttttaacagatgcctgaaatcatccctgtggcaggcacccacttcagatttttttttttaagttgttattgtactttaatcaaattcatatactttagattacttaaattggtattttgcttcaaattataatttttgcttctaagataatctgttattcaaattatcttagatagggtataaagttttaccctcacatgattttaatagaatttcatgaccaggtgaaacctaccattgtccccaaaccctgtccctgcagggctgaggcccatgatgaaggtgctccaggcctagcctaggagtcggaaggactgtgtcttccttcttttgcctcttgattaacgtgtgttgggctgctgggaagctgggaatccaatttgggtactttccaaacatatttggaaacgtgcttgtattacatgtgacattttttcttaaaacattttactccttagcctctcaggacaggatttggggttgttttcacttgttgaaagtcttctatttattgcttatctgaagtaggctgtagctaacatttgactcatgaaaatgaagtaagcattcaaaatgtttttttcctcaaagctaacaggccaactcggaatagggatatcgtaatattaaagtagaaaggcttttcttttgtggcaaagctgtaggcaactttgagaagtactggatttagaataaaatttctatcctctgtttgtaacagagttagggctaaagtttgtgggtttctatcatctgtcagaggaatgttgttttaattgggaaagtgttttatttgagatgtcattcccctgacagagcagaatgactcatggctctctaaatggtagcaatttctagcactatagctggatttaggcccccattctgttacttaaactatagaatacaaaactattcagacctctccagcaccaccaaaaaccctttactttgtttcctgatgcaggtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacaggtatgttaactgatgctttcatgtgttgtccctgattaaatgttgaatccaaacttgttaaaacctttcttatagaaaattgcaaaattttagaacatctgtgcttgtgtcgacaaactgaaacctttaacactttaggaccattttttcaaaaattagattaaatagtttgtttcataacattatgaacttacatctatacaccacacattatatactattacatctaaattggctcactcagcactgaatttggctcttcagagagatcttgtaattcccagtacctagcttagagcctagttagagtaagctagtaaaagctcaatgagggagttttaaaaaatcttctcttagtgccctgtggatacttcaagggaaactttgggcaatttacaaaagaaagtaggtacatcctggccgggcgctgcagctcacacctgtaatcccagcactttgggaagccaagacgggtggatcacctgaggtcgggagttcgagaccagcctggccaacatggtgaaaccctgtctctactaaaaaaatacaaaaaattagccgggcgtgatggcacatatctgtaatcccagctactcaggaggctgaggcaggagaatcacttgaacctgggaggtggaggttgcaatgagctgagatcgccattgcactctagcctgggcaagaagagtgaaactctgtctcaaaaaaaaaaaaaaaaaaaaaaaagtaggtacatcctacttccctctaatggaaaatttagtatatctattatctgcccatacataaaaacatttgattaattgaattcagagaggaggagtggactgaaagtttaaatgtcaggggaaaaaagggcagaacggggtaaacctggattcacatttgtgtacgctgctcctctttacagtaaaacttctcaagttgaccatatttactgttccttcttcctctttccccagtcttaaattgttcttattaaatactgagtagatacaaaggttgtttacgtctgtagactctgaagggtcacagtacagtagacccccatgaatccagcacccagctgaggaaagcacattactgttccagtccactgcatgcccctgccccaggctctgtgccctttcccacccctcaaatataaccattctcttacatttcattgtcattcacttgcatttctttagagataaaccaaaatggtaaactggaaataatgtattatttagttttgcctacttctggcctctatataagtgaagtcatagtaatatactctttggtgatttgattttttttcactcgatattatgttctttagagtcatccatgtgatttaatatagatataattcatacattcttactcctgtgtaaaattccattatatgaatacatcacagcttatctgtttattttactgaaaataaactgtttgtttccgattgcttgatgttaaaatacagtgctgctttgaacattcctatacatgtatcccagtgaccacatgcaaacgtacagattgaacttgttaggtcagagttgggtacatcttcagctttactagatgataccaaaaattttcaatttgattttaccaaattacacgttccccagcagagtagaagtgttctattttcctaatcaggtgggtctgaaatgataccattgtagcttttctaaattgagattgaattcacatgccataaaatacaccatttaaaaatgtcagttcagtgatgttttggtatattcacaaggttgctaatcatcaccactatctgattccagaatattttaatttaaaaacccaaaaagaaacccaaacccattaacagtctctattcccccattctccctcagcccctggcaaccactaatctactttgtgtcactatggatttgcctattctagaaagacgctttatgtgaatggaaccctacagcatggggcattttgtggatagcttctttcacttagtgtagtgtttcaaggttcgttcatgttgtagcaccatcagtatttcattcctctttattgccaaatactattccattgtatggatggaccacattttgtttatccattcatcagttggtagatatttggactgtttccactttttggctatctcgaatgatgctgctgttaacattcttataaaagtttatgtgtaaacatatgtttttatctctaaaaacatatacctacgagtgaaattgctgggtcatatggtaactctgtgtttaacattttaaggaaataccaaactgttttccaaagctcctgtaccatttacagtccaaccagtggataagtgttccaatttctccacatccttacttacttatttagagacggagtctcactctgtcgcccaagctggagtgcggtgacgtaatttggctcactgcaacctccacctcccaggttcaagtgattctcctgcctcagcctcctgagtagctgggattacaggcaccttgccgctatgcccggttagttttggtatttttagtagagacaggatttcaccatgttggccaggctgatctggaactcttggcctgaattcacctgcctcagcctcccaaagtgttgggattatacatgtgagccaccgtgcctgccctccatatccttttctacacttgtcactatacatcttttgaattatagccatcctcacagaagtgaagtgatatctcgctgtgatttttgtggggggggtggggcagggtggtggtggaggggagagagtcttgctctccaggctggagtgcagtggcgcaatctctgctcactgcagcctcgaactcatgggctcaaacgatccacccacctcagcctcctgagtagctgggaccacagatgtgtgccaccatgcccggttaaatcttttttttttttttgatatgtttggtagagatggggttttgccatgttgtccaggctagtctcaaagttctgagctcaagcgatccacctgccttggctcccactgtgattttgatttgcatttccataatgacttctgatgttgagcatcttttcatgtgtttattgactatttgtatgtcttcctcagaaatatgtctattcacattgactttttttttgagatggagtctctctctgttacccaggctggagtgcaatggtgcagtctcagctcactgcaagctccacctcccgggttcaggcgattctcctgtctcagcctcccaagtagctggaattacaggcgcccaccaccacgcccagctaatttttgtatttttagtagagacagggtttcaccacgttggccaggctggtctcgaactcctgacctcaggtgatccacccgcttcggcctcccacagtccatcctttgctcatttttaagtagagttacttgtctttttatagagttgtaaagttatactgagtatacttgaaaacagaagcactatgttttacatgtcctataattaagatttttttcactaatttagaaatcttcctgattttcctaattcctgaaaatattacatattttgtagatacaatttgactatataggttgggtgcggtggcttacgcctgtgatcccagcactttgggaggctgaggcaggcatatcacttgaggttaggagttcaagaccaggctgaccaacatggcaaaaccccatctctactaaaaatacaaaaattagccaggcatggtgacacatgcctgtaattccagttatttgagaggctggggcaggaaaatcacttgaacctgggaggcagaggttgcagtgaacggagattgcaccactgcactccagcctgggcaacagagcgagactctgtcttttaaaaaaagaaatgaatatataagcagtgtttttgcctttgctttcttttgtttattttatttgtaagtataaccatctagaatttcacatcgctttttaaaggcattttaatactaggtctaagatacattaaatccaatgtaagcaaaaaggtagctttaattttgttttattctatgatttggtcctttgctcacaacagaagagtttgttggctgagatttggtttctgttttagttcttcggttggcaccattcatcccctgcaagggccccccgcctctccttgcccctcagcccacctgttccgtctccccacccagctttcctctctccacgctctccagcctgggtcctgctgtgtcattggaaggccagcagaatctgaataaagggcttactcaataaatcaccagaactttattttagcttactcccagtgaaaaggctcagggcgattaggcaggctctgtggttttgatctcttcgtgacctcatttgcagactgggatacagactttctggttagttcaaaggaagaaacatgtgcctctcgtgtgtaaaggggcagaatggcctgggtgggagtgtgagaaccattgtgtggatcctgtgataataggaaagaaatgtaggcttttccaattcattgtaaaaagagaatgtaatgtgttatgctcacaaacaagtaaatagctgtgttctgacagaaggtttctatagttctatatactaattaatattcagcacaagattctggctttaattttattttcttgtacagacttgtcgttatttaatgtatttaaagtctgctattcttcttagacttgaagtctcttttttttcccagctgtctcaaagaaaaaggttcataagacggttctaaaattagcatagtcatttagtttacttttttcctacgtgggaatggcctcttgtttggataccagagtttccaatctaaatcatatagtttcatttttttgtatagtaattgcaaaaagattttgattcaattaaatcatagctcattttggcagattacattttctgagtatgtgtttgggcttatagaatttctttttaggaattacttttaatgtatctaccacttattttgtaaagtggcagctgacagagactatactcattcattcagtaacttttttgtttttttgtttttttttgttttttttgagacagtcactcaggctggagtgcagtggcacgatctcagctcactgcaacctccgcctcctgggttcaagtgattctcctgcctcagtctctctagtagctgggattacaggcatgtatcaccatgcctggctaatttttgtatttttaatagagatggggctttgctatatttgccaggctggtctcgaactcctgagctcaatctgcccgccttggcctcccaaagtgctgggattacaggcatgagccaccgcgccccgccacatttagatcttacatgttccagttactgccttctttgagctaacactgtagatgggaagataaaaagtattaaaccagtaaaattacaataagaattgatcagtgttgtcataggataaatgtggtatatgtatagaaaagaagatggcaaggagatatccaaaatattttcttttctttttttcttttattttttgagatggagtttcgctcttgttgcccaggctggagtgcagtggtgcaatctcagctcactgcaacctccgcctcccgggttcaagtgattctcctgcctcagcctcccgagtagctaggattacaggcatgcaccacaacgcccagctaattttgtatttttaatagagatggggtttctccatgttggacagaactcccaacttcaggtgatccgccctccttggcctcccaaaatgctgggattataggcgtgagccaccgtgctcagcccaaactattttctgtagactaaaacagtaacgtctgtgtctgcctcattaaaaacatgactgcatgtgacctttttaaaataagagctagttgtggggtggggggaggggggagggatagcattaggagatatacctaatgctaaatgacgagttaatcggtgcagcacaccagcatggcacatgtatacatatgtaactaacctgcacattgtgcacatgtaccctaaaacttaaagtataataataataaaaaaaataaaataagagctagtttgaattagaaagcaacagacaccaggaaaaatcttgtcaggaaaaagaatagatatttgatgagtagcagcattgagttcaccagcagcaggcacctgaaaagacattgcggcgggggttttggccaaaacatgtctgtctgccctctaagcagggtggccttcttacctcatgtatttctgatttgattttctcttttcccacttctggctttggctctcaacaccacagtccaggtcttttgtgctgagggcagaaggcattgagggtggtacactgggatgtatcccatgggctgtgctctggagggcttatctaagaaaaagagtaagaaagtgcctttgagtgttttcatttgaataccttctctccgtaagctgccttcccgtattttttttttcctgctcttatgttctagaaatttttttttcttccaagaagatgaagaaacctgggttcttgtcacagcaagagaattgtctagctgtcatgaagaataagcttagctcttgcttttctgtgctttcctcagactgtaacaacagcagccacagaacttgcaggaccgacattttttgttctcattttttcctttagatatctccacaggaccttcttggttaaatcagggactacttctgaactctacccaatcagtttcaaatttagacctgaccactggtgccaccttaccccagtcaaggtacgtatttttttcagggttagaaaggcaaaccccagagccctgactgtctgtgtaggggtgagccggggtcatgttactgccagcacaggtcctgctgagcaggtttgtggcagatctcaccaatggcacctccttcctgtttttattcctatgttttacaaaactgtttataccacattaatgagcctgtgtgtttttaattgtttgctagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtg

SEQ ID NO: 36439 - DNA, 408997 bp, Homo sapiens
agtgggtcccggggaggcggaagcgggtcctggggaggcggaagccggtcccggggaggcagaagagggtcttggggaggcggaagtaggttccggggaggcggaagcgggtcttggggaggcggaagcgggtcttggggaggcggaagtgggtcccggggaggcagaagcgggtcttggggaggcggaagtgggttccggggagacggaagcgggttccggggaggcagacgcatgttccgggggacggggaagtgggttccggggaggcagacgcgggttccggcggagggggaagtgggttccggggaggcggaagcgggtcttggggaggcggaagtgggtcccggggaggcggaagcgggtcttggggaggcggaagcgggttccggggagacagaagcgggttccggggaggcggaagcgggtcccggggaggcggaatcgggttccggggaggcggaagcgggtcctggggaggcagaagcgggtcttggggaggcggaagtgggttccggggaggcagacgcatgttccgggggacggggaagcaggttccggggaggcggaagcgggtcctggggaggcggattcgggttccggggaggtggaagcgggtcctggggaggcggaagcgggttccgggggacggggaagtgggttccagggaggcggacgcgggttccggggaggcggaagccggtcttggggaggcggaagtgggttccgggggagggggaagcgggttccggggaggcggaagcgggtcttggggaggcggaagtgggttccggggaggcggaagcgggtcccggggaggcggaggcgggttccggggaggcggaagcgggtcctggggaggcggaagcgggtcttggggaggcggaagagggttccggggaggcggaagcgggtcctggggaggcagaagccggttgtactgcgcaggccgagcgcgcctggggaccacacgtgggggagtgaggtttcacagccagcttctgggggctcccacaggctttggtgggcccgggcttgaggcccccacctctgcctgtctcctaacggcccgctcctctgtgcatctgagtctaaagttccttctccttacagagacccctgatccaggtaggcctcatcttgactaggttacatctgcaaggaccctgttcccaatataaggtaataaggtcagactcctacggcacaggaattgtagggggacccttctcaactcggtgtagggggaaggaccccactgaacccagcgtagggggaaggaccccactgaacccagcgtagggggaaggacccctctcaactcggtgtagggggaaggaccccactgaagccagcgtagggggaaggaccccactgaacccagcgtagggggaaggaccccactgaagccagcgtagggggaaggaccccactgaagccagcgtagggggaaggaccccactgaacccagcgtagggggaaggaccccactgaacccagcgtagggggaaggacccctctcaactcagcgtagggggaaggaccccactgaacccagcgtagggggaaggacccttctcaactcagtgtagagggaaggaccctactgaactcagcgtagggggaaggaccccactgaactcagcgtagggggaaggaccccactgaactcagtgtaaggggaaggacccttctcaactcagtgtagagggaaggaccctactgaactcagtgtccagaaaagcaaagacacaacccaatgtgaacacaggctaatgttcctggccgcagaggccgggaggagctgggagcacccaccggtagtggcgtgcgggagtggctgatcattttcccagacgccgtaatgactgcagctgtaggacagctgctctctcagaagacgggggactatgcacggcgctgtcacccctgcaggtgacttcacacggtttactataaaccacagagaggggcagacccgtcagcagaggggaaggttaccctcctaggtggaggcgtgctgtgtccaggcgcccgacttccccgtgtgtttgaaaaggttcatttatcataagacccaaggtaaataaacaaaggccgcttccttggccgccctggaagtccctgctgcctcccatctggaatcctggggtctgtccgggcgccagcccctttccaaacaccccttcccgcacccccaccgcaggccagcgtctcgggccccgtctgtcattcgtgaacagctgtccggggggctccggtggcagagacgccccggccgctcgccgctctcggcctcgcccgcccagtccgagtggggggcggtgcacctgcgcatgcgcgcccctcccccgccgccctctccccgcccctccccacgtgacgccgtgggaacccggaccccagcgcctccgggtgggggcagccgccggccgccggccggggatgggggtccggggtggcgggagagcaggaaggatggggaggggacacctggctcgcggggtccgggggtcccggaggagagggtgggggaggggaggccgccgcgaacgggctcccggggggggtgggggggactcacccgcacgacgtaggagaccccgggccccaggaccctggcgtcggggtgtagccagccgtgcgcgggtttgtggatgaagctgcccttccggatccactcggcggcggcggcggcgtccccggaccccgccgccccccgcccgccccgcgacccccgcgaccccgcgccccgacagcggctgagcgcgggcaggggacagggcgcggcgcagcggggctcgcaggcgcccaggacggcggccgccagcgccgggacgccccccgggcccgccggctcgggttgggggtccgcgccccccgaggccccagccgcccgcgccgccgccgggccgcggcccaggaagccgcccggggccgcgaacttccactgcggcattcggggcagcaacgcgcagaaggtggtgggcgcctcgggctcggggggcgcggggggcgccgggggcgcgcgcccgcccggaccctgcgtcatggccgcggccgcccgacggagcccgaccgggcgctgcgcctggcgcggaggaagccctcccgctccgcccgctccctcccgccccccggcccggtgatgtcatccgcccggcccagcgcgcagccgcggggggctgcgcccctgggaccccggccctcctcgtcccggagcctggccgcgaggctggggaaactgaggccctccgaggacaccgggcgctggcctggaacccgcagccaaggcgggacggggctttgaacccagaaccccgtcagcgaccctccccgctgcgccccccacccccgcccgccgcccaagttcgcagaaggaccgagctggagaagcttagaaattccacatcccttctttcccctatttcctagtggggaaactgaggccccgggaggcgcggccagggaaaagagaaccccagaccctaaggtcagcccctccctctccgttgttgcagctagaaggtaccttagggtcacccctatttcttagtggggaaactgaggcgcggggaggggaaggggcgcggccgagggctcacagacgaagctcaaacccaggagtgccggctcgggggtggggggggggggcggggctaggagcggagccgggcccctgctctgcggcctgtcccggcctcagtttctccggctgtaactcaggggagcgggctggagggtcgcggcccttcttccctcacttctggggagcccagtcccgcaccagctcatctgagctctgggcctcagcctcccaggccggtcgctccatccccagcctcaacctctccgagaccggccgcaccttccctggcctcaagggtcggttccttctgcaccagaaaacggggtgtcactgtcaccccgggacccagcctcctggcccgacttggctggagctcccctgcacctgccccgccccaagcagggctgattgccgggaacaaagggaggggccgggacgcgctggcaggtggggagggagggaggggcgaggctgcccggagcccgatcgataattcaggggatgagatcacagccggcgccgcccgcggggccggggaggtgggggaggggagcgaggcgcgcggtcgcgatcggccgtctctgccgcggcgcgtgtcggactcagcccctgcgcgtccgcgggaggagcagatcgtgggcgcgattggtcgggctggagccgcggctggacctgcgcgcggtgtgtgtgttgtgcgcagggtgtacgctgtgtctgggtgcgtgtccaggcatatgcaggggatccaggctgctgggtcctggggtgtgttcacctaatgggtaaagggtgggacaggtttggcggccctaggctgagggctgtgggctgaggagagagcagccccaccaccccctctctgcgccctgcatgcctcccaggctgcatccctcagggaggtcccggggcagtgtcgcaccctcccaagctccgggattagggtctttctggatgggaggtttgtaaggtggtccaggtgccatccctccctggcacacagagggctcagtcacacggcacccccggtgtgtttccttcctgtcccttggagacagtggcaggaactcagtccaacatccagagttcaaatcctgacatcagactgaggtgggggctcacagcatgccccaggacaaatgtccagtctctccaaagcaccatttcctctcagtagatgcccctggtcctgagttgctatgaagcctagatgatctttattaatatccaaaacatagcaagcagctactgatggcagatattagaatacctcaagctcctatacatccttcaaaacccagcttcaatattgcctcttccaggaagcctacctggctgcctgctcaaaagcttggctccacctccggcctcccctcgccctgggtctctcttctggtctctcagaccccctggccactggagggctacgggtctggctctggagggcggcgttcgggtctcttttctgtgacatcaatagacacgttaaggccgggctcggtggctcatgcctgtaatcccagcactttgggaggccaaggcaggaggatcacaaggtcagaagatcgagaccatcctggctaacatggtgaaaccccatctctactaaaaatacaaaaaattagccaggcgtggtggcgggcgcctgtagtcccagctactcgggaggctgaggcaggagaatggcgtgaacccgggaggcggagcttgcagtgagccgagatcgcgccactgcacttcagtctgggcgggagtgcgagactccgtctcaaaaaaaaaaaaaaaaaaaagacacattaaatgagtaagcacatgtgatgctgacagctctccagcccaggaaaggtttattggctaagcaactgtagaaggtggagtgggaaaggcacaggcctcggggctgcctccagcctgagtttgggctgggaccggggctaacccaagctgtgatggggatccaggccctagtggagctggacgccgagttctgggacacaggaagctccatctccagccagctactggggagggccggaaggtgtccctttccccacctggcctggcctggcctggcgtgacctggaagaaactggggcactggaaggagactcaccctgcaccctgcacagggccatgggtcacagcccccagggactggaaggatcaggtgtcctagaaggacctggacagttcaggaaaggggagggaagactcctttcccagcccctctcgccttctagcccctccagccaaagccaggccccaggagaggcccgccagccccccgttcactgtgtgggaaacaggcctggcctagcagcagcggccgggcagcctgtgccccgcaggccgggagggcgtggtggcggccatggtgctggcccgtttcgagtggcggatgcccatagagaacgctggagccctggctttgttcacggtgacctgctctgggcagtgggcgccagggccgggggtctcctccaggggtcgcggggcccggggccgccccagcatggtgaaggcaggcaggcgctggcggtaggtgtttgcgtccgggctgtcgtactggcccgggcctggtatctcagcaggatcctgcggggggcgggcggggggggtgcggcccaccaccgtgtagctggggctgctgggcttggtgaagatctgtgagccccacagagggggcatggtgtaggcattaggggcaggggctgaggtgtccaggggcttcagggggaggcggcagcccagggtgaaagccggcggtgtccgatggcgcacagggggcaccttctctgggctgtaggccccagggcctggcgtcacctccggacctgagagagtggggaaggaaaggtggcactgatgtcctcacctgcccagagacccggcctggctccccatggcccacatgcaccctggagcttacaacgcttctcaagcagcctgggtgcctttctctcccttccccatcctccatacacatggtctgtgtttcaagcctccaggactttgcccaagctggacccagggccaagcacgccttcattttccacccctcctccctgctgccttccccagcccatccagggtagagccctcacagcccttccagagccccacagcctgggttttcccctctctccagacgtgagcacactgaggtgggatggtctgcacctgcatctaactgccccaccagactgggatcccataaaaaggaaggcatgtcaaatttactccaactctccagcagttgactgtctgagttgatgggtgaacaggataggtaggaggtgagtggttgagcggggagtgaatggttcatgaagggatttgtaaatggatggatgagtggatgatggatggatggatggatggatggatggatggatggatggaacggttgataggtagaaggaaaaaaggaaggattcatagatgagtgggtaggtgggtggctgaatgggtgggagggtgggcggatggatggatggatgagtgagtggatgggtggatagatgatggatggatggatgggtgggtggaaggatggataggtggatgggtgagtgggtggatggatggatgggttgatgagtggatggatggatgggtgggtgggtggatggctgggtgggtagatgctaggtgggtcaatggatgagtggatggatgggtggatagaatgttgggtggatggtggaaggaggggcgggtggatgggtggatggatggatggatggatggatgatgagtgggtggatgggggatggatggatgtgtagatggatggatggatgagtgagtggatggatgaatgggtaggtggatgggtggatggatgggtatgtggttggatgggcgggtggatgggtgtgtggattgatgggtaggtgagtagatggttggatggatgagtgggtgggtggatagatgggtgggtgggtggatgggtgagtggatgggtgaatggttggctggatgggtgagtggatagatgggtaggtgggtggatggatagatggatgagtggataggtagatgggcaggcaggtgggtgggtggatgggtgcaggtcggtgtgtggatgggtgtgtggatggatgggtgggtggagggatgagtgggtgggtagatggatgggcagatagatggttgtgtgggtgggtgggtggatagatgaatgagtgggtaggtgaaaggatggacagatggatgggtaggtggatagatgggtgggtgggtggatagctggacagatgggtaggtgggtggatggatgagtgggtgggtggatggtggatggatgtgtggatagatggatggatgggtgggtggatgggtgggtggatgggcgggtggatggatgggtggatagatggatgagtggatgggtggatggttgggtgggtggatgctaggtgggtggatggatgagtggattgatggatggatagatggttgggtggatgctggaaggacgggtggatagatggatgggtgggtggatgggtgggtggatggatgagtagatggaagggtggatagatggttgggtgcagggtggatgtatgggtgaatagatgggtgggtgggtggatggatgagtgaatggatgggtggatacatggttaggtagatggtagatggatgggtggatagatggatgggtgggtgggcgggtgggtggatggatgagtggatggatgggtggatacatggttaggtagatggtggatggatgggtgggtgggtggatggatgagtggatggatgggtggatagatggttgggtggagggtggatggatgagtggatagatgggtgggtgggtgggtgggtggatggatgagtgaatggatgggtggatacaaggttaggtagatggtggatggatgggtggatagatggctggatgggtgggtgggtggatggatgagtgaatggatgggtggatacatggttaggtagatggtggatggatgggtggatagatggatgagttggtgggtggatggttgggagggtggatgctaggtgggtggatagatgagtggattgaaggatggatagatgtttgggtggatggtagaagcatgggtggatagatggaggggtgggtgggtaggtgggtggatggatgagtggatggacgggtggatagatggttgggtggagggtggatggatgggtggatagatggatgagtggatgggtggatggttgggtgggtggatggatgagtggattgatggatgggtagatggttgggtggatggtggaaggatgggtggatagatggatgggtgggtgggtgggtgggtggatggatgagtggatggacgggtggatagatggctgggtggagggtggatggacgggtggatagatggttgggtggagggtggatgggcgggtggatagatggatgggtgggtggttgggtgggtgggtagatggatgagtgtatggacgggtggatagatggttgggtggagggtggaaggatgggtggatagatggatgggtgggtgggtgggtggatggatgagtggatggacgggtggatagatagttgggtggagggtggatgggcgggtggatagatggatgggtgggtggttgggtgggtgggtggatggatgaatggatggacgggtggaaagatggttggtggagggtggatggacgggtgggtagatggttgggtggagggtggatggatagatggtgggtgagtgggcaggtggatgggagaatggagtcaggcaggtgtgtcaggtgtgcgggcaaactgttgggtgcctgtgaaggatactgccgatttgccacagtccccattcacctctcacctcctgacacctaggccagctgcctctgtggccatgtgtgcccagggcctctgtcatcctgacccacttcactcattcagttctcccagccccagtgggcactgcagtggcggcccctcctccgtgtcccttggatttgatcactccaaagactctgcattctaagaactccaaggataagagggggagggaggacagggcaggagagtcgctgagaccctggaaagcaggtccttgtgcggctgcttggctccagtactcaccccgagacttggcccggccctgcatggagtaggcaggggtgcagctgcggccaaagcgtgtgactttggggtccaagaagtagatggggcccgggctggtgtcctgaggtggtgctggggagaggagcccagagtgctgagagtgattctgaagacagtgcctgccccaccgcccggcctcagtgcccctcttggccccgagacactcccaccaggtcagaggccaccccagtcccatctcggaggggtcaccccaggggccctgagttgtggctgcctgaactgggtgcctcaggtctctgctctgactctgtctcctcacagtcaaagtgattctgctctgctgctgtttgtagccacctctgcccctctaacctctgcgcaggtgtgggctggagaaccagctcgtgggtttgttggaactggacataattaggctgggtgtggtggtgcacacctgtaatcccagcactttcagaggccgaggcaggagggtcacttgagctcaggactttgagaccagcatgggcaacacagcaagatcccgtctctactaaaaatttaaaacttagccagacatgttgacatgcacctggggtcccagctcctcggaatgctgaagggggaggatcacttgagcctgggaggttgaggctgcagtgagctgtgatcgcgccactgcactccagcctgggcgacggagcaagatggagtctcaaaagaaaaaaaaaactgcacataaagagtgacaagagcgactaggctctgaaccagggcttcggcttgctggcaggtcgcatgcttaagaggggggctcggcgttggaccacgttcaaatccagcagggcctcttgtgagctggtgaccttggccaagttatttatcctaagcctattttcctcatcagcatgttgagaaaatcaaaaagtgagaggatccacagaagggagtgatcctgtggccttgcacttcccgattgagaccgtttgctgctttcaccattattgccacgccaaagcacaaccagtgacagatgcgcaggcacctgtgtgtagcagcgtgaccggtgttcacggccccacagaccgtctgtgcacacatgctgtacatgtggcagtgagccacgggtgagggaggaaacgtcatccacaccttcgccctcccctgaggagtccgtggcacgcagtgtggcccagacacggctccagacctccccgaaacatcatccaaacctttgccctcccctgaggagtccgtggcacgcagcgtggcccagacacggctccagacctccccgaaacgtcatccaaacctttgccctcccctgaggagtccgtggcacgcagtgtggcccagacacggctccagacctccccgccacaggcacaagtacttgcacatacgctgtggtccccaacgcaggctcactggccagactccaagggtgatcactgacccttagccacagcctcatcctttgttagactggcaggagggagggggtctatttttagccccttccccaggccctgggcaaatacagtcccccaggactggaagaggctggggagattcttttttttttttttgagggagtgtctcactctatcgcccaggctggagagtgcagtggctcatggctcactgcagcctcgacctcctgggctcaagcaatcctcccacctcagcctcctaactctgggaccacaggcatgcaccaccatgccctgctaattttttattagaaacccttgatcatggctgggtgcggtggctcacgcctgtcatcccagcactttgggaggctgaggcgggtggatcacctgaggtcacgagttcgagaccagcctggccaatatggtgaaaccctgtctctactaaaaatacaaaaattagccgggcgtggtggcgggcgcctgtagtcccagctactcaggaggctgaggcaggagaatcacttgaaccccgggaggcagaggttgccgtgagccgagatcgcaccactgcactccagcctgggcgatagtgtgagactcagtctcaaaaagaaaaagaaaaagaaaaagaaatccctggtcataatcccatcgcccctccacagatgcctgggcctcactcacgtgaccacagactcgcctcaaagtgctcactgtgcagggcttagccatcaggactccccatgctgaagcactgaccttggcctctaccctgcacctggaaccttccagccttttcttctgccctccccaacccctggctcagtgccccgtgagaaatgaacacaccccagctcatcatgacatcactcatctcaaggcctcagcctacaaacaggctctgcctggagttcagttcttctgggggctccaccaaactcctattcatcctacaaaacccagatcccatgttccacttccaagaagcctaccctgggccttcagcaaagtgtgcacgatccccagtccaccagcctccccacgctgtctcgggcccaggaggtgtcctgagactggatttgaacctgggaactcagatcggtctgggtcataggctaagttctttttttttttttttttgcgacggagtctcgctctctcacccaggctggagtgcagtggcacagtctcagctcactgcaagctccgcctcccgggttcatgccattctcctgcctcagcctccctagtagctgggactataggcgcccgccaccacgcccggctaatttttttttttttatttttagtagagacggagtttcaccatgttagccaggatggtctcgatctcctgacctcgtggtccacccgcctcggcctcccgaagtgctgggattacaggcgtgagccaccgcgcccggcccataggctaagttcttaagccagtcctggggacagggggtgctgacgccttcactggcattctgggaccccttgcagcttcctgagtcccagtgtgggctgggatttttgctcattctgaaggctgagaacaggctgctgtcctgcccctcctccagccgcccctcccagcaggcctctgtccaaatccccacacaagacccttccgaccgcgctcccagcccagctgggaccttggagcagcggtagaaaatggagggatggaatttgggagccctgagacctgctggcccgtggtagcagcgccactgatgaacaccaacagctccctgggtgccgggcggggtccacgccggagctgcttcactgcgcccgttctagacaggagcaggcaccatggggcaaggccaccagcctgtggcacagcgagccggtgcaccccatgcctgccctcccgcaggcagccgggaatgtccacagagatacaccacagccctgtgagacgggccaggcccggggagcccccaccttcatggtggagaaactggggctcagggctcagcctcacacccgacagcacacgtttactgagcacttactattttttctttttcttaaatttgtttttgtttttgttttcttttcttttctttttttgagacggagtctcgctctgtcgcccaggctggagtgcaatggcatgatctcggctcactgcagcatctgcctcccgggttcacgccattctcctgcctcagcttcccgaatagctgggactacaggcgcctgcaaccacgcccggctaattttttgtatttttagtagagacggggtttcaccatgttagccaggatggtctcgatctcctgacctcgggatccccccgcctcggcctcccaaagtgctgggattacaggggtgagccactgcgcccggccctaaatttgttttaagacgaggtctcactctgtcgcccaggctggagtgcagtggtgcaatcatagctcactgcagccccgacctcctgggttcaagtgatcctcctgcctgggcctccccagcagctgggaccacaggcacacactaccacacccagcttttcggctacttttaaaagcatttaatcctcacttaatgaatctcaaaaaggcatctaatccttacaacaggcctgtatggagtctgttattatttttaatataatgttaatgtttttgttactattgttaactttttttttttttctttttagagacagagtctcactctgtcgcccaggctggagtgcagtggcgccatctcggctcaccgcaagctccgcctcccggcttcacgccattctcctgcctcagcctcccgagtagctgggactacaggcgcccgccaccacgcccggctaatttttctttggtatttttagtagagatggggtttcactgcgttagccaggatggtcccaatctcctgacctcgtgatccgcctgcctcagcctccttaagtgctgggatttcaggcgtgagccaccgcaccggcctgctattgttaacttttaacagaaactgagttgcaaagcacttaagcaatttgcctgagtccaggcagcaaggaattgcaaacacggtaaggcaggtacaggtactcacctccttactgcgctctttctccttccattctcattatcaatgaaaaaacagagagggacagcagcttgcctgaggtctcacagtaagtaggaggtggagcaggttgtacagcccagccctgcctgcttcctgccgcactaactgggggcctggatctaaggggtaaggagacccatcagtgctcctggggggagattggaggatcagggaagcctccagccgcccactcgcccgccttaccctcactgggcctccggacgagcgagtaggcgggactggccaccctggtgcagtcgtggttgatgaagcccacggtggacggcaggacatacaagcctggccccgagcctgcagcccaaagccctcaggtcacctcctgggcccagattccccgaagaaggagccctggacccagctcctgagccttagcctgggttcccctctccctccatggtgaggattgggggccccggggagcaagaggctgctgcccgtcggggacaaaatgtgatgcctgcattgtgagtcagacatgaatcacagaggaaaagctggggacagcagcccccctcaccctggggcacagacagggagactggggcctgagcctcccagagatacacggtcacaggtggggaaactgaggcctgagcctcccagagatacacggtcacagatggggagactgaggcccaggcagagatacacggtcacagatggggaaactgaggcccaggcagagatacacggtcacagatggggaaactgaggcctaggcagagatacatggtcacagatggggagactgaggcccaggcagagatacatggtcacagatggggaaactgaggcccaggcagagatacatggtcacagatggggaaactgaggcccaggcagagatacacggtcacagatggggagactgaggcccaggcagagatacacggtcacagatcgggaaactgaggcctgagcctcccagagatacacggtcacagatggggagactgaggcctgagcctcccagagatacacggtcacagatggggagactgaggcctaggcagagatacatggtcacagatggggagactgaggcctgagcctcccagagatacacggtcacagatggggaaactgaggcctaggcagagatacatggtcacagatggggagactgaggcccaggcagagatacatggtcacagatggggaaactgaggcccaggcagagatacacggtcacaggtggggaaactgaggcccaggcagagatacacgatcacagatggggagactgaggcctgagcctcccagagatacacggtcacagatggggaaactgagggccaggcagagaaacacggtcacagatggggagactgaggcccaggcagagatacacggtcacagatcgggaaactgaggcccaggcagagatacacagtcacagatggggagactgaggcctgagcctcccagagatacacggtcacagatggggagactgaggcccaggcagagatacatggtcacagatggggaaactgaggcccaggcagagatacacgatcacagatggggagactgaggcccaggcagagatacacgatcacagatggggagactgaggcctgagcctcccagagatacacggtcacagatggggaaactgagggccaggcagagatacacggtcacagatggggagactgaggcccaggcagagatacacggtcacagatggggaaactgaggcccaggcagagatacacggtcacagatggggaaactgaggcccaggcagagatacacggtcacagatggggaaactgaggcccaggcagagatacacgatcacagatggggagactgaggcctgagcctcccagagatacacggtcacagacgccatgtgttgtggcttctgcagaatctcgatgccacagggatcaggagagaccacagaaccagcccgaggacctggcttggggcctgactccagccgctaattgtgggtgaggaaactgcggcccgtcctgggccctcaccgaggccagcagctgatgtggctcccagcagagccgcctccgcacacgcgcccctcgccctgccccacgttgtctagggcgcccgtccctgagggccacgctggaaatattccctcctccccgcgtctcccgcatgatcgctgtggctttgcccactgctgtacccacagcccctggaaggggacccggctggcaaagcacgcagcttccgttggacagacacatactcggggctcacggcaaccccgtgtccacacccatcctgccggaaggaaaactgaggtctggggaagggcaaggacttgcctgaaactcctgcctcctgctgggctcccagaacattccagaagccccagaagtatggggagtggagcaggaaaaggtcccacccatcccccacggctggcacgcaccgttctccagggtggccgtcccacaggacttcctcaggccggtctccggaatctggccctccgtcactcgccggccaaggggggctgtggccagccgtggggtggagtcgcagctgagggtccccatggtgggcaggcgatggcccccacagcacccacggggcctggtgctaccttctgagccgcagcagctctggcggccacaggcccaggcaccgtccccaccttcacggcctcaccacaccctcccacgaccacagccgcacagacggcctcttgtcccgcagcagggagtcgtggggccctggcccaaggcaggctggtcggccggacactggcctggaagtggggccgggatcgagtgtcggccaggcggctggatggtccaggaaagagtccggtgtcagcagagtgcgtctcccgggagccggcagagctgggcagctggggccagggccggccccagggaactagacctgcaaacatgacacccacagccttgcagcaggagggcctggcggggtcgtgggtggcgtggccccgtttctacacctggggaaactgaggcacagcccaaggtcatacagcaagtacacaactctgggagtttcagctctgagccaagaagcattcactgcctcatcctgtcactcattcctgccaaagcatgtactgggcacctactgtgtaccagcctctgttgggggtggtgagaactggacacgaacagacggaaaagaaggagatgttctcaggatgggagagagaaagtcgtcagtaaatgtgataagtgaacacagtctggtgtatgaggaggcactgaacgtgagggaaaacgcagacaggtttggggcccagggtagcagtgtgggtgtgggtgagccccacggagaaggtaaaactgaacagtcccaaagcaggtgaggaggcagccgtgcagaggccctggggcagcggcgaggacagcggggaggtgagagccgtcctcactgcctcccagatgcctccgagatttaaaccacaatggattttgatacattcaaggcgaccactgcgtgaggctccaagaagaggctcagaaaactgccagatgagatgcacgttcctgtctcttccttgtttgtttctgtattttttggagccttttgcagtgtaatttttttttttttttgagacagagtctcactctgtcacccagcctggagtgcgctggtgcgatctcggctcactgcaacctctgcctcccgggtttatgcgattatcctgcctcagcctcctgagtagctgagattacaggcacccgccaccacgcctgactaatttttatattttttagtagagatggggtttcaccacgcctggctaattttttttttttttttttttttttttttttgagacagagtcttgctcccccgcccaggctggaatgcagtggcgcgatctcggctcactggaacctccgcctccagggttcaagaaattctcctgcctcagcctctcgagtagctgggattacaggcatgcaccaccacgtctagctaatttttttgtatttttagtagctaattacaggcacactccaccatgtccagctaatttttttgtatttttagtagagacggggtttcaccacgttggccaggatggcctcaatctcttgaccttgtgatccaaccgcctcagcctcccaaagtgccaggattacaggtgtgagccaccgcgcccagccaatttttttgtatttttagtagagatggggtttctccatgttggccaggctggtttcaaactcctgacctcaggtgatccacacacctcggcctcccaaagtgctgggattacaagcgtaagccaccgtgcctggcctgcagtgtcatctttaacagctttattgatataattcacataccatacaattatacatttcaccctgcaatgtaattttaatgtattgcatgttttaaaattttttaatcaaaatggtatagtctacataaaggatcataaaacaagtcttagtacatatcaaacttttgaaacttacagagcatattatctggtgaaaaaggaattaaaatagaaatcaccaacaatacgatatccaggatcccccaaatatatttagaagttaaacaacatacttctgaataacccacgcatcaaagaagtcatcacaaaggaagttagaaaattttcaaactaaatgactataaaaaatcaacatattaaactgtgtaggatgcagttaaagaagtacttagagggaaaatggttgctttaaatttttatatgagaaaagaaggctgggcacagcggctcacacctgtaatccctgcactttgggaagccaaggcaagcagattgcttcagctcaggagttcaagaccagcccaggcaacatggtgaaaccccatctctacaaaaaatacaaaaatcagccaggagtggtggtgtgtgcctgtaatcccagctactcaggaggctgaggtgagaggattgcttgagcctaaggaggccaaggctgcagtgagccaagattgtgccactgcactccagcctaggcctaagtttccacctaagaagctaggaaaacaagagtaagtataaggaagattgtaaagataacagtagaaatccatgaaattgaaaactgtagaaataatcccttggccgggcactgtggctcatgcctgtaatcccagcactctgggaggccgaggcgggcggatcacttgagatcaggagttcgagaccagcctggccaccatggtgaaaccccgtctctattaaaaataaaaaaattagctgggcacagtggtgcacgtctgtaatcccagccacacaggaggttgaggcaggagactcgcttgaacccgcttgaaccctggaggtggaggttgcaccactgagccaggatcacaccgctgcactccagcctgagtgacagagcgagactccacgtcaaaatcaaaaaaaagagaaaaaaagaacgcctcctccccatcccaaaaaagctggtctttatttttatttttatttgtgtatttatttatttttgacacggagtctcgctctgtcgcccaggctggagtgcagtggcacgatctcggctcactgcgagctccgcctcccgggttcacgccattctcctgcctcagcctcccgggtagctgggactgcagacacgcgccacgccacggcacgcaggccctgcacggcctcgtctccacctccccctgtcctctcgtcctgctccttcccctttgccgctctactctgaccatccggacctgctttccctccctcgagcccctaagacggtctccacctcggcctctgcctgagctctctctacctgagatgcctctgccagcaaaccaaccctcgctggccccttcctcggtcacgagggcccccagcccacaggccctgtcactgcccaaccttggacacaccatttgctcgtttccagaggcagcacaactccagagccacagcagggatgggtgccgaggagggagagaggaggaaaggccccaacctccctcgaccaaagctgctccttcaccaaaaccagccgaagtgcaggaccccaggggctcccacggctaaagagacagaggggacaagggcctggaaggtgttcccccaaccccatccctcctcacatccgggtcaccaggtccaggccacaccagacagccactaaaggcagacagccagagacttggttccagcccggactcggccccacctgcctccgtttccccattttacgtggggtggaaccaaaagctaacacagggaagacaggatgggaagccggccaagccgacagcatgttgctgggaggacgctgagggccggcagcctcgccagaacgagctggggcccctccagccaccagtccccttctgatctgatcgcaccagattctatcaactctgtcttcagctcagagcttgtcgcaactgccaagcaaagagcttgcaaatgagatgcaaatgaattcaacacacatgcagatgagccctgattttaatcctgcctgctcgacagaagagactaaatcacaacagtgaaaaaaagggaggctggaccggatgagaggccggaggccggccctacgtccacccgcccagctgccggctgcaggcgagggacgtcactgcccggcctgggtgtcctgggtgggaggtgactccgttggtgctcccgagacccttgttctcaccgtaattaggaactcagccagtgtttatttggggccaggccctgctcaggtgctgggaaaacgggagaggacaaaacacacaagttcctcgtcctccctttcccttggagacaggcaggcagataagtgaaacttacgtgagtgcagagggcacgtcgcgctatggaggaaacgtgggcgaagggggtgttggaggccgaaagagtgagggccgtgatcaactcagtataccactggggggctatatgagtagacagcaaactgttctcgtaaatgcagaatgttggcaaactgacaaactgcgtctgccgtgcagaagggctgctgagggccatcaccacccaggcacaaatgtttcctacgattaggcataattgaagcccgtcagtaacaatatgaacctgtgatcaattaagcagctgctcaatcgttacctcctcctctctgctcttgttacccaataaatactaagggctgtagaagctcaggaagctgcctttgctcactaggagcagggagcccttttcttcttctttttctctttttttttttttgggggggggggggatggagtttcacccttgtcgcccaggctggagtgcagtggcgccatctcagctcactgcaacctctgtctcccaggttcaagtgatcctcctgcctcagcctctcgcgtagctgggattacaggcgtgcgcaaccacgcccggctaatttttgtatttttagtagagacggggtttctccatgttggccaggctggtctcgatctcctgacctcgtgatccgcctgcctcggcctcccaaagtgctgggattacaggcgtgagccaccgtgcccggctaattttgtatttttagtagagacgggggtttctccatgttggccaggctggtctcgatctcctgaccttgtgatccgcctgcctcggcctcccaaagtgctgggatgacaggcgtgagccaccatgcccggccccttcttctctctttccttctctcttcttcttccccacgttgcccttcctttaaaatagttacttttaagtttttatttctatttaaaagtttcctttgtttcttgttatcattttctacgtttgtcccttcgttcagtcttataatgacggtctcaggcagtaactgtggcggtcagccacagggtggttggtggtgtgagcgtctgcgatgtgaactgggaggtcgggagcctcgcggagaaggtcacgctccagcagagaccagaggagaagccgaactcgggaggcgggcgaggcattccaggctgacaggaactgcacgcacagaggccctggggcaggacctgcctggtgtgtaggagaaacagcgacgaggcccgtgcagctggagcagcgtgagcaaggagaagaggagccgggaggaagccgatgcggcgggtcctgcacggcctgtggactgtggggacacgggtgacgtgtgagcagggacgcgtcccaatcagagctcacaagcgccctctggtgacatctgggagagcaaaacgtgggcggtgccgggagagggcgtcacatgctgggaaggatgatgaggatggatgacaggaaggatgataggggaggatgatgggaaggatgatggggaaggatgatggtaaggatgatggagaaggatgatggggaaggatgatggggaaggatgatggggaaggatgatggagaacgatgatggagaacgatgatggagaaggaatgtgggaaggtgatggggaaggatgatgggaaggatgatggggaaggatgatggtaaggatgatggagaaggatgatggagaaggatgatggagaacgatgatggagaacgatgatggagaaggaatgtgggaaggatgatgggaaggatgatggagaacgatgatggagaacgatgatggaaaacgatgatggagaatgatgatgcagaaggaatgtaggaaggatgatggggaaggatgatggaaaggatgatgggaaggatgatggagaacgatgatggaaaacgatgatggagaacgatgatggagaaggaatgtgggaaggatgatggggaaggatgatgggaaggatgatggagaaggaatgtgggaaggatgatggggaaggatgatggagaacgatgatggaaaacgatgacggagaatgatgatggagaaggaatgtgggaaggatgatggggaaggatgatggaaaggatgatgggaaggatgatggagaacgatgatggagaacgatgatggagaaggaatgtgggaaggatgatggggaaggatgatgggaaggatgatgggaaggatgatggagaaggaatgtgggaaggatgatggggaaggatgatgagaaggatgatggggaaggatgatgggaaggatgatgggaaggatgatgggaaaagatgatgggaaagtatgatgggaaggatgatgggaaggatgatggagaacgatgatggagaaggatgatggagaaggatgatgggaaggatgatggagaacgatgatggagaaggaatgtgggaaggatgatggggaaggatgatgggaaggatgatggagaaggatgatggggaaggatgatggggaaggatgatgggaaggatgatggggaaggatgatgggaaggatgatgggaaggatgatggggaaggatgatggggaaggatgatggaggatgatggagaaggatgatgggaaggatggtgggaaggatgatggagaaggatgatgggaaggacaatgggaggatgaccgagaaggatgattggaggatgatgggaaaggataatgggaaggatgatggcaaccaagaccaactcatcttcaccaagctcatggtgtagccagaaagttgatcacccacagcagcactgcccaccagaaacagactgagaacctcctactttttttttttttttttttttgagacaatatgttgctctatcacccaggctggagagtgcagtggtgcaatcatagctcactggagcctccaacttctgggctgaagtgatcttcccacttcagcctctggagtagctaggactataggcatgtgtcaccatccctggctaatttcttttttgtgtgtggagatgggatcttgctatgttgcccaggctggtctttaactcctggcctcaagcaatccccctgccttagtctcccaaagcactgggtttacaggcatgaaccaccatgctcggccatttttaaattttctagtagttgtatcaaaaaaagagaaacacgtgaaattaattttaataatacattttattaacccccatatccaaaataatatcatttctgcatatgaacattacaggtgagatatttcacattcttcttttaatgctgtcctcccagcctggcatgttttgcactctctgcctcagtgtggagcgtccacagttccagtgctccagcgtcacctgtgacctgtggacgctgtgtcgggcagcacaggtctagagagtagagcctaggactgatcccttgggccaatggtgctcagccatgggtgttgctgcccccaggggacacttggctatgtctggagacattcttggctgccaggaccaggagtgctgatgacatctagtgactggagaactacaacgctgttcctcccaagagaagaccctcaaatgtcaatggtgtcaagatggggaaatgctgccttagtggatgggcacttattaatcgcctactgcatacagggtgagatcggcagggcgtccttggcatacagcagattactcatgcagaacggctctgctgccagctctgtgctcacaggcgccaccccacgagctgttccatgcctatcaccatggacagaggcggaggtcacaaagccagcaggagtgtggacctaggactcaagtccagaatgttcttggccctgcactgtcctgcccacctacacctgccagtctgaatgtcacccaccctggccgccatcatacgagcaccccagccccgcccctcgacgggcaccgaggctattcccacttcacctcctttacaatttcctgcagtgaacttcccaggcagacctcctgcgcccatgaaccagggtttctggattagacactgtgtggtccctgatgaatcactgcaccactgtgcatgtgtttcctcctctgaaaaacgggcatatgtcagcctgactccacagggtcactctgaagacaagggcatctggccccttatcattcaaacatcctcttccagccttccctcactccagcaaatggcacctccagacccatgctgacttggatccaaacccctggggccgcttcctggatccaaagcccactcagcagctgactgctgctctccacctcacagccacggcccagtccagggccccatccccccccaacacccacccccacctcctcagggatccctgggacgcctctcccagccccaaaaggccactctatgtcagccagagccagctcttcagacatgaccatgggaagccctacagacgcccatcctggctgccactgcgtctagcacaggctcctccccgacagacctccacctgcctgagttccctcaccactcccccaggcatgcaggctcaccctcgttccagtgacacggagctatgagatcatggtgggctgaaatcaacagaccaggggttcccaacccaggtgattgcccccaggggacgctgggcagtgtccaaggacacctgtggtcgtcacgactgggggagctcctggcatggggtgagtgggggcagggatgccgctaggcaccctgcagtggccgggaccaccccacctgggatgtccacagggcctgcggaagaccctgcagcagagagccatcagctcttcctctcatgggtccccggaagctctgggatcaatcaatccccatggggccggctctgggatcaacactgtgtccccagctccccggaagcccctgcagccatcttccttccctctacctgtcagccgccatcctgcctgtaaagccaggccccgctttgcctcttctgtgcggcacgggaaggggacggtgcactcatgagacctcccaccctgcctgtgagatcagtcctggtgtgggtgacagctgtccatcactcacttctgttgctgggcaacgttccatcccatgaagatgccatgatttactcagagcttctaggctgcttctagctcggaacaaccgcaaataatgctgtgaacacatgtctctcttgttttatttatttttttcttttcttttctttttctttttttttttttttttttgagacagagtttcactcttgtcaccaggctgcagtgcaatggcgcgatcttggctcaccacaatctctgcctcccgggctcaagcgattctgctgcctcagcctcctgagtagctgggattacaggtgtgcgccaccacgcccggctaatttttgtatttttagtagagacggggtttctccatgttggtcaggctggtctcgaactcctgacctcaggtgatccgcccgccttggcctcctaaagtgctgggattacaggcatgagccaccgcgcctggcctcttgttttatttttgacacagggtctcattctgtgctcaggctggagtgtgcagtgacgtgatcacagaaaggaaacctcagagcagagttgggtcttcacatacggtggccaggaaggccccctgaagaggtgaaacgttagcaaaggcctggaggaagtcaggacctctaagggatgcccagctgtgcagacatctacggggtgtctggggagggcaccgctgtgcaaaggccctggggcaggaccgcacctggcgaggcggaggagcgaggaggaggccagggtggctgccgcagggtgaggaggggagagcaggaggagggagggcggggctgacccagcaggtcgtgaagggccctgaggacacggagaggacacagggttttaccctgagcagggtgggagccacggaggcctctgctggagcagaggagggcacggcctgaattgggtttgaaggaatcgactgagggtaggaaggtgggggtagggaagcccgggggaggcgagcacaccagcccaggtgggcaccacggggcctgggctgggggctgctgtgggatggtcaggagtgggtgggttctgggcctgtcttgaaggcagaactcacaagattttctgagacgctgtggggtgaaggggagtgagaggaggggagggtcctggaagggcgggtgcaacctcaacccagcggaggaccctgctgacctgcttagttgtttatggagggtcattgccgtgctctaccacgtaacacacgtacacacacacacacaggtgcacgtttacaccacgtgggtgcgcacgatgaggcacacacaggcaggcgcgcacacacacgcgtgctcacataggaacacgaagaggcaggagccgggcgtgcccgagccccgtggcgccctgggcatcccaaacaccgcctgcccagaacaggtgcgcagtgagtgcctgctgagccagtgagtggaatgaagctctacaatagtccagatgacagacatgactgctgtggctgctgccgatccaagtcccaccgttcttttctctagagacaaggtctcactccaccatccaggctggcgcgatcacagctcactgacggtggagaagggtgatcagagaatggtgggaatgaggcggccctgacctcctggggttagcgatcctcccacctcagccccctaaagcaccgggagggcaggtgtgagccacggtgccagccccaagttcccgacattctttcctaaaacacatcctccggctgcagatgagggtgcgacagctgggaggcagctcccaggaggccgggttcctccgatgacctgctgtttctgtgtccctggcacacggcacagcaggagagggggaggccaggtgtttgtggctgctgccaccggcccgtccagggtcagctcatgctcccagcctccgtgatctgccactccccacttccctgaggctgctcactgctgtcctttgtccggcggccagccccctgactcagactcacgcgccctgctgctgcccgcccctttgttcccgggagactctaacaaggaaggcttgttcttcccgcaaggacacagagaacctgccagctcccctccatcctcatccagagagagcctgctgtccccgtgggacagtgaggacaggaccagctctcaggctctgctgggcacccagcccatgcctggcaagtcctcatgttacagacgaggacaccgaagctcagaggaaggaagggcttgtattccgaggatttggggggctggagaggggtcctagtgggctctgctgtagcctgcaaggtcctacaagcccaggtccttcctgccctctctggctgcgttggtccctccggactcagcctctgcactcaccgtacattctgcctgatacacccggtccaactccctccccctccaggaaggccttgctcaaatctctccacctccaggatcttccttggaccactgattgattgattgattttttgtttctgttgtttttctgagatggagtcttgctctatcacccaggctggagggtagtggcgcaatctcggctcactgcaacctccgcctggtgggttcaggcgattctcctgcctcagcctcccaagtagctgggattacaggcgcccgtcaccacacccagctaatttttgtcttttttaatagagatggggccgggagcggtggctcacgcctgtaatcccagcactttgggaggctgaggcgagcagatcacgagatcaggagatcgagaccatcctggctaatacagtgaaaccccgtctctactaaaaatacaaaaaattagccaggcgtggtggcaggcgcctgtagtcccagctacacaggaggctgaggcagaagaatgacgtgaacccgggaggcggagcttgtagtgagccgagattgtgccagtgcactccagcctgggcgacagagcaagactccatctcaaaaaaaagaaggaaagaaatagagatggggtttcaccatgttggccaggctggtctcaaactcctgacctcaagtgatccgcccacctcagcctcccaaagtgctgggattacaggtgtgaaccgccatgcccggcctatcgggaccacagatttgatcctgcaacctgcctatcatcatgctgcctgcccccttccctgccttttccttcttcccagcagcactctccacgcctcacctattgcagcggcggctggagctgctcatgccagctcctgagcccactgtgaagttcgcggcgatctgtgagctggttggctcatgttggcagccacgatgggagtatttacaacacagggggcggcgtgcgctgcaagtgagggccttttcccttggagagccagctgttcaacatttctccgcacagcaccacttcggtattatgcccgaggtttatggcataactagcctggctcatggtctctcttccctgctgctcactagaatgtaagctccttcgggccgaggtcagcccaccttgcactctgctgtctccttggcacttaaaacaacgcttggcatacagcaggcactcaataaagatgtgctggcagggcgcatgacgtgtgcctgtggtcccaacactttggaaggccgaggcgggaggattgcttgagctcaggaggcggaggttgcagtgagtggagatcgcaccactgcgctccagcctgggccacagagtgagaccctgtgtcaaaataataacaagcatgaggcaggggggatcagctgaggtcaggagttcgagaccagcctggccaacatggtgaaactctattaagggaggagaccatccctcatattgtcttatgcccaatttctgcctccaaagaaagaagtaaaaactaaaaggcagaaatgaaatccacaggcagacagcccggcgctgtgccctgggcctggtagttaaagagcgacccctgacctactgggttacgttatctatagattccagacattgtatggaaaagcactgtgaaaacccttgtcctgttctgttccgatctgattgccggtgcatgcagcccccagtcacgtaccccctgcttgttcaatcgatcacgaccctctcacgcggaccccctgagagttgtgagccctgaagagggacaggaattgctcactcggggagctcggctcttgggacaggagtcttgccgatggccccggccgaataaaccgcttccttctctaactgggtgtctgaggagttttgtctgcggctcttcctgctacactatctctactaaaaatacaaaaaaaaaaggccgggcttggtggctgaagcctgtaatcccagctcctcgggaggctgaggcgggcagatcacgaggtcaggagatcgagaccatcctggctaacacggtgaaaccccgtctctactaaaaatacaaacaattagccgggcgtggtggcaggcgcctgtagtcccagctactcgggaggctgaggcaggagaatggcgtgaacccgggaggcggagcttgcggtgagccgagatggcgccactgcactccagcctgggcgacagagcgagactccgtctcaaaaaaataacaagtaaatcagtgtggaactaacgagcgccctcgtccctcgcgctgctgggactgacgtccgggtacccccaacgcaaccacggcctcccggtgaccctgacccgcgaagcgggccggaagccccgcagcccctactccagaatccgcgtcccggaacctggatccccgaccgggccctgcggccccgacccccgcagcgagcccagcgccggggaacaggacccggcttcccagtctccgcccggggacaccaggctccttgggcgaacggccaggcctcccgggaccagcgcgctggaagactcgcggcggggacgccccctcggccgccccgtgccgggccccacgcaagggcagccggggcgccccgcagtgggaacgcgaggagaccgaccacggggcgagacagccgccagggcgtccgcgccgcccgccccaagcccgcatcagcccgccacgaactcggaggaccgcgggctagagcggccccgccagcgcgcaaagccttgtgggccacacgccccggcgccccgcgctccgcggcatggcgggagttgtggttcagctgcgggggccgcgcgggagctgccgggagctgtgggcggggtgggtgcgcgcgcagtggcagggccagtgagctgcacccgcggaaaaggagggggagcggctggtcagctgcgccctgcgggtcgagaatgtcatcagcagggatggcggcgctttgagtgctgagcgcggccccgaccgggaccccctacccttgacccaccctcgcaggccgagccccgactcccgacccgccgtcgcagcccgcggccccgacctctgacccgccctcgcagcccgcggccccgacctctgacccgccctcccagccagaccctctacgcccgacccgccctcgcagcccatggcccatcggcccggcagtggacgcagagcctcggccccgttccctccccggaccccccggacccgctctccgtcctccctgcagagccgagggccttggcccagccccgcatcctccccgaccgtgctcgatccagcccgggtgtgctgcacccgaaacaggctcccgggggccgtcgggcctgtgggtgaccgtgcaggccaggatctcccccttcccagtcgtgacaaccacagatggccccagatgccacgttagggttagtgcctcctgggggcgggattgcggccgggggagaaccaccctcccaacccgttaggaactgcagggacggagagcgcgctcgggatgtccagcactcagcgcgggttgggtggcgaatggagagcgagtcgtcctcagaggccgccggcctgcaggcgagaaccctcccagccaggaggctgcggctctgcctgaaccccgacccagggcgaacacccacatttggcccctgcccggtgctgagagaggccagagcggcgtccccagaagcggagcgggagccccacgtccggcggccacgatagaaagaagaaaagaaatgggtggtagtaagtaaaataaatcgtatgaaacataaaacaaggccgggcgcgttggctcacgcctgtaatcccagcactgtgggaggccgaggcaggtggatcacctgaggtcaggagtttgagaccagcctggccaacatggcaaaacctcgtctctactaaaaatacaaaaattagccgggcgtggtggcgcatgcctgtggtcccacctacttggaaggccgtcacagtagaatcacttgaacccgtgaggtggaggttgcagtgagccgagatagcaccactgtactccagcctgggcgacaagagtgaaactccagctaaaaaaaaaagaaagaaagaaacgtaaaacaaagatgtatctttatcttatttaatccactgtgtccaaaatactatcctttcgattcataagcaatacatgttgagatgctgtacactctttgttcacgctgagcgttcagagcccagtgtgtattttgcacatttgtgtccacttcctaattctcacaggaaatattcaacctgcacttcaggccactaaagttctagttggaaaagtggcttcacaaaccctagctgttgcacatgttttccaatagctgcgtccgtttctaagttgatattcgtgttagaaaggaggcttcagggccaggcgcggtggctgacacctgtaatccagcactttgggagcccaaggtgggcagatcacttgaggtggggagttcaagaccagcctgaccaacatggggaaaccccgtctctattaaaaatacaaaaattggccaggcgcggtggctcacgcctgtaatcccagcaccttgggaggccaaggcgggcggatcacctgaggtcaggcgtttgagactagcctgaccaatatggtgaaaccctgtctctactaaaaatgcaaaagttagctgggcgtggtggcaggcgcctgtagtcccagctactccggagtctgagacagaattgcttaaacctgggaggcagaggttgcagtgagctgagatcgtgccactgcactccagcctgggtgacagagtgaggctttgtctcaaaaaaaaaaaaaaagtctacaaatacaaaacttacctgagcatggtggcacgtgcctataatcccagctactcaggaggctcaggcgggagaatcgcttgaacccaggaggcggaggttgcagtgagccaagatctcaccactgcactccagcctgggcgacagagtgactccgtctcaaaaaaaaagaaggcttttaaagaaacagtttagtgccctttatggtgtttgcgacgtcgtgtaaacaccagctctctagtctcaaacccggcgagggcggttcatagacaatttcagtctctcgacgcgacgccgtgtggcttgtgcccttctagccacctagaccctcgggagaggcctgtgcggctcctggctgggcccccgtcttcaaagcagcttttgagtggccctttgacccgtgagacagggccgtggaagctggggtgagcctggagatgcccccgggagcaccaaggcgtcagagcagctgaccagggccccaggcctcgccgcttccccaggcagagccggccccaagccccgcctctcccctgggcggagccagccccaagcccccctcccctgggcggagacagccccaggccccgcctctcccctgggcggagccagccccaagccccccctcccctgggaggagacagccccaggcaccgcctctctcctgggcggagccagccccaagcccccccctcccctgggcggagacagccccaggcaccgcctctcccctgggcggagccagccccaagccccccctcccctgggaggagacagccccaggcaccgcctctcccctgggcggagccagccccaagccccccctcccctgggaggagacagccccaggcaccgcctctctcctgggcggagccagccccaagcccccccctcccctgggcggagacagccccaggcaccgcctctcccctgggcggagccagccccaagccccccctcccctgggaggagacagccccaggcaccgcctctcccctgggcggagccagccccaagccccgcctctcctctgggcggagccagccccaagcccccctcccctgggcggagccagccccaggccccgcctctccctgggcggagccagccccaagccccccctcccctgggcggagccagccccaagccggctctcaccatagtgtgcctcctgccccatggacccccatccccccagacccctcctgattagctcaggtggggctgccgtggagaccacaccagcatcatcgcctgaggctccatgtccaatttccccggggctgctggagactgagcactgccccagcccctcaccaggcggtcactgaccccagggaggcctgtcagctctgcccaggctcagcgacgtggtcagctcggccagcctgcggggagggactcgactcggacaagggttccttcagggacctgtgccaggtgggccacgaagatccttccttcctcctttttttttttttttttttttttttttgagacagtcttgctctgtcgcccaggctggagtgcaatggtgcgatctcggctcactgcaagctccgcctctccgggttcacgccattctcctgcctcagcctcctgagtagctggaactacaggcgcccgccaccacgcccggctaatttttttcgtatttttagtagagacggggtttcaccgtgttagccaggatggtctcgatctcctgacctcgtgatccgcccgcctcggcctcccaaagtgctcggattacaggcgcccgccaccacgcctggctaatcttttttgtatttttagtagagacggggtttcaccgtgttagccaggatggtctccatctcctgacctcgtgatccacccgcctgggcctcccaaagtgctgggattacaggcgtgagccaccgcgcccggtcgatccttcctccttaaacctgatgcgggagccaggcccacccccatcgtgggcttcatggctacaactccacacgtacacacgcacacacgcatgcacgcacacagacgcatgcacacacacacatgcatgcacatggctacttattgaaccccctcctgcagcctccatcaatctcattcctcccccactctccttgcgaccctcaggtctggggtccttggactgggttcaagccttgtccaacaaggaggccctgccgtgatgggggtcctcactccaaagaaaaagccatgaggaccccagaactgaccagtgggtgggagacaggagagctggcccagctgggtcaagaagggtctgtcagggcctggggcgtgctccgctcctggacaacggcgccctcacagccccttcccctcagggcaacacagtcatctggaacgctccctcggcagctgtggacagggaggccaggatgtggggtctggggctggtgggatggctgggaccctccatgggaaggggggcttcctggctgggaccctccatgggaagggggcttcctgacggaggccgccgaggacaatgccgggaaggggattgatgttgggggcggggtcgagtctcccaaggacaaaaaggaggtccccgttgccggcggaagatacggtgtaggccttcctgtgggactaggactcagacccaggggtctcagggtcctccccggccctcaggctgctggcccacctcggtctctccatccctctgcctctgcctctctgtgtctctgtctctgtctccctgtgtctctctgccttctctcttcctcgctctgtctctgtctctctgtgtctctatctccctgtgtctctctgccttgtctctcttccttgatctgtctctccctctctgtgtctctgtctccctatgtctctcttcctcactctgtctctgtctctctgtgtctctgtctctctctctctgtctctgtgtctccctcacccccgccttccccacctctggccgttgaaacctgcgggtccctctgcctctgggaaccctccctcctccttcctgtgtccatcccacctgccctgtcctcagggggaccccagctttgttgtctccccgcccccacaagcctgtggatgtgagggctcggcacacggggactgtgagcagcgtgatcaccacgcgtgacccagcgggcgggcgggggacagggccctggagagctgggacacaccctgcaaggggcctcagccctcctggcgcccagtggtccctccccacctgcaggaagtagggtcgggggctgggaaacagcccattcaccaggcctgctgccccccgcccgggttaagggcccagcttcccgggaagggcctgcacctccggcctggggagggcccctcctcggagtctgctttccggtgaggcctttcccggcaccagcctgggcaggagggggatgggacccagggagacagggctgtgagctcacacacctgggccctcacctctgaggggactgtttccccaccccgggcctcagtttccctcctctaggcctcagtttctctcctttgcacccagcccctcctctaggcctcagtttccctcctcagcacccagcccctcccccgagcctcattttgcctcctctgcacccagcccctcccctaggcctcagtttccctcctttgcacccaggccctgccctggatctcagtttccctcctctggtcccagccccacccctgggcctcagtttccctcctctgatcccagcccctcctctgggcctcagtttccctcctctggtcccagccccgcccctgggcctcagtttccctcctctgatcccagcccctcctctgggcctcagttttcctcctctggtcccagccccgcccctgggcctcagtttccctcctctggtcccagccctgcccctgggcctcagtttccctcctctgacaggtaagccgattggcaatgcttggaaccccatggactggctgctgctttttattccatggccagggaaactgaggcacagacagaccctgaggtcagcaggaatgctccatcattttattcccgcgtgcctgcggtgcatggggtccagggtcacaggaccggcccctgggtggaggggagccagccatcacgactgccaccacaggccctcattgagctaggagcagagcaccctgggaaccacagcggaggagggtggggggcgagggggtgagggggtgggcagaacctgggtaaggtgaggagcagcccgggcagagtcccagaggccctgggagggtcccggtgatgcaggggggtaaacaagccaccagcggagacagaaccagtgtgcggggcttggaggaacaggtgggtggattccagtgcgtttggaagatgaggttcccaggactcgctgatggcagctgtgagtgggagtccagccagcatcccttccagatccctcttgtggaccgagatccaggtctcagtgtagaccaaggaacagaggcagcccctactcgggctcccaggctccagccaggcctgctaggtgggcggcctctgcccgtgtgatggaaggaagccaggctcagagatggggtgacttgtcccacgtcctggagggtctcacagctccaccacggccaggagacttcagtccagggggcctccatccccagcgaccttcacctgacccccaggggaccccagccaacaagacccggcctgcagctccggaacgggggagggctgctctccaccgcccctgtgcggccgcccgggaaagtgcaggcgggccgggcgcggtggctcacgcctgtgatctcagcactttgggaggccgaggtgggcggatcacctgaggtcgggagttcgaggccagcctgcccaacatggagaaaccctgtctctactaaagatacaaaattagccaggcgtggtgacgcatgcctgtaatcccagctactggagtggctgaggcaggagaatcgcttgagcccgggagacagaggttgcggtgagctgagatcgcaccattgcactccagcctgggcaacaagagcgaaactcagaaaaaaaagaaaagaaagtgcaggggacccgccgtcggggtgggggcggcgctgcccagcctctgtcccacttccatgcacttgacctcgaccctccggcctccgtctgcgatcttcccgtgcctgaatatgaggcttggaacagacccagaccttcctgcctgcccgtcctgagtggccccgggaccccgccccatctttggcccccagcccctgcctctctgccgcctccagggtcgggggtcaggccaggaaagccccttgggaagcccccggggagcagctggagcggggtcgccgggcggcgggaaggagtgggcgcctctatttaagcggcttccccgcggcctcgggacagaggggactgagcatggatttcggactggccctcctgctggcggggcttctggggctcctcctcggtgagaaggggagggggcgcgggagagaggagtgagttaggagggggctcaggagagaggagggggctcaggagaggggagggggctcaggagagaggagagggcccgggagagaggagggggcccaggagaggggagggggctcagtagagtgggggggctcaggagagaggagggacgcaggagagaggaggggcgcaggagagaggagggggctcaggagagtggagggggctcaggagagaggaggggcgcaggagagaggagggggcgcgggagagaggagggggcgcggaggggagggggcgcaggagagaggagggggcgcaggagagtggagggggcgcgggagagaggagggggcgcgggagaggggagggggctcgggggagaggaaggggcgcggtgagcggggaggggacgcgggagagaggagggagttaggagggggctcaggagaggggagggggctcagtagagtgggggggctcaggagagaggagggacgcaggagagaggaggggcgcaggggagaggagggggcgcaggagagtggagggggctcaggagagagaaggggctcaggagagagaaggggcgcaggagagaggaggggcgcggaggggagggggcgcaggagagagcagggggcgcagtaaagtgaagaggactcaggagagaggagggggcgcgggagaggggagggggtttggaagagaaggggggctcgggagaggggagggggctcgggagaggggagggggttcggaagagaaggggggcccgggagaggggagggggcccgggggagaggaaggggcgcggtgagcggggaggggacgcgggagagaggagggagttaagagggggcgcaggagagaggaggggctcggagggggcgcgggagagacgaggggtgctcagagttaaggggctccgagatagggggtgattggtgatcctgccagaggagggggctcggaggaggcaggggctgagaggggaagttgcggggctccgcgcggccccctgacccgcagcgaaactggctccaggcagctggggttcgggggactggggcagaggcggcggtcggggcggggttcagggaccgagcctgggagtccgggtagcggcggggcaggggtccgggggtgcagcggagggtccgggaaccgggcagaggcggggcggggtccgggggtggagcgggacgcagggccggtggcggggcggggtccgggactccgcggggctgagcgagagccgcggtcgccgcaggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacggtgaggcgtccccccgcgccctgcctctctgacccttggactcccggctccttccctatgccacctcttcctggaagcctcccagattgcaggcagggtcccagctccatgcacagctccccgaagccaggtccccggccttcgcttccctccaactcaccccaactctcccagggccggccctggcccatcctcctgtctattccagcctcccagggtggggccacggggcctgcgcacaggccgtccctactgcctgttcatcagcagcccccacgcatccttggccccagctccaagcccctccgggctccggcccctccatcacgtccagccctgactctgggctcagccctcacccccgaccctccatcacagccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccggtgagtccgctgggtgccctggagacccacccgctcgccagccttgacaagcacttcgggacggggtgggggggtgggggggcagcacctgtgctgtggggcgctgggaggactggattcccccacgcagcgacagcgacattcatcgacgcaacatgtatttgccgagcacctgccccccagcacaggtcccacccctcccctgcccacagcgctccatggctcttgccttggggtcaaagcccaagtcctcccgggggcccacaggaacctgcacgacctaccctgtccccttcctgtcctccctccaccctttctccccctcctcattctgctgcagccacacgggcctcctcgcctcctcgctgttcctccaacacaccaggcgtgatcctgccccggggcctttgcacggctgtgccctctgccgggaatacccttcttccggatctttccacggctctctcctcctccccctcaggtctctgtagaatgttgcctcctccgtgaggcttccctggattcccgtttaaagggtcaacccctgatccccaacgtgtacaaacataggcacacaagcacacacatgtacaaacacagacacacacacgcgtgcacacaggcacacacgcacacgcgtgtacaaacaggcacacaagcacacacgggaacaaacgcacacacccacacgcgtgtacaaacacaggcacacaggcacacgcgtgtacaaacacgcacacgcgtgtgagccccctttcccttctgtttcgtttcttgacaccttggataacatctgacatcccccagtcccgtacattctcttttccatgaccttctcccactgtggctccccaggtgggaatcttgtgtcgcgcacggctgtgtccacagaagctagaacagggcctggggcatagcaggtgctcaataaacccttgctgaatgctcggatgaagacatttaatgtgggccggtgccctggcggtgctcccttcacgctctgtccaatcccgaagcccctgccggcttctcccactaaagaaaaagggatttgtcctcccatggggcaccctgatacccatgttaatggacgtgaggtcgtgagtttcaagcaaagggctcccggggataaagcagaagctgggagacccgggaggtctttgtggtgggggtggggctggggtgggcagagaggaggctggatttgagggatattttacagaacacgggccctcacgggcctcagtctccccatcagtcccacaggggatggagcagaaggccagggcagaaagcccccaagcaccttctctctccacgccagcctcctcccaactctcctcgtccacagcccatcataataaacgcgggacccactcgctctcagggcagcccaaagaggtgactctcacccctttgacagttgaggaaactgaggcacgtggagattaaggaggctgctggggtgatgttgccagtgagtgggggacctggaatgcccggactcccatcctgcccactgtggtgcctcagcttcctcatctgtccagtggacttccctgactgtgggtcctttgtaaatttcagggaccatgtggatttcaaagcactttataaattataggctttaggccgggctcacgcctgtaatcccagcactttgggaggctgaggtgggtggattacctgaggtcaggagttcaagaccagcctggccaacatagtgaaaccccatctctattaaaaatacaaaaattagatgtggccaggtgcggtggctcatgcttgtaatcccagcactttgggaagctgaggtgggtggatcacgagattaggagatcgagactagcctgaccaacatggtgaaaccccgtcccctactaaaaatacaaatattagcctggcgtggtggtgagcgcctgtaattccagctactcaggaggctgaggcgggagaatcgcttgaacccgggaggcggaggttgcagtgagccgagatcgcaccattgcactccagcctgggcaacagaacgagactccatctcaacaacaacaacaaattctaggctttatcaactagaacagtaagccgaatagaaacaaaaatgtaggccagccatgggaggctgaggcgggaggatcacttgagtacaggagttccagaccagcttgggcaacatacgagacctcccatctctacaaaaaaatttaaaaattagctgggcgtggtattgcacacctgtggtcccagctactcaggaggctgagtggggaggatggcttcagcctgggaggttgaggctgcagtgatccatgatcacaacactgcactccagcctgcacgacagagtgagaccccatctctaaaaaaaaaaaccaggccgggcgtggtggctcacgcctgtaatcccagcactttgggaggccgaggtgggtagatcacctgaggttgggagttcaaggccagcctgaccaacatggagaaaccccatctctactaaaaatacaaaattagccaggtgtggtggcaagcgcctgtgatcccagctactccagaggctgaggcaggggaatcgcttgaacctgaggagcggaggttgtggtgagccaagattgcgccactgcactccagcctgggtaacaagagcaaaactctgtctcaaaaaaaaaaaaaaaaaaaaaaaaaaaaaaaagaataaatggaaatgtgactcaccagagtggtccagggaaggggcttggaggggttctggtccaagcccttcatccagatgcggagattgaggcaggagaggcaagcctggggcagcagagaggaaaaaaaaaccctcactctgtttccagtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctgtgagttctggtccctgggggcagggagggtgggaagggctgagagcgagaggttccttggatgaagactttagacaagaaattgccctgcccagccttggtttccccgtctgcccagcctcagtttccccgtctgcccagcctcggtttccccatctgcccagcctcggtttccccgtctttccagcctcggtttccccatctgcccagcctcagtttccttgtctgtccagtgggcttctcttaactgtgggtcctttttgtaaacatcagggactgtgtagatgtcaaggcacttggtaaattctaagccttgtagactagaagaatctttggaatagaagcagaaacaatgcggccacataggtaatttctttcctttttttttgtgagacagagtctcgctctgtcccccaggctggagtgcagtggtgcaacctcgactcattgcaacctccgcctcctgggttcaagcgattctcctgcctcagcctcctgagttgctgggattacaggcacccatcaccactcccggctaatttttgtatttttagtagagatgcggtttcaccatgttgaccacgctggtctccaactcctgacctgaggtgatctgcccgcctcggcctcccaaagtgctgggattacaggtgtgagccactgcacccggcccacataggtaatgttagaaatgcttgtcccccagtgccacaaagaaatagcactcaaacaaatttaattctctcagcaaggccacttttactttctgcagaaagggtgctcattgtagacggaacaatggcgagagcacagctgaacaaaggaaaagcagacatatttatccctcacacatttgggtcgcccttactgctgtgtcctgcatccactggctggagcaggatatcacactcttaaactgatacccagtttgctaacaacctaaaactttcctaagtaggtaagcgcaaaggaggacaaacaaggagaggaagttgcttacgaaagatttgaggaagcagtaacatttccaaataaggaaggggcataagctatgagctaagacttccctgggactctccagatatgcctgggtaagcccaagcaactaactgggctaaagtgtaagaactaatagctgataggaggctttagagtaagaagctattatttctagtgtctatgtctattattttatttgtaaatcaagacgagctttgaagaggaacttttctacttcctacaggtaatttcaaatttaaaagtaaaggcaaggcatgaacccgggaggtagagcttgcagtgagccgagatcgcgccactgcactccagcctggggcacagagcgagactccatctcaaaaaaaaaaatgggccgggcacggtggcttatgcctgtaatccctgcactttgggaggccaaggcgggcggatcacgaggtcaggagatcgagaccatcctggctaacacggtgaaaccccgtctccactaaaaatacaaaaaattagccgggcgtggcagcgggcgcctgtagtcccagctactcgggaggctgaggcaggagaatggcgtgaacctgggaggcggagcctgcagtgagccgagatcgcgccactgcactccaacctgggagacagcaagactccgtctcaaaaaaaaaaaaaaaattaaaagtaaaaataatgtggtcgggccaagcatggtagctcatgcctgtaatgccagcactttgggaggccgaggcaggaggatcacttgagcccaggaggttgaggctgcagtgagctgagatcacacctgggtgacagagcaagactcagtctcaaaaaaaaaagtgttggccagacacggtggctcatgcctataatcctagcactttgggaggccaaggaggaggatcacctgaggtcaggagttcgagaccagcctggccaacatggtgaaacctcatctctactaaaaatacaaaaattagccaggtgtggtggcatgtgcctgtaatcccagctgaggattactcgggaggctgaagcaggagaatcacttgaacccgggaggcggaagtggcagtgagctaagatcacgccattgcactccagcctgggggacagagcaagattccatttcgaaaaaaaaaaaaaagtgtggtcatacatttcgcagagcccaatatatcccaagcattatcatttcaacaggtaatcaatataaaatagtatgaaggagatatattacattcctcccttttccccagactaagtcttcaaagtgcagattgtaggctcagcacccttcatggtggtgagccgtcctctctccggtctgcccttttttttttttttttttttttttgagagacagagtctcattctgtcacccaggctggagtgcagtggtgcgatctcagcttactgcaacctccacctcccgggttcaagtgattctcctgcctcagcctcccaagtagctgggattacaggcgcctgccaccatgtccagctaactttgtatttttagtaggcacagggtttcaccatggtcaggctggtctcgaactcctgacctcgtgatccacccgctttggcctcccgaagtgctgggatttcaggcgtgagccaccccgcctggcctggactgcccatttctaaactctaaggtgctatgcgcatttcaaaagggtcatggtaaagtcctttgtgaaatttcagggaacgtggtaactttggaagcacgtgtagcctctgaggggctcctcccttcccaagcctgcagaggcctggagggctctgaccggggtctcctgcactctctccccagcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatacaaacgtgtcagttttctcagttgacacccactccgtggagaggagaggtctgagggctccggacagcagagggttgactgtgggtcctgccctgatggctccatctccctcatcccacagtccggggctggagaagaaagtgttagaaatgcttgttccccggtgccgtaaagaaatagcacttgaatataaatgtcatttcctcagcaaggccactgttttactttctgcagaaagggtacactggccagcagttttgccacgagagtatccagaacaaaggagacagggtcatttataacctgacgcgtccaccctactgctctgtccggtttccattggctggaacgggacggtttccattggctggaacgggacctcacattctgtatttatcccgatcggctagcagcttggaacttttaaaaagaggcaaaggcagaggagaacaaaggaaggaagaagtagcttgtggaatgctaagaaaggtaaaaacaccttcaaataaggaagaggaacaggttatgacctaatgcttgcttggaccagtataagcatgccagggcagatatttagcctacattgtgggcactaagaacataaagtatgttgatttccttattacattatatatattcaatataacattaacaattaattaacaaagaatgttagcacaggtcttttgtttgtttgttttttgagacagagtctcgctctgtcgcccaggctggagtgcagtggcgcgatctcggctcacttgcaagctccgcctcccgggttcacgccattctcctgcctcagcctcccgagtagctgggactacaggcgcccgccaccacgcctggctaattttttgtatttttagtagagacggggtttcaccgtgttagccgggatggtctcgatctcctgacctcgtgatccgcccgcctcggcctcccaaagtgctgggatgacaggcgtgagccaccgcgcccggcctaccacaggcctttgaatacattttgcttctaagagaagttactatttattcctaattagatggggaggaaagtctcatttgaagaggaacctctacttcacgttttacaaagggcatttggtctgcccgccagagattcctgtgctgggaggatggtggaacggtcccccggcaaacagctctcattgccccctgcccggggcaacgcccctgagggacggggacggcacccagcaagctctgcccggggcggggaaacgcgagggcttagtggtttcctcggtgagaagcttaaccaggagtccccgaaagcagtgagggaagatccacagaggtcgcctggggaaacacacccagaggcggcttatggaggagactgcttgtgttttgaggtggctgcgggctgcggagggttgggagggccgggagggcggccggaagcgaggtcaggcgatgaaggcctggaggtgccagcccgggggccctggagagccatggcagagtttacagctctggaggctgcggtgtcagaaagctccctctggcggtcagggggtaacagcgcgggatgctcgcccgtgtggccgccaataggggctcagcgcagctgcagcggagctggggagggggcttctcccacgaggtgagctacgcactcagacgttgactgagttaggcggaaggccaggctgagctcgacccccagcaccaaggctcagagatgaacatgagaaaagggtctgggggccgggcgcggggctgggtccagcagtcctgggcaggtccagccccgcgcatgctccgtcaggcttctctgctaaccagggagactggttgctaggagaccatgctaatgaaggactcgctcactacccaaatggcaagcaatccggctttgtgccagaaacgaagcacttccgaggcagccattttggagtctggcaaaattcaggaccgaggccaaagccaggagagccaatcaatatacacaaagagggaggagaagagagagtgccaataaggacacaaggaaagtggtagcgtacccttgtcacttcccaaagtctcccagcgggataccggtgccctctgcccttaatcaagatggccgccttgggggggctctagcgcacagtggaatatggcggtgcttccggtcccgctgccctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagaggtgcgcagtgggccggcttgggcgggtggggcagcgatggacttcaactcccagcatgccgcgcgcggctccctacccgcagcgccggcgcaggggcccggggcttgctgggagttgtagtgcgcgatgccttcttgggtgggatggatcggacaaggtgggctggagggtccgggcttcggtccggcgctaggcagcgcgctgcatgcggcgcgagtccttctggccggcttcgccttctgtgatgcctttttgcaggtgctgagtttccccttgcagttcatgattttcaaaatcgtgcagctcaagaggacttggcccgaggtcgcagagccagcccccgagccaggtcctcctagtcgcctccttagcagcctcatgttatccccgtccattcagccagaacgtgaatatttacagagagcagcgcagtcacccagggcccccatcttaggggacaggctcccagcgggcaggtggggattcctggaagagcctggcgatgtgcgggcgggttgcagggaagaggcccagcaggtgcaaatttagaccccgagtgtggggcacacgggaggcgggaaagccacggaatttggctgaagcatgcgaggctgcaggtgcctacgcgcggtgtcccctggctggggccagttctgagcccagggaaggtggttggggactatctgttggcgttggggatggatgggctgatgtcttttgttggggggggggtccccagaagcggagcctgaggtaggcattgtgtgtgcaggtgattttacaagggggtgcgcccaagagaacccaggaagggggtgggaagagcaggcagggaaggatgccaagcaaaggtgccctttcagcctcataaccagggcataagcgcccaccatggcagccctcgccagagtcccagagaagttcggggggagaagagagatggggagtgtcccccctaccacgttcagggtgcacaggtgtccaagatcatactcagataagggtggcagggtgttgggtacctggacaaggagcagacttgctccggtggcccagtggctctgaaggccccgcccgatgatttgctggagccaggtgggaggggagcgggcaagggcaggcccagagggtcagtggagccgtttactgcgatggaaggcccctggtttgaagaagctgccagagccacttgcggattaagttggaggctgggaggagcctggagacaggaaggtagaaagaagcgtctgcaactgacgtggggccaggacagaagactgaactggaggggtcctgaagtcttcaggagagatgagaagagctcaggaccccactctgagggcacctagcccagagagcccaccagagagggtgagaacgtgagaccagaggtgaacggggagcaggaggaagatggcctcccaggacatccggaagagaatctcccaaggaggaaaaggggtcaacagcaggcccaccacgtatggttgttcaggttgagcactgcacaagccactcaccccgtagacactgcagatgaggatatttatatttatattaatttccgagggctgctggaacaaattacctccaacttagtggcttaaaacaacagaaatttattctctcacagttctggagggcagaagtctgaaatcggagtgtcaggaggaccacactccctctggaggctccagggaaggagccttccttgcctccccagcctccagtggcggccagcagtctttggcttgtggccacattgctgcagtctctgcctccgtcgtcacgtggcctcctgtgtgtctctgttctgtgttccctcataaggacaccactaggccccaccctactccagtgtgacctcaaccgcctacatctgcaaagctgctgtctcaaataagctctcagtctgaggttctggatgggcgtgagtttggtgggcaccagtcaccccaggacaggagtggagccattggctggaagagttctcatagcagggactcagggcaagggtggtgctggtggcagatgcatcccggccctgggctcgcctgggctccccagagacacagccagtggggaatgcagaagacaggtgcacagacctgcgtggcatctgattctgtgctcatggagccaggcctgctcccgtcctcccagcaggcagctccggccgcccctccatccttggaccgtcaggaacccctgaggtcacctgaccagtcaggaagagaagcccagagcagccgggcgcggtggctcacgcctgtcatcccagcactttgggaggccgaggcgggcggatcacaaggtcaggagatcgagaccatcctggctaacacggtgaaaccccgtctctactaaaaatacaaaaaattagccgggtgtggtggcgggcgcctgtagtcccagctactcgggaggctgaggcaggagaatggcatgaacccaggaggcggagcttgcattgagccgagatcgcgccactgcactccagcctgggcgacagagcgagactctgtctcaaaaaaaaaaaaagagaagctcagagcctggcagatttgtccccactcagtccagtgtgttgacccccaaaggctgaggggctgactggggctgctcctgagagcatcaccgtggtaggctgggggagaagtcaccccagatcctccctggcaccttcttttgagaaatggcaagctccggccgccagggctggtgatggcagccacagtgtccccctcctgccaccttcctggtcgtctccaaggccccctggagcacacacacagacgttacatgacttgctgaaggccacacggccaccgagggcagagctggggtcagagagccccagagtgcagccccggaggcctcctcagccaccacgttgctcatcctggcagcaagggctgcactgccccctgcaggtcactgccaggaaaacgtgcacgaaaacgaagccccagctgatctgggccagggttcccccgactcgtcctctgggggccgtcctgggtactgcagggccctgagcagcgtccctggcctccacccactccttgccaggagctccccgagtcgtgacaaccacagatgtcccagacaccgcccggcgtctgctgggggcaggagtgggaagcagaagtctaaggtgtagggtggctcctgtctctttctggagacgttccataaatagaatctttcctgtattaacaaatgctcacacgccttacaaaccgctctgtgtaggagccgacacagacggagccctggctgggctcccgctttccattttgcaatcagggaaaccaaggcccagaggccaccgtcacaggcagagctgacgttccagccccggcctcctcctccgagcccagagcttgctgccttcctcttcctcctcctccctcacccgatgattctgctgggagccgcccgggagcccaggaggggcgggtatgcggccgccttgaagtgggctgtcaccttcctgtctcctgccgtcatcatggctgtgatctcaccaggctgtaattacctctttgtgtgtcttcctgcccctcaaggcagctgtggctgagctgcagccctaattacagcccaaaataagcaggtggggcctcccacacgtatgccagctgctgtcctgagcacctggctccagccccgttctcccgtcctcacaagaacccccactccgtagatgcacaaggccaggtgcagaaaaggagagtgcacacagctgggaggggcagacgaacacccgaggcaggcctgggccaggcacagagccctgcacaccgaggggccgcgtggatgcttgcggagctggaccagggctgccgcccccagagaggagagcatttatgcagaagtggtggtggatggcgctgggtaatcccggcccacagacctgtcagtcagaagctgcgagcacgacaggaaccaacaaccccaaacctcagtggcttcaacacaagcaaaactcttctcgcttactctgcaggggacgtccagttgtttttttgttgttttttttgagatggagtctggttctgtcacccaggctggagtgcagtggcgcgatctcggctcactacaagttccgcctcctgggttgacgccattctcctgcctcagcctcccgagtagctgggactacaggcgcccccaccacacccggctaatttttgtatttttagtagagacggggtttcaccatgttggccaggctggtcttgaactcctgacctcaagtgatccacccgcctcggcctcccaaagtgctgggattacaggcataagccactgtgcctggcccagttttctttttgagccagggtcttgctgtcacgcagcctgcagtgcagtggtgcaatcccagctcactgcagcctcgaccgcctgggctcaagggatcctcccacctcagcctcccaagtacccgggaccacagacgcacgtcaccacacctggctgatttttaaatttttgtagagacaggatctcactatgttgcccaggctggtttcgaactcctggactcaagcaatcctcctgcctcggcctcccaaagtgctgggctcacaggcaggagccacggcacccccacccaccccccaccaagggcttgtctgatcttgacacgcacctgcaatcatgaccacagagaagtggactgagaagtagcacgatggctcttaacattcccgctgaaagtgggccacgccccctcgcacgtttcagggggcaaagcaaggcccagaggctcaccctcggcggggtggagaagtggcgggtggagaagtggcggagggatccgcggagcagcgctgccgtcgccagccttcgagatgcccctgcaagcctcggctcccggggttcacggcctggtgccgtcccttccccctgcacagccggaacgggactgcagaagcaacggacagagtgtggcctccgaggcgggtcacgaaggacatcgtggtgtccccctccctcctgggtgggttgctggctcggctgggcagccgccatgcggtggggtcgctcgcgcagctcccagggagcacctgcagccgctgccaagagccgcgcgggttcccctgcgggggactgggccgcctcgcgtcgagccccgggggagtgtggccacggcaacctcctaagagaccccaagccagagcctcgcagcaaagccgccgccgagacgctgtgtcaatagtaaatgcttgttggttttgggcctctaggtttggggtgtgatctgtgaggcggcagcagcctgcccggcctcacagcagatcctgatgagaggggccccggtgcggctcctgctgggtcatgcggagaggtcaggcgtgatgggagctcgggccgccgcgctgacactgcgactgcccccagcgcattttggggatgacctcatggatggtaaaagcgcccagcggattataagggccaacaaatggggcctttactacttgggagggaaaaggagcgtacagccagatgggcctagagttgaattgcaggtcgctgccctcctgcctctgggcctcagtttcctcctccatagcagagctttgaccctcgagctcgctgagatggcacgtccatccctaagccctgaactgagcagcagtgatgaccagggaggcacgtgttcaccaggcacccaccgtgcaccggcccagcattactgagcacctactgtgcacccgcccagcatttactgagcacctactgcatgccggccctgcattactgaacacctactgcacaccagcccagcattactgagcacctactgcatactggccctgcattactgagtacctactgcacaccagcccagcattactgagtacctactgcacaccagcccagcattactgagtacctactgcacaccagcccagcattactgagtacctactgcacaccagccccacatttactgagcacctactgcacactggccccacatttactgagcacctattgcatcctggcccagcatttagtgagcacccactgcacacaaccccagcattactgagcacctactgtgcactagtcctgcattactgagcacctgctgcacaccaacctgccccggccccacatttactgagcacctattgcatgctggcccagcatttactgagcacccactgtacacagacccagcattactgagcacccactgcacactggccccacatttgctgagcacctactatgtaccagccctgcattcactaagcacctactgtacaccagccctgtattactgagcacccactgcacactgaccctacatttactgagcacctattgcatgctggcccagcatttacttcactcccactgcacaccgccccagcattactgagtacctaccgtgtactggccctgcattcactgagcacctactctacaccggccctgtattactgagcacccactgcacaccgaccccacgtttactaagcacctattgcttactggcccagcatttactgagcacccactgcacaccgccccagcattactgagtacctattgcacaccagccccacatttactgagcacctattgcattctggcccagcatcactgagcacctactgtgtaccagccctgcattactgagcacctgctgcacaccaaccctgcatttactgagcacctactgcatgctggcttagcacttccccggcacctaccacaggtggcccacagaaaggtgaagtcgtgtgcccaggtcatgccggagggaaggctgccctcctcaccatgaagctgagctcccagaagggaaaagcgtaagccctgaggttggccacttcctctctgggacccttggccagaccatggggctgccctgagcctcagtttccctatatgtcccagaggaagtaacaggccactagcatgaggcctggccgggaactgatggggggagtgaggccagggggttaagcagcccacccagggtcctgcagcggcccccacgctggccacggtgctccctggccactccctggtgccctccacgggagtgtgtgtcacactaccagcacacgagtggcacgtagtaaggcctcaggctcctcactggggcagggaatcgaacccaccccagagccggcagcagggctgacagccttcttctgtaaggggccagatagtgaacatttcagctttgcgtggcagcctccatcctgacattcagctctacggttctggtcggaagctgccacaggccacatgtcagcggactgatgtggttatgttccgataaagctttatttacaaaagcaggcagcaggtcgtatttgaccctcaggctgactgtggggccttgcctgtgggattgtggggagagaaataccaccactggccccgagcagcaactgtcacctgtaatcccagcagtttgggaggctgaggcaggaggatcgcttgagcccaggaggtggaggctgctgtgagccctgattgtaccactgctctccagcctgcacaacacagtgagaccctgtctcaaaaaaaaaaaaaaaagaaaaaatgcaatgtcagctgtgttaaatgttcagcacagactgggcgcagtggctcacacctgtaatcccagcactttgggaggccgaggtgggcggaccacgaggtcactcgagatccagaccatcctggccgacatggtgaaaccccgtctctactaaaaatacaaaaattagctgggtgtggtaacacacgcctgtaatcccagcagctcaggaggctgaggcaggagaatcgcttgaacccgggaggtggaggttgctgtgagctgagattgtgccactgcactccagcctgacaacagagtgagacactgtctcaaaaaaagaaagagggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcatagtggcggacgcctgtagtcccagctacttgggaggctgaggcaggagaatggcgtgaacccgggaggcggagcttgcagtgagccgagatcccgccactgcactccagcccgggcgacagagcgagactccgtctcaaaaaaaaaaaaaaaaggaagaaagaaagaaagaaaagaaaaaaacaaatgtcagttgtgttaaatgttgggcacagtatttggccacatgtaaacaggcgctgctgctgcagggagggagaccagagggtcctggtgttgtgggacaaagagtggagagaccgaaaaaggttcaggagagtttatcaaggtgatcaccggctcagctggacatacatccagaaagtctgagcctcgaacaaagggcttttcctatttttaaacatcgtaaggcgggaactacgtgaggcgggaagcaagttacagaggcgagaaacaaaggcagttaagcattacagcatttcttttttctttttcttttttttttttttgagacggagtctcgctctgtcgcccaggctggagtgcagtggcgccatcttggctcaccgcaacctccacctcccaggttcaagcgattctcctgcctcagactcccgagtagctgggactacagacgtgtaccaccacgtcccgctaatttttgtatttttagtagagatggggtttcaccatgttggccaggatggcctcaatctcttgaccttgtgatcctcccacctcggcctcccaaagtgctgggattacaggcgtgagccaccgtgcctggccaacatttctcacatcttgagaaaaacatgtcttacaacctaaacttatcggttttgtgaccctgcagccgtgctagggaggtaagcaggaactcgctgggcctgtaataaactgaggaatgtggagttggagagtatagataaggtccactgactacagagagaagacaggctgttaacattctcttttaacttgagtgtaagggtgggggtcacactttgcagcaactttaagaggattttaaaatttctatgactactactattaggttagagctgatttcactaattccttcttcactggggccagatgccccagacagatgcctgccgttgattcaagacatttactgagcacctactgtgggcagggcagtgttctgggcaccagggctataaccaagacgaacttccggccctggagggcaggtgctcacactggtgggagacatgaagctcacagggatgtgggacagcgagtgagacaggatgaccactaggaagaaaacaggaggaaaggagttaggggtcaggggaggcgacatttgaggagagacctggaggagaccagggaggaggtgagggagatctgggggaaggcagtgtcacggcccttgcagaggccctgaggccggtccagttggagctgggaagccagggctggatgggagctgcggggaggagaggcctgagctgggtggaggctgggaggggggaggccaggctgggtgggggctgggaggggggaggccaggctgggtgggggctggccaggctgggtgggggctgggaggatggaggccaggatgggtgggggctggaaggggggaggcccaggctggggggtgctgggaggacggaggccaggctgggtgggggctgggaggggggaggccaggatgggtgggggctgggaggagggaggccaggctgggtgggggctagaaggggggagacccaggctggggggtgctgggaggacggaggccaggctgggtgggggctgggaggggggaggccaggctggggggtgctgggaggaggaggccgaggctgggtaggggctgggacgggggaggccaggctgggtggaggcggggatgagggagacccaggttgggaggaggaggccgaggctgggggtgctggtggggaggggaggcccgggctgggcggtgctgggaggagggaggccaggctgggtgggggctgggaggaggaggcccaggctgggtagaggctgggaggagggagatccaggttgggaggaggcccaggctgggtagaggctgggaggagggagatccaggttgggaggaggccgaggctgggggtgctggtggggaggggaggcccaggctgagggggtgctgggaggaggaaggcctggctgggtgggtgctgggaggagggagccccgggctggggggtgctgggaggaaggaggccaggctgggtgggagctgggaggagggaggcccaggctgggagtgctggtggggtggggaggggaggcccaggttgagtaggggctgggaagagggaggccccggctgggtaggggctgggaggagggaggccaggctgggtgggagctgggaggaggggaggtccaggctgggtaggggctgggaggagggaggcccaggctgggagtgctggtggggtggggaggggaggcccaggttgagtaggggctgggaagagggaggcccgggctgggtaggggctgggaggagggaggcctgggcttgggatactggggggaggagaggccagggctgggagggggctgagaggaggaggcctgggctggagatgctgggggaggagaggcccaggctggggatgcttgggggagggaggcctgggctgggaggggactgggaggagggaggcctgggctggggatgctggggggaggagaggcccgggctggggatgcttgggggaggagaggcccgggctggggatgctgcggggaggagaggccctagctgggagaagggaggcgggggctcaagagaggagcttcagggatagagggtgaggaggaggggaggccggggatggggggtaggaggagaggggaggccagggctggctggggggtcggggaggctagggcataggcctggcgaggaggggaggctggggctgggtgggcgcgcggtctctgccggcccccaacgtccccgtctccgcagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggggcccgacagcctggcgctggcgctggaccgcgccgtcggggggcggcggcccagcgcgcccatgacccgcgaggagtttctggagagggccgccgcgctcttcatcgcgaaggtcaagccggtgggctgaggcccgtgggccgcgcggatccgggatctgcgctggggggtccccgcgtgcggggcgcgcggagccttcccttcgccctggtgaggccctgccataaccaggcgcccagccctgcggaggaggccggggctcccaggaagcggacgcccggtccccacacagcgccgcggccgcccctccacccccgcgggagcccctgccccacgctaataaaatgtgttgcgaggctgacgctggtgtgtatgcgagcgcccgcctcccagccccggtgcccgcagaagacgcttttccccagcaggtcacccacggccccggaaccgcggcgactggaggctggattcgaggccggaaacgccgggacccctggacccggcctggtgggagcagcggagggggacgccccacggggccctgcggagcctgaagccggagagcaggcggctcttctggaacgcagggcccgggccctccagccccgcccggcccaggtatcctccctgagcctcagtctccccagatgtcaaatgaagaggccagctgggcagatggtagtgacattggtgagacaacagccctaacacttcccaggaactgaagtgcctcatgtgattgattcccaggcccaggcagcggaggttacaccctcagcaagggctcagctgggatctgcgcccggcctgctccagaacgcagcccactcgccaccggtggggagggtcgtccggtatcccccagtgcccaccaccaccaaccagaatcacttctcagactgcaagagcgaatccagccgggcgtggtggctcacacctgtaaccccagcactttgggaggctaaggcggcggatcacttgaggtcaggagttcaagatcagcctgaccaacatggtgaaaccctgtctctactaaaaatacgaaaaaaaaaaaaagctgggctgtggtggcaggcgcctgtaatcccagctactcaggaggctgaggcaggagaataacttgaacccaggaggcagaagtggcagtgagccgagattgagccactgcactccaatctgtgcgacagagtgagaccctgtctcaaaaacaaaacaacaacaacaaaaaaaaaacaggccagacgcagtggcccacgcctgtcatcccagcactttgggaggcagaggcaggtggataacgaggtcaggagatggagaccatcctggctaacatggtgaaaccttgtctctactaaaaatacaaaaaatgagccgggcgtggtggcgggcacctgtagtcccagctactctggaggctgaggcaggagaatggcgtgcaccgaggaggcggagcttgcagtgagccgagatcgcgccactgcactccagcctgggtgacagagcgagactccgtctcaaaaaaataaaaaaataaaaagtgaatccagaactccagctccagttgctggcaggtgacttcactcccttggcctcagtgtctcctgttaaatgggagtccccacagcctgttctggtggagggggtccaatcggacatagagaacactcaagccttgtttctcccctgctgtcaccgccacatcacagtcatccacacagaaaagacttctgtgaccacatgtgggagcgttttttcccacacaccaaccagcagacgccagccgggtgtcctcttaattcagctctgacgccttctacccagagatagtgtcagatcccacaggccgagggctcagtccccgagcctctccctcttcagacaccagttgcgaatctgggcttccaggacttcggtctggccgggttcaagttggggttcccagcacccctttgggttcaattaatttgctggagcagctcactgaactcggaaacacttgtgtttcctggtttactataaaggatgtggcaaagatagcagaagaagggaccacaggtgaggtacgtgtagggtggggattggagtgccatgaggatgcacagggcaccatctcagagcttccaggcatctccacatgttcagctcttggaagctccccagaacccagttctctagggtttcgtggttttttgtttgtttgttcatttttgagacggagtcttgctctgccacccaggctggagtgcagtggcgcaatctcggctcactgcaacctccccctcctgagttcaagcgattcttctggctcagcctcctgagtacctgggattacaggcgcccaccaccacacctggctaacttttgtatttttagtagagacggggtttcaccacgttggccaggctggtctcaagctcctgacctcaggtgatccacccacctcagcctcccaaagtgctgggattacaggcgtgagccaccacacgcggcctagggattttatggaagcttcatgatgtcagcattacttccccaggggtatagggcaggaccctctttggggagggtcccaagacccgtaatcgaaaaggtaagattagagctctgcagcccagaggagggcgggagattatttcctgaggcctaacgagctcagcagtgcagcaaaagactgcaactagggcttcaggagctatgatccgggaactgaggaagaaaactactctctattctaacaccacacacgggaacagaattttattttattttaattttttgagacagagtctcgctctatcacccaggctggagtccagtggcgtgatctcggcttactgcaagctccgcctcctgggttcacaccattcgccattctcctgcctcagcatcccgagtagctgggactacaggtgcccaccaccacgcccagctaattttttgcatttttagtagagacggggtttcaccgtgttagccagtatggtcacgatctcctgacctcatgatccgcctgcctcggcctcccaaagtggtgggatgacaggcgtgagccaccgtgcctggccttctttttttttttagacggagtctcgctctgtcacccaagctcgagtgcagtggctcaatctcgtctcactgcaacatctgcctcccaggttcaaataattctcctgtctcagcctcctgagtagctgggatcacaggcacgtgccaccgtgcctggctaatttttgtatttttagtagagatggggtttcaccatgttggtcaggctggtcttgaactcctgaccttgtaatccacacaccttagcctcccaaagtgctgagattacaggcatgagccaccgtgtctggccgggaacagaatttttaaatttttacaagttccacgatggcagagaccactcctgtctcccagtttcccagcactgagctgggcttaggataggtgatcaatgaaccaatgaatcaatacaggaatgaatcctggcaaatcgcctgtttcccaaaaaaagccacaataatggttccactccccgccgcagaggcagatggagaggtagaatccgcatccccctgcgggactggagctccttccaaggcagggcccctgcgggacgctcaccctctggactgggcaccagctgcgatgcctgcgctgacggcagctcctgctgtgcagactcaggagctgaataaatgacagttgtggttctaggctaccaaatttggggtgattcattacgcagcaatgagtaacaaagattaatgaaaggtgcccactccatccacaggtgctgttaggctaccacaaacgccccttacaggtgtgagccttacaggtcatacgccagagcatttcagtgagcacgggccgggggctcagcagcatttccggtgagcacgggccgggggctcagcatttccggtgagcacgggccgagggctcagcagcaattccggtgagcacgggccgggggctcagcatttcagtgagcacgggccgggggctcggcatttccagtgagcacgggccgggtgctccgcagcatttccggtgagcacgggccgggggctcagcagcatttccggtgagcacgggccgggggctcagcatttccggtgagcacgggccgggggctcagcagcatttccggtgagcacgggccgggggctcagcagcatttccggtgagcacgggccgggggctcagcatttccagtgagcacgggccgggggctccgcagcatttccggtgagcacgggccgggggctcagcggcatttccggtgagcacgggccgggggctcagcggcatttccggtgagcacgggccgggggctcagcggcatttccggtgagcacgggctgggggctgagcaacaggacacaaaacacaggagagccgggcgcggtggctcacgcctgtcatcccagcactttgggaggccgaggcgggcagatcatgaggtcaggagatcgagaccatcctggctaacacggtgaaaccccgtctctaccaaaaatacaaaaatttagccgggcgcggtggcgggcgcctgtagtcccagctactcgggaggctgaggcaggagaatggcgtgaacccgggaggcagagcttgcagtgagccgagatcgcgccactgcactccagcctgggcgacagagcgagactccatctcaaaaaaaaaaaaaaaaaaaaaacataggagaggcccctgtcctcccgaagcccacagccaggcaggctgaggtgggcttaaatcctggacacccggacagggacgcagggcacggaggcttccaggagtgaccaatcagaggacaccaaagctggtcccagggtgcacctcacactccgccccggtcccttgaggccaaggccgaccgaagcccacctcccctgccccgcccagctccccggggcctcccctgatccctgaccctgtgccgcccactgtgcccgccctcaggtcccgaggaccccgtctgtcctaatcccggcatgacccttaccagcgcagcccggaagctgacgcgtcctccctggcctcacagcagcatagagcgcggcaatcccctctggcagcacccacaggctcctgccccaccccacagtcccccttggaagcttcctctctctccccagctcctctggtggcttcatccagggcctcccctcctcccaacagtcctctgctggctccctggggacatcccaagcctgacacatccaagacggagcttccggccggctccctggaccccgggctcctccagagtttctggtctctgtggaagcctctcacccgatccactgagcactgagaccacggccagacgccttcccgggctccacagcggccctcaccacacctcatcctgaggcaccctgcctgccctcccttcactgcccccggctggtccagccaacaccctcgcccacctggacccccagcccttcaccgcccccggctggtccagccaacaccctcgcccacctggacccccagcccttcaccacgcccccggctggtccagccaacaccctctcccacctggacccccagcccttcaccgcccccggctggtccagccaacaccctcgcccacctggacccccagcccttcaccgcccccggctggtccagccaacaccctctcccacctggacccccagcccttcaccgcccccggctggtccagccaacaccctctcccacctggacccccagcccttcaccgcccccggctggtccagccaacaccctctcccacctggacccccagcccttcaccgcgcccccggctggtccagccaacaccctctcccacctggacccccagcccttcaccgcccccggctggtccagccaacaccctcgcccaaatggactcccagtccccaccagccagtcaaagcatccctcccccagcctcagcgatgggttcagagaaacccagctggccagtgagatgcagccgggagctgtttccgggagcgcagtgctgggcggctgggttgggtgcatgggctagactttgcagccctcacctccgccatgtctgcgaataaagccggcactcaggacagctgagcgggaggctccccagcgtcttctcacctctgtcccgcactcaccacccagaccctgggcctctagccagtcgggctgtccccacctcagggcccctggacgtgctgttccctctccctgcagcactgttcccgcagacctgcctgctgcttccccacgccacctgggtctctgcttatatgtcacctcctgagtccaagatgccttcctacaccatcccggtggctctctaacccctggcattctttagaaactgcttatttatgtatttatatgctggtttgtggcctctctccctgtgaacccaagggcaagaagtttactgcttttgttcactgctcaatccccagaacctagatttacacatagaagagaaggaagagaaggagagagggaaggagggcaagggaagggaaggggaagggaatggaagggaaggggagtggaggggaggggaggggaaaggaggggaaaggaggggaaaggaggggagggggataggaagagaggggagggggatgggaagagaggggagggggaggggaagggagcagaggggaggggaggaggaggggaggggaagggaggggaagggaagagagggggagaggaagggagggaaagaaggaagcaattttcccctaggaagaagctggaagtcattgaggtgtgttaatccctgtagctgtagtaacaaatttagtgacttagcgtggacgtaccatctcacagctctggaaggcagaacttctaaaatcgaggcatgaacagggctggtccctcctgggggctccagggagaacctgtttcctcctttcccagagtccagaggcgcccgcatccctcagctccaggcccttcctcccccttcacctccaagagcgcaacctcttccagtctctgactctcggcgcccgccccccaccgccctcttaaacggaccctgtgaggacatgggcccccatcaccccggatgctctgccgtctcagggttcttatcacacctgtagagtcccttttgccacctgaggtggtacagccacagattctggggatcaggatgtggatgtcttgggggccttattccctcttccacggtgaggaactggcccgggactgcacagaggaaagctgacctggaagcctgttctgatgcatctggaagcacacgggccccacagccttttgcgtttttcccctttttttttttttagacagggtctcgctctgtggctcaggctggagtgcagtggtaaaatcacagctcactgcagcctcaaactcctgggctcaggcgatcctcctgcctcagcctcccaagtagctgggaccacaggtatgtaccatcacacctggctgcttaagaaacatttttttttttttttttttttttttttttttttttttgtggagacgaggtctggccatgttgcccaacgccccacagctgctgtgtcctggctccctgtccctctcccctgaggaccatatcctcccacatgcacccctctgccttctgagaactgtctttcttccctacaaggcatgagagcagcaagatgccatcgtgtaagagtctcagtgacatcttgggctccacaggaagacctttgtacaactatcttatctaacccactttcaaattaaaaaactgaaagtcgggctgggcgcggtggctcatgcctgtcatcccagcagtttcagaggccgaggcaggcggatcacctgaggtcaggagttcgagaccagcctggccaacatggcgaaaccccgtcactactaaaactacaaaaattagccgagtatggtggcgcacctgtaatcccagctactcgggaggctgaggcaggagaattgcttgaacccaggaggcagagattgcaatgagccaagatcgtgtcactgcactccagcctgggcaacagagtgagactctgtctcaaaataaaataataaaataaaataaaaaactgaaactcataggccaggcacggtggctcatgtctgtaatcccagcactttgggaggccaaggagggtggatcacatgaggtcaggagttccagaccagcctggccaacatggtgaaaccccatctctactaaaaatataaaaattagctggcatggtggcacaagtcacccacttgggaggctgaggcaggaggatcacttgaacccgggaagcaaaggatgcagtgagaagagatggagccactgcgctccagcctgggtgacagagcaagacgccatctcaaaaaaaaaataattaaataaataaattaattaaataaacctgagactgggtttaatgtttgagcgatatttccaaggtcgtggcagaaactagatttgaatttaaggttcttctctgccatgtgatggaaaacctaactcaaactggcttaattaacgaagaaggaatttatttttacttatttatttatttttgagatggagtttcactcttgttgcccaggctggagtgcaatggcgtgatcttgactcaccacaacctccgcctcccaggttcaagcgattcttgggcctcaccctcccgagcagctggaattataggcatgtgccaccacgcccggctaattttgtatttttagtagagacagggtttctccatgttggtcaggctggtctggaactcctgacctcaggtgatccaccctcctcggcctcccaaagtgctgggattacaggtgtgagccacggcgcccggcacgaagaaggaatttaacctggttgtggtggtgtgcacgtgtggtcccagctacctgggaggctgaggtgggaggactgtttgagcccaggagttcaaggccagcctgagcaacaggaacgggggcagggagggaggaaaggaaaataaactaaaaaggctgggcgtggtggctcacgcctgtaattccagtactttaagaggccaaggcaggaggatcacttgaggctgagagatcgagaccagcctggccaacatggtaaaaccccatctctactaaaaattcaaaaattagctgggtgtgacagtgcacgcttgtgatcctagctacttcggagacaggtgggaggattgcttaagcctgggaggcagaggttgcaatgagctgagattgcgccactggactccagcttgggtgacacagagagactccatctcaacacaaacgaactaagaggcaagaattcatgagcttgcatcattggaacatccaggggaggtcaggtaacagcatgatgcaggatcactaataggattatcaacgtttcccctctcatcagccggctcggctttcctgtgatgccgcctttgttcggaggccccgtggtgacaccatgaccccgtaactccagccccaggtccttccagctcagccaccccagcactgtgatcccagagaaatgtcccagagctgaatctcattggacgtcaggagtcacatgcttgttcctgaaccaatcattgcagcccagggtgggggccctgggaactgatgggatggcccctccctgcagccagggcttgcgtcagtccaattcgaacccgttcccacagagtagggagcccccaagcaggcaggtggaagcccctggtgtccaccgctcccgggtgctgtgagcctgagcctccctgggggtcggggccctgtgggaccagctggaggggcttgaaaatctccccaacccaggccgggcgcggtggctcacgcctgtaatcccaacactttgggaggccgaggcgggcggatcacgaagtcaggagatcaagaccatcctggctaacacggtgaaaccgcttctctactaaaaatacaaaaaattagcagggcgtggtggcatgcgtctgtagtcccagctactcaggaggctgaggcaggagaatcacttgaacccgggaggtggaggttgcagggagccaagatcgtgccactgcactccagcctgggcgacagagcaagactccttctcaaaaaaaaaaaaaaaaaaaaaaagcgagagaaagaaaacctccctcacccacacagtgcttcctgggatgtgggtgtacggaagaagagagatcttgggagcccttagagaaggaatcgtggttaattctaattagcattaatttacccatgagctgctgcctgccggctccatgatgctggcaatatatccacgacctgtggcacggaagagactgaggctcacaaaaccctgggaaccttggtgaaggggccacagccagaaggccccactagtcccgagaccctccttttactccaggcccccagggtgccgggcagaggggcctgagggaggaggcccagaggcccttacgggtgaggacgcctcggcctcggccctggacagctctggaagtgaccgctcggcccagagctctttcttggatccctccctccctctccactcctgatgctgttttcctttccccagacaggtttgcctgctggtcctcttccggggaccagactcatgaagccggggccaggtgttggggcacctgcgggacagagtggccctggtcccagactggtttttgtttttggttttttttttttttgagacggagtctctgtcgcccaggctggagcgcagtggcgctatctagactcactgcaagctccgcctcccgggctcacgccattctcctgcctcagcctcccgagtagctgggactacgggcgcccgccaccacgcccagataattttttgtatttttagtagagacggggtttcaccatattagccacaatggtctcgatctcctgacattgtgatccgcccgcctcggccccccaaagtgttgggatcacaggcgtgagccaccgtgcccggcctgtatgttgatgcagctgtgtgtacccagggcatagcaacaatgccactggcacagtccgagggcagggccacccgtcacgggcacgactcaggggaggctgggctgccccgtcctcaccacggccagttctcccgaccaagcttcacagcaaggagcatgtgggtgtctgggcagccactgagccaggtcagaagtcaggtggggtcacagtgatgcccggaatcagctggggtcaagactcaggtgggctgggcgcggtggctcatgcctataatcccagcatttgggaggccgacgcagacggatccctttattagtccaaactgcatcctccccttcctttcaaaacctaacaacacacttgaggtcaggggttcgagaccagcctggccaacatggtgaaaccccatctctacttaaaatacaaaattagccggacgtggtggcgggcacctgtaatctcagctactcgggaggctgaggcggacactagcttgaacccgggaggcggaggttgcagtgagattgtgccactgcactccagcctgggccacagaacgagactctgtctcatttaaaaaaaaaaaaaaaaaaaagactcgggtaggacaaaggtcaggctgggaggagggcacagccaggctcgggctcagcttggggtgggggctccgtggggctggcgcctctcccgggtcaggtgctgagccgatgctggccggcgtaggcctctttcccagtttctctggggggcaggagcaccttgccaacctctgatggctccagcgcctgcactcgcctcacaccacatggtgacttcaacggggaccagggaagccctcgcccctcccacccctcagagccctccccgacctcgcccacttctcagagctcccgctgtcgggggaaccgaggcagcgccgcgcctggaagccaggtctgcggatcccgcctcgctcccgccccttcctcccttccgcgtggccagcgcgaccctaggacagacttcgcgcccgtcccctgcacagacggggaaacggagacggggacgcggggtcgcgccggatggaccggccctgcccctccggtcccggtcaggaccccgcgccgcgccccgttcaccgcccgcggccccgccccgcgccggcacgtcacaaaacaaccccaaagccgggggaccgggccggtgacggcgcagagcagccctgcccgcctccttgcgcacagcgtccgcggtgctggtcgagcagggggcgacggcggcggcctcggggatcggaagagcccggggctgcgcgctcgaaccctccctcccggcggaggcgctcggcgccgtaggcgggaccggggccgggactccacctcccggcgtcccctgcggccgggcgcgcaggcgcaagtcggacctggccgcggagcgcaggcgcagtcggggccaggcggtgcgcgcaggcgcagcggggggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggtgagcgcggcgacccccgcccgggtcccggagcccacgagcgacctcgggcgccgggaaccagctccctgccccgcggtcctagcgctgttgctgggcgggccccgaagcctcctggcttgggctcgtttcccttctatggccacgttcccccacccagctctgcccggccccctcctcggaccgtctcggggaccttcagcctctgctgcagtcctcgaaaatccccagttcccttcaaggcatcgtccggtcccctgttaggctcttggcccccggaggggtggccgggggccctccctgtagcatctgggcgtggggctcttgcccacctcctccttggcgggggctggaccccggctgcctccccctccgcccctgcgagaaagagggagcggagcccaggccgcgccggcctttcagctgccctccccgccctccccggaggagacaaagaggcccccccagaccccgtagctgctattgttggggagctgggcccgtgagcgggggagcgaggccagcctgggggtggctggcgcggccactcgctcagtctccaacaaaggcccggatgagccttggcagccaggacccgcctggaaagcggccacccttgccagtagcagccggccaggcgccctgggctccatcccctgctttatgtaacctgcgccctcgggaaggccgaagtaggggcgtgcctcccacctgctccctgcagctctctccaggcctcccggctcgggcccgcgtcccggaccccgacctcagaagctccgggctcgctcatcccagctggtcttggcctttctcagagtccactgaacaggtggcttcttgggacccaaaccccgagttctgggccgtttcttctgccctctggcggtttaattccaagcagtttctggatgtttttgttgttgttgggagcggggaggctgtttctgtctcatgtgaaaaggactcaggccaaaaccagggcagttttcttgatctcacgatccagacgtgacctttgacttcttttagcgttcagggacctcgttcttggggccagagggacaaagcgaggggccctgtgtgagcggtggggaacgagcaccctgtccaggaatctccccctcccaccgtcacttcctgccaagagcctggacacgacacgacactgcagggcccggcccgctctgccccggccagctgcgggcgtggggccgagggaccgatgcctcccgcacgatatgtgtctgctctccgagctaattagtgtctgaaccgcacccgctcagcggctgtgagggcagcagcctggtctgctgggggcgattcctgagcagagagtgggacgcccgtgggttctgcatctggaatcctgcgtccccacacagggaacagagtttgggtctcgaggttgccaaatggttttagcagctcctccgccagccccttctgtctgcttgggggagcagctggctgaggagccgcagccccacctcgaagccaggcctgtgaggcggctgctgttctggaaggaggggatgggggtttctggctgctgtgcccaccagaccggttgccagggattgtgggcagagcttcctgggccagcattaggggataatccggttttccggatttcccagggagggggcctctagacatctgccacagggtcagtcctcagaagccagtgttgagacgggggtgctgccacccacgaggactctcccttcccgctgtgcctgggagggagttgggggagcgtggaaatacagaacctgctgagtgcccagggccgctgctgcccagccactgcctgcagctgctgttccttcaggagccaaagtgagccctggggcaggggccgccagagagagccctccacagccgacttgctgtctgcccttggcagggcgctttccttttctgagcctgggtttgctccggggaaaagacattcttagaggtgcccaaaataagaggctcattgggacttggtggggtttggtacagatgaggccttggctgttgtcaaggattgccgcctgaaacccagcaccaggcttggggggcctgaagtcttggggaaccgcaggacagttctgagactgaagttccagccttgctctgtggccgcggccaagtcacttgccttacggggcaccagtgagttccctgtcaaacagaggacaccccccaagacaccccgcgtgccctccctgtccaggaggggcccgtccacgatccaagacccccaaagtgccctgcctgtccgggaggggcctcgcccacaatccaagacccccgagtaccctccctgtccagacctcgcccacgatccaagaccccctgagtgccctccctgtccagacctcacccacgatccaagaccccctgagtgccctccctgtccagacctcgcccacaatccaagacccccgagtaccctccctgtcaaggcctcgcccacgatccaagacccccgagtgcccgccctgtccagacctcgcccacgatccaagacccccgagtgccctccctgtccagacctcgcccacgatccaagacccccgagtgccctccctgtccagacctcgcccacgatccaagacccccgagtgccctccctgtccagacctcgcccacgatccaagacccccgagtgccctccctgtccagacctcgcccatgatccaagacccccgagtgccctccctgtccagacctcgcccacgatccaagaccccctgagtgccctccctgtccagacctcgcccacgatccaagaccccctgagtgccctccctgtccaggcttccaccacgatcgctctgggggtgctgctctcgtgccttggagtgctgagtgccaccaggacccctgacccagacaacctctgtgtctggcactggggcccagcaggaaaacagtgaggcttccttgtttacctgctgtggcccaggagggccgtgggtggcatcacgccccaggctgcaggccagacagctctgtcacctggcacgtggcttcaggcctccctctgtggccgtccttgccagcagatctggacctccagggcctgggtgaccacagggggcgatgctgacagggaaggagtcctgccaggtttctgtgacctatgggtctgcctgcctgaccccccaagaccggacacctgagggcagacggccatactgactcatcccctcccacggcctgggccagggcaggtgtcacaagtgtttgctaactgagcaatcatctgtgctaaccctccccacaccctggctgccaaggccctggaggtgcagccctggtcctgggcttcagctccatccaaggggagcctggagcccctgccagtccattctgtctgctggtgggtgcccctggcctgggtcccatatgcctgacctgggctgccacgggcctggagccacgcgggcagccagtgcccacgttccccagcagttgtgctgggccgggtcccggccacctggactgtgtaggagctgggatcagctcgggtgactcagaaaaggcttcaggcagccttctggggacttgaccccaggcctgtgagagtccctgccttgggcaggatacggtgtccctcacacacaccctcaggcaccagcactgggagtgggatggccttgggcaccttgtgagctggggcaggtcttggggctgggctggactgagccacctgccttctgcccctgcaggcgcgcctcaagttccccatcgactacccatactctccaccagcctttcggttcctgaccaagatgtggcaccctaacatctacgaggtgagcgcggcccccacgggcctcaagtcctcatcctccgggacccagggtgctgggagcctcacgtcctcatccttccgggacccggggcgctgggagcctcacgtcctcgtcctccgggacccggggcgctgggagcctcacgtcctcgtccttccgggacccgaggcgctgggagcctcatgtcctcgtccttccgggacccggggcgctgggagcctcacgtcctcgtcctccacgtcctcatcctccgggacctggggcactgggagcccgtgctgacctctgacctgttctgacctgtcttcttcttgtgcagacgggggacgtgtgtatctccatcctccacccgccggtggacgacccccagagcggggagctgccctcagagaggtggaaccccacgcagaacgtcaggtaagccggcccaaccccctgtgtccacccagaacatcaggtaggccgggctccgtcccgtatccacccagaccatcaggtaggccgggctcccccacaggctgtggcgccaaggcctgattcgggacctgccagctggcggtcctgggcctcgctgtacctgcacggtaggtgctttcacggggcctgcggcaccgtgtgtcggtgcagactcccaccaggaccccaggccggccccaccgtctggaaccacctagaggtgtcccgccatcctcagtcctggggccttctccttacccagccgtctctgggttggtcacctcgtgccacgtgtgccgcctgggcctcgtccccaggtacaagcactgggccgtgttgcccgtgtgtcctggagtgtagtctaggcaggacgtgcgggtgtgagggcagccccgggtctgacggaggggtctgcaccttgctgccctccctggtcttggcgtgggagggaggagactgatgcaggtccagcccctgctgttctgggggcctgagacagaagcagaggccatgaggccaggtgaaggtcacctgctgggtgggtccaggcgtccccgtgaccctcagggccagagaagagccggaaggctggggtgccccgggccgccccactccgacccactctccccacaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggtgagggcgggcgggggcgtcacgggaggagagactcagatccggcctgcaccccggcccctggtcccacggccgcccagccccaccttcctggtgagggtggcggagcttcctggtgcccatttacagggtgccagtcacagatggaggccgggccgagtggcggagggtccagccaggttcaagcccagcttcttgccccttttcctctttttttttgtttgagacagagtctctctctgtcacccaggctggagtgcagtggcgcgatctcggctcactgcaagctccgcctcccgggttcacgccattctcctgcctcagcctcccaagtagctgggactacaggcgcccgtcaccacgcccggctaattttttgtatttttagtagagacggggtttcagcgtgttagccaggatggtctcgatctcctgacctcgtgatccatctgcctcggcctcccaaagtgcagggattacaggcgtgagccaccgcggccggcctttttttttttttttttttttggagacagagttatactctcttgcctaggctgcagtgcagtggtgcgatctcggctcactgcagcctccactactcgggttggagcagttctcccccttcatcctgccaagcagctgggattacaggtgcccactaccacgccgagctaatttttgtaatttttagtagaggtgggatttcaccatcttagccaggctggtctcaaactcctgacctcaggtgatccacccgcctcggcctcccaaagtgctgggatgacaggcgtgagccactgcacctggcctggtggttagtgttttcatagattcttccaggcttttcagtttaacgcatgtctgtgctttaatgaagaaatggggtcgtgctgtgtgtgcccagtgactgactgttagggaacatgtgtctgtgccttaatgaagaaatggggtcgtgctgtgtgtgcccagtgactgactgttagggaacatgtgtctgtgctttaatgaaaaaatggggtcgtgctgtgtgtgcccagtgactgactgttagtcaggggtgttggccttactcatgtctggagtgcgtccctgcaggctcttggcctggtgagctctgggtacagctgtgcagtcgcctaccggcgccttctgtacctgcagtccacttagcttgcgtggctgtgtgtggtgacccacggctctccctctcctcccatcgccctcatgccccagagctgagccccacagccccttctcttgggtgcctgtgttcacatgaatgtgtaaacacgtgcgtgtctgtgtacaaagacaaggctttctttacgggttgacggccttaatggttcctgctcttcctgttacatagaggcccttcctatccattttttttttttctcagagtgatattgcatagatttcctcacagaggcctcacctatttttgttggtattttgtataaacagaatcttaaaaacaacttttaaaatattgcacacataatgcatgtgtcttcctcgccccaggacccaggagcatccagggcaccttccatcctgcactcgctggtacctggtgtcgtggggtcatctcggggcagcatcctggtgctgggcggtctcggctctgagcagccatggtgggcgggccccgtgcggcctcctgggaagtggcctgcaagcacctgctggcctctggaggtcacagggtagctgccctggccgtccctctggtgcagatgtcctcggtggccccggtccggtcgtgtcacctggcccaggtggctggctccttggcccggttcttcccggccacctccctgaggcaccacctccttgagatcccagcacagaaataaaagccacactatttttatccctcaaaactccctgtgggccaacacacatgtgccatgtggactctgctgtggtcgccgtttctgcctgttttttcatctgtgtgcgtgttggcctcgtggcagcccaagtcccgctgagctgtgtcgggcaggctgccgtggagcccggcttggtcagggatgttggtcttgctgaacaggacctccagaccgtcctccagctcatgctggcggtgtgccggcggcacctccacggtgcaggtcagttcccaccctggccctcccctgcgtctccccacagccgccacctctgcggtgccgtccccggggcaccgtcacccccccagcccgtccaccctggccctcccctgcgtctccccactgctgccacccgtgcagtgccgtccccggggcactgtcagtcacccccccagcccatcggagagcttggaaagcaaagcttggcgtccgctgggtcccgccacccagggacgtccctgaggccagacgcctgccctccacgcgtcatgcatccccataaaaagcactgggcttgtgggctgggcttggggctgtctgtctgctccctggtgccctcccatgcgggcactgtgggacccgcacaccctggtagcagccagccccagagcccagagccgtgcctggtcggtgataggggctcgagcccattgcctgcggctgcagcctcgttcctgttttctgtcaaatggggtcagcgtgccgcctggccctgctgtgccacccccggaagcccctttgcttccagtcctggggggacattcttgacgcgtgtcctggaggtggagccgggggcaggttcctcgtaggtcctggtgtgcgcggtgcagcccctcatagggccgggtgtacacggtgccctccaggaagtttgagctaacttgtcctcccttcctgccagaggctgggatggccaggccccccaggtttagaatccggaggccggggtggccaggcccccaggtttagaatccggaggccggggtggccaggccccccacgtttagaatccggaggccggggtggccaggccccccaggtttagaatccggaggccggggtggccaggccccccacgtttagaatccggaggccggggtggccaggccccccgggtttagaatccggaggccggggtggccaggccccccgggtttagaatccggaggccggggtggccaggccccccgggtttagaatccggaggccggggtggccaggccccccggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccacgtttagaatccggaggccggggtggccaggcccccgggtttagaatccggaggctgggatggccaggcccccgggtttagaatccagaggctgggatggccaggccccccggtttagaatccggaggccggggtggccaggcccccgggtttagaatcctgctgaggccacggagaggctcaggccgtttttgcgtttcccatctcacctgtgctggttcccgtctccagggatggtcctgcctcctgtccttgggccctcccagctgcttcctttgctcctgcgctgaggaaggcttttgccccccagtggggcagcatgggccctccctgttgccggcatcgttattttctcccagctcctgatgggtcccttgggttgtgcttcggggcggggcaggcgggtgtgactgcactgcgcccgtccagcctcccacccgcacctcctgcccttcccgagccccctcctctgtcatttctccccctggagttcctcacgcacagggctttgtcctaagtggtcgccacacgccgttttaagagaaacctgagcgttggggtgagcgtcggacctgggggaggggggccgggcaggggccgagtccaggcacgtgggtggcgccctcacccaccctgtccccccaggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgagaggccagagaagctgtgcttgggagggagaggcagcctccacgtccatgagtgactgcacacggccagtcccactgggaccctggctacgccaggtgtggatctgggaggcctgtcctgggaggcacggggagcagccgggtcccgcggcctgtacgttcccatgacttgggtcagacaggcctgggcagcatcccccagcctgcgggacaggggcggccagaaagcccccagagttcctcctccctgtgaccaggtgcatctagtgggacgggagctgcctctgcaggcatccagcaaagcttcgtcgcgggtccacagccgcctgggcgttgatctcagcgtctcagggctcccaggaccacagatgcccccgatcagcactccggcggctccagctccgtccaggcacaccctcggggtggggagccgtggccctgggcacacagggcaggcacctcacgtcctggtgtcaggaagtccccagcatcgttttattacatgtcatggaggaaagctcggagctcccatgccctcccggggcaccgccttccaggaacctgcctgcgttccgcttctgggcacccggaaagtcgctcagtggctgattcagggtcgaggagctgtgaggatgaggtttcccaccaagttgggacagaaaatggggccctggggtctcagcaaaccatggccctcgggaccaaacctggcgtccgcccctattgtgagtgaagtgttactggcacagccacacccaggtctcaggatcatccatagctgcttggtttggtttggttttgtttttgagacacagtcttgtgttgcccaggctggagtgcagtggtgcgatctcgcctcctgggttcaagtgattctcctgcctcagcctcctgagtagctgggactacaggctcccaccaccatgcccagctgatttttgtatttttagtagagatggggtttcaccatgttggccaggatggtctcgaactcccaacctcaggtgatcgcccgcctcggcctcccaaagtgctgggattacaggcgtgagccgccgcgcccggcctaaatttatttatttttgagacagggtcttgctctgtcacccaggctgaagagcagtggtgcaattacggctcactgcagccccaacctgggctcaagcgatcctcctgccccagtctctcaaagtgctgggattacaggtgtgagccaccgccttcggccagtgtctttattcatgaagaccaaaaactagaacagcgcaaatatccgtccgctggtgaatgcataaacacagcgtggtccagccacacaatgggatgtgacacagccacaaaaaggagcgaggctctgacacaggccacagcctggatgcaccttgaggacgtcatgctgggagagacgccaacgcaacaggtcctgtgtgattccactcctgggaggtccctagagaccaattcagaggcaggaagtagtggccgggcgcggtggctcatgcctgtaatcccagcactgggaggccgaggtgggtggatcacctgaggtcgggagtttgagaccagcctggtcaacatggtgaaacctcgtctctactaagaatacgaaaattagccgggcgtggtggtgggcacctgtagtcccactactcgggaggctgaggccggagtatggcgtgaacccgggaggcggagcttgcagtgagccgagatcgcaccaccgcactccagcctgggcgacagagcgagactccatctctgaaaaaaaaaaaaaaaaaaaagtgttactttgtcaggtgtgatgatggtagtgtggcttcatctcgagtcctctttgagaaacactttctaaaatgctcaaggatggagggtggagggtgtgcagcggtgggcggggctgtgaccgtcacctcacctcccccacaggaagcgcgtgtggggaggctcggggccggggccagcacccacactgggtctccacagcggcatggaggcctgcgtgtcttcactgctggtgctggccctgggggccctgtcagtaggtgagtgggagccgggatgcaggggggacactgaggcccagcgctctcggtgggtccctggatgggaggggtgggcgcgggcgccgacatcctgggtgtaagagcggagattcatccttgtttggagggggactgaggcctggggcatcccgagctcctcacgcttcaccccgagtggacatcccgggaccgtgggagagtgtggtgtccaccggctcacctcgcccatcctcccggcagcagccagaaggcaggggtcacgctcacacccgaggtgcagagtaggagactgagacttggcgaaggagatgctgacctaggactgcccagctgggagggcagagctgggactcgatccccgctggctgcctgccaccaccaagggcttggctgggactaggtgcccagcagtgagggagaagggaggtgggtggcggctcccctgcattccagctggactgagtgacaggggctcttgatgagttggggacccaagaagatggacagaggtaggaatccagccgtcagtcatcatcatccttcctcccatttttatttccttccacccatgggtccatcatccctccctccctccctccctccctccctcatctccccttccttccctctacccgtccgtccacccatcattcctccttccattcttccacccacccatccatcatccatccctctacccatgggtccatcatccatccctccctccctcctttcgttcccccttccttccctccgccagtccatccacccatcattcctccttcctcccattcttccacccacccgtccatccatcatccatccctcctttcaacctccctccttccctccacccgtcatccttccctccctccttccatgtatccacccatccatccatcatgcctctctcttcctttcccccctccttccctcctccctcccatccatccatcatccattcctccttccatccctccttcctttctcccgtgcttctgtgtatccatccgtatttgcagggctcgtgctgttctaggcctgccctcctgtctgactggaagagacaggccaggcatgagactgtgcagagcggaggaaacacggagggcaagagggcgggtggggggccgttgcaggagacgagcataaaccaagggaggaagccggtgggggaaaggtacgcaggcagctaagtgagacagacaaaggcccagggtgcaggcagcttgcaggcacagctagacttgcactcttgtcacccaggctggagtgcgatggtgccatctcggctcactgcagcctccgcctcctggtttcaagcgattctcctgcctcagcctcccgagtagctgggattacaggcgcctgccaccatgccgggctaattttgtatttttagtagagacagggtttccccgtgttggtcaggctggtctcaaactcccaacctcaggtgatccgcctgcctcggcctcccaaagcgctgggattacaggcgtgagccaccgcgcccggcctattttttttttttaagatggagttctgctattcttgcccaggctggagtgcaatggcacgatctcggctcaccacaacctctgcctcccgggttcaagcgattctcctgtctcagcctcccaagtagctgagattacagatgcccgccacctcgcccggctaattttttgtatttttagtagagacggggtttcaccgtgttagccaggatggtctcgatctcctgacctcgtgatccacctgcctcggcctcccaaagtgctgggattacaggcgtgagccaccgcacccggccttaatttctgtatttttagtacagacggggttttaccacattggccaggctgatctccaactcctgacctcaggctgtctgcccaccttgacctcccaaagtgctgggattataggcgtgagccactgcaccggcccgcaagcggggacttgattttcaaagcatgatggggattcagagaagattttgagctgatttacgttacattatgaaatcaatccttttatatttatgattgatttaaaataatttttgtacagctttattaggaaattatgcactatacaatttacttatttaaagactacatttcttgctgggcacagtggctcacgcctgtcatcccagcactttgggaggccaaggagggtggatcacctgaggttaggtgtttgaggccagcctggccaacacggcgaaaccctgtcgctactaaaaatacaaaaaaattagccggacgtggtgatgcgcttctgtaatcccagctactcgggaggctgaggcaggagaatcgcttgaacccaggaggcagaggttgcagtgagctgagatcacggcactgcattccaggctgggtaacagagtgagactccatctcaaaaaaaaaaaaaaaatggccaggtgcagtggctcatacctgtaatcccagcactttgggaggctgagatgggtggatcacaaggtcaggagttcgagaccagcctggctaacatggtgaaaccccatctgtactaaaaatacaaaaattatccaggcgtggtggcaggtgcctgtagtcccagctactcgggagactgagtcaggagaatggcatgaacccaggaggcggagcttgcagtgagccgagatcgtgccattgcactccagcctgggtgacagagcgagactctgtctcaaaaaaaaagaaaaaaaaagttttttttaagagactgggtcttgctgtgtcgcccaggctggtctcgaactcctggcctcaagtgatcctccctcctcagcctcccgaagtgctgggatcacaggggtgagccacccacatccggcctgatgtgcgttttgaaggactcctgtggctgtggggcccagtggggcctggggaggtcctggagaggggattgggaggtggcctggggggaacatgatgggggtgatgagagggggatgggagggatgaagggcagcccacacgtatcagcctaaaagtttcggggaacactggggacttcattaggatggcacatctgcttggggtcctgggcctctgagctgggcaaggacagtcgcagcaggcagcaggggcatgtagccccaacctggctctttgtcccccatcctggcaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggtgagtaccctgccctgcccaccccaggggtccggggaatccatccgacggcgcccattctctgcagggggtgggctctgggagatttaggcccattgtgggacccccgtcccctcccggtgacgacttaggcaggtttaagtgacctgcggctgtgggactcctggagaaggtttactccttgcaagaggcactggcagggccagctccttccacaccgcagcctgggtcagagcctggctcctttcacggctgagccacagtcctggtgtggacagagtgcattgtgtctgtccattcacctgctgatggacccaacttaggcgggggcttctgctataaggaaggagggtcaggtgggggtgtttgccacctgtggccaggaggtcgaagccggccttcgagagtggctcgggaatcgacctggttcccggggatcaggaagccgctaaatgacccatcatggagttgccctacctcaggactggtccgtcatacagagcccagatcaagatggtcaaagtaacaaaaagggatctgccggcttgtgtaactgcaaagtctaggaggaggcctggcttcaggtgcggcttgatccaggtgctcacaggaggcgctgtggagcccatctgtctcccagctctgctgcactaccaggaagcctgtctcacaaggtggaaagattgaccctcctcagtcccatggaaagagggcttggctctctaaagttggggcacacttaggaggattggcatgtgtcaacccctgtacaaatcactgtggttgagcctggggccccaagtgaagggaattcccagggctggttttcgtgaagctgtaggcttggggttggatttttggacacacagcccttgcctggggccagggccgggcagaagtctggggcaggggtgagagcagggagggcttcctggaggaggtgggttgcaaagacacagggaaggactggccaagccaaggcctgtgaggggcagcggctgtgagtgatggccatggacaacgggcacagtgggggccgggactgcatgtggcgggtcgtccacgccgggccaggccgcagcaccctgattccctctgtccccaggatggcccagctgaggctggtgctggggctccacaccctggacagccccggtctcaccttccacatcaaggcagccatccagcaccctcgctacaagcccgtccctgccctggagaacgacctcgcgctgcttcaggtgtgcagggacgggacagggagaactgggcaccctcctgtcccccacgggtgcccctcacccccactgcgccctccccccgctgccgaccctccccccgcactgctgcccctccccccgcactactgccccctcccccattgcccaccctccccccactgccacccctccccccgctgccgccccccgcccccgcactctcaccccctccccctgctcacctgccccttcctgtcactcgtagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaaggtgaggggcgcccgggtggggctgggggaatgaggctggcgggagggccggggccagggcagccgccgggcaggttcctggctctcccgttctctggggagtcctgtcaggggctggggggcggggaagcactggcaggggtcccgtttctcaggtgcagaaactgaggctcagacaggtttagcaacctgcgcaagaccacacagccgggaagcggcagagctgtgacttctgctccagccaagacggtccggcgggggaagaaggagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccagagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctcagagcccgcctgagtcccagcccacctctgtccatgctggctgtggggcttccgacaaacctgtttccctcagcctcccgagtaactgggtctacaggcgcccgccaccacgccaggctaacttttggtatttttagtagagaaggggtttctccatgtttgtcaggctggtctccaactcttgaccttgtgatctgcccacctcggcctcccaaagtgctgggattacaggcgtgagccaccgcgcccggcccttccctgttttaaaaagggaggttgtggatcccaaggcttctcccaggagggggcggcgttggccaggactggagcggtggccgggtctgcaggctggcaggggtgggcggccgtcctccccgcgtggctcctggggctgggccttgaacagcatcccaggatcttcttttttagtaacagcttttatcaagttacaactcacatagcagatgagtctccctgtaaactgcgattcaggggcctttggtacctgcacagagctgggcaaccaccaccgtgacatgtcaccccagcaccccgaaaacaggcccgtccccagtcaccccagcaccccgaaaacaggcccgtccccagtcaccccagcaccccgaaaacaggcccgtccccagtcaccccagcaccccgaaaacaggcccgtccccagtcaccccagcaccccgaaaacaggcctgtcccctgtcaccccagcaccctgaaaacagtcctgtcaccccagcaccccgaaaacagccctgtccccactgtcaccccagcaccccgaaaacaggcctgtccccactgtcaccccagcaccccgaaaacaggcccgtccccactgtcaccccagcaccccgaaaacaggcctgtcaccccagcaccccgaaaacaggcctgtccccctgtcaccccagcaccccgaaaacaggcctgtccccactgtcaccccagcaccccgaaaacagccctgtccccactgtcaccccagcaccccgaaaacaggcccgtccccactgtcatcccagcagcccgaaaacaggcctgtccccactgtcaccccagcagcccgaaaacaggccccatctctatcaccccagcaccccaaaaggaagccccacccccattgtcattccagcaccccgaaaatagactctgtccccactgtcaccccagcaccccaaaaggaggctcgtccccatcggccgtcactccccgtccccaccccagccccggtgccctcacatcccctccctgtctctggatgggcctgtgctgacatttcatggacaggggatcacgctgcgtggccttctgtgtctggcgtctcccgctgagcgtgacgtcctcaagctgcacccgcgcgctggctgggtccgagccgtgctcctgctccggggggtcgagctccagctcgaggggggcctcgctgcgtttgtgggtgcgtccctgggtgcacatctgggcggcttcgtctgcgtccgtccgtctgaagctttgctgggagccgcctgtgtgcgttttcgtgtggacctacctgctccttcctccctccagattagacccgtgggagtggcatctcgggctgttcagtgactctgtttcagcgccgcgctgttttcctgcagaatcttttaatttcactaccaactctttctttcttttcttttctttcttccctttcttccccttcttctctttccctcccttccccttcttctctttccctcccttccccttctctcccctcccctcccctcctctctctttctttctttcctttctttcctttcttccccgtctccccttcccctcccctcccctctcctcccctcccctctcctcccctcctctctttctttctttctttctttcttttcttttctttttttcttttattttcctttcttttcttctgatggagtctcagtgcgtcacccgggctggagtgcagtggcacgatctcggctcactgcaagccatctcaggttcaagcgatgcttgtgtctcagccacctgagtagctgagggatcacagacgtgcaccaccacgcccagctaactttttttgtatttttagtagagactaatagaaacacaggtttcaccacgttgaccaggctggtcttgaactcctgacctcaggtgacccgcccacctcgccctcccaaagtgctgggattacaggcatgagccactgtgcccacgttaatggttttttattattttattttatttttagacagttcccactctgttgcccaggctggagtgcagcctcagcctcccaagtagctggaatcataggggtccaccaccaagcccagctaatttttttggatttttactagagacggggtttcaccatattggtcaggctggtctcgaactcctgacctcaaataatccacccgcctcggcttcccaaagtgctgggattacaggtatgagccactgtgcccggccgggttagtgttgtaatagacttaatttttaaaaccatttttggtctgcaggagatgtgtggcggctgtatccacagggtcccccgcgtccccgcccccaggctcctggccgctcccctctccagtcagcaggagtcacggctgacgaactcacatgaatgcgtgattaactactaaggacctactcttggctcggatttcctcagtttcccctaatgtctcttcctgcacagggtcccacccgggaccgaacctgccgtttcgccgcagcctctcctcggcacccccaggctccgaccgtttctcagaactccgtgtctggaggccggctggacgggatttatgtagattacgggtgtggaccactgcacccgccagctatctcatgtttttctctcgattggactggagtcacagtgtttttgggagaggcaagtgcatttttaatctttaacttttttaatttttttatgttatttttttagagactcctgggctccagcaatcctcccacctcagcctcctaaaggattacaggtgtgagccaccgcgcccggcctaatctttaactttttatggcatcattggcagtggaaggttctcaggtcacaagtgaagagcctcataactcacaaaccaggcacgcccctgttcccggcacctgggtccagacacaaccccctgccccgaagcccctccttagccaagtacccaagtccagtctcttttttttttttttgagattcgagtctcgctctgtcccccaggctggagtgcagtggtgcaatctcggctcactgcaagctccacctcctgggttcacgccattctcctgcctcagcctccccagtagctgggactacaggcgcccgccaccacgcctggctaattttttaaatatttttagtagagacggggtttcacggtgttagccaggatggtctcgatctcctgacctcgtgatccacccacctcggcctcccaaagtgctgggattacaggcatgagccactgcgccccgccccaagtccagtctctaaccccagagatgggccctgcctgtttgggttctttttttgttttttgtttttgtttttgttttgacacggagtctcgctctgtcgcccaggctggagtgcagtggtgcaatctcggctcactgcaacctccgcctcctgggttcaagcaatcctcctgcctcaacctcccgagtagctgggactataggcacgcgccaccacgcccggctaatttttgtatttttagtagagacggggtttcaccagattggccaggctggtcttgaactcctgacctcatgatccgccagccttggtctcccaaagtactgggatgacaggggtgaggcaccacgcccagcccctttgggtttttaaattgttcattcatggccaggcatggtggctcgcgccggtaatcccagcacatcgggaggctgaggcgggcggatcacgaggtcaggagttcaagatcggcctggccaacatggtgaaaccctgtctctacgaaaattacaaaaaaaattagctgggcatggtggtgggcacctataatcccagctacttgggaggctgaggcaggagaatcacttcaagccgggaaagggaggttgcagggagctgagatcacaccactgcactctagcctgggcgacaagagcgagactccgtctcagaaaaaaaaaaacaaaaaaaccataaataaaaaattttttaaaaaatgataaatgtttgcaactctagctatgttaatgtctgatcagcacacattgtatgtattgaaacgtcactatgtaccccatgaatatgtacaattattatgtgttctttttttttttgagacagagtattttgctcttgttgcccaggttggagtgcagtggcacgatctcggctcaccgcaacctccgcctcccagattcaagcgattcccctgcctcagcctcccgagtagctgggattacaggcacccgccaccacgcccggctactgtttgtatttttagtagagacggggtttcgccatgttggccacgctggtctcaagctcctgatgtcgtgatccgcccgcctcagcctcccaaggtgctgggattacaggcgtgagccaccgcgcccggcatgtgttcatttttttttaaaaaaaaaaaaggataaaaaggccaggcacggtggctcacgcctgtaatcccagcacttttggaggccaaggctggtagatcacttgagcccaggagttcgagaccagcctggccaacatggtgaaaccccgtctctactaaaaatacaaaaaaattaaaattaaaaataaaaacaaataaagaaaagataaaaagaaagccaggcctcttggcaatgaaagctgcccggggcagccctctccctcttcctggtgcaggtgtgttgccagcgtggatgtccttcgtggacgtgaacttattttacaaaagagcacttgtccagagctagtcctgagcctgcggtttctgggagtcaccagctcgaacgacgcaggacaagtacactttggggtggcacgtcctggtgctgttattttggggtggggtgtccttccgtggtacggctggaccacgttgcctctgtccactcactgccctcgagggatgggtgagctgtttccacctttggctgccgtgacctgggctgctgtgaacttcgcagacgtttgtgtttctttcccgcacggaaacttggacagaagctccttgtcacgtcccacagtcacacggcccctgcacgtgcttaaaagaagctgtggtgtttttttttttgttttttttttttttgttgttgttgtttgcttttttttttgagacggagtctctgtttccaggctggagtgcagtggcgcaatctcggctcactgcaacctcctcctcccgggttcaagtgattctcctgcctcagcctcccgagtaggtgagattacaggcacccaccaccacgcccggctaatttttgtattttcagtagagatggggtttcaccatgttggtcaggctggtctcgaactcctgacctcaggtgatccacccgcttcggcctcccaaagtgctgggatgacaggtgtaagccaccgtacccagcggaagctgcgattttccttattccttgacatcctcaagggagaccctgatgtagaggcagggaggctaggaaggaggaagcatccagcccagtggggtggacccgtcagaaatgctcagaggcggccgtgcatggtggctcacacctgtcatcccagcattttgggaggccgaggcgggcggatcacctgaggtcgggagttccagatcagcctggccaacacagagaaaccccgtctctactaaaaatacaatgttagccgggcgtggtggcgcatgcctgtaatcccagctactggggaggctgaggcaggagaatcgcttgaacccgggaggcggaggttgcagtgagccaagattgcgccactgcactccagcctgggcgacaagagcaaaaaactccatctcaaaaaaacaaacaaaaaaatgctcagaggcaagggttgagcttcctctccagcctcctccagaggtcacagggcaccgccccaccccacccaccccacccactgggtcctggggtgactccaactggacagagatcagtggaggccaggccaggctggtgtttggtgagctggagccacgccccggggagagagctaatctctgagcccggacgtgcctcatcagtggttccctcctgctgtgctgagatgtccccaccccagccccggtgagtgactggggacttagagacacagaaccagccaccagcaggaggctgacaccctgtgtgggacacgcagtgccctggaagcctccacccctccgtctgtgttttcgtggttttttttttttgagacagggtcacccaggctgcagcgcagtggtgcaatcctagctcactgcagcctcaaactgctgggctcaagcaatccccttccctcagcctcctgaggagatggggctacacgtgtgcaccaccacgcctggctaatgtttgtaattttgccgagatggggtctcagtatgttgcttaatggagtctcaaagtcctaggctcaagtgatcctcccgcctcgacctcccaaagcgctgggatgacaggtgtgagccactgcgccctgccagccctcgctggttcctcctggtgtaaaagggaacagccgagtgagcatctccgggtggccggtgggcagagctctggtctcaggtggtttaaactggacaggtgtcacccgggagcttgacagtgacgtgggaccacatgctgggtgacttaaacaacagaaggcagcccctccccgtcctggggcccggagtctgaggtcaaggtgtgggcaggcgccgctctctgagaggccccacggaggagtcctcctgccttctccagctccgggggcgccaggcgtccttggcttgtgtccacattgctgcagtctctgcctctgtccccgcagggacgtctccccatgtctcagtccaaatgtccctcttctgatgaggatgccagccattgcctcagggccacccttacaactttatcctaactacctctgccaaataaggccacattctgaggttctgggtgggcgtgagttttggggggcaccgttctccctgggaagacgcagacgcttgtcgtcccgtggtaaatgccagaaggcctcatctgatgcccacgtacgccctgaggtggggaagctgctgtcctcatccttgctgagcgtggggccccaggattctcaggcagctggatgagcctgtggagaggccggtgcccaggctcggtcccagaacaaagcgcagaggcacgatggtcgctgacaaagtgggggccccgggaccccaaacagaaaggtccacaaaggctgaggtcggggcaggggaatttgattcaagagacattttcagccatacggcccttctcgaatttttttttttgagacagtctcgctctgtcacccaggctggagtgcagtggcgcaatctcagctcactgcaacctctgcctcctgggttcaagcaattctcctgcctcagcctcccgagtagctgggactacaggcgcccgccaccacgcccactaattttatatttttagtagagacggagtttcaccatgttggccaggctggtctcaggtgatccacccgccttggcctcccaaagttctgggattacaggcatgagccactgtgcctggcctttttttctcttttttgagatggagtctctctctgttgcccaggctggagtgcagtggtgcagctgactgcaacctccgcctcccaggttcaagcgattctcctgcctcagccttccgagtatctaggattacaggcacgcaccaccgcacctggctaatttttgtatttttagtagagacggcgtttcaccatgctggccaggctggtctcgaactcctcaccttaagtaatccgccccacctcggcctcccaaagtgctgggattacaggcgtgagccaccacgcctggccccttattgaacttgatggtttctccttcgtatctcagaagtcacaagctggaggatttaggtttgaagaatcacgatgccaaggtcaggcgccgtcgctcacgcctgtaatcccagcactttgggaggccgaggtgggcggatctcgaggtcaggagatcaagaccatcctggccaacacggttaaccctgtctctactaaaaatacaaaaaattagccgggcgtggtggcgggcgcctgtagtcccagctactcgggaggctgaggcaggagaatggcgtgaacccgggaggcagaggttgcagtgaacagagatcacaccactgctctccagcctgggtgacagaatgagactgtgtctcaaaataaaataaaataggccgggcgcggtggctcacgcctgtaatcccagcactttgggaggccgaggcaggtggatcacgaggtcaggagatcgaaaccatcctggctaacatggttaaccctgtctctactaaaaatacaaagaattagccaggcgtggtggcgggcgcctgtagtcccagctactcgggaggctgaggcaggagaatcgcttgaacccaggaggcggagcttgcagtgagccgagatcatccagcctgggtgacagagcgagactctgcctcaaaaaaaataaaataaaataaactctgaaatttaaattaactgggtatttttatttgctaaatgaggccctacagggggtggtcctgaagaccctctccttggcagataaaagaggactgggatcttcttgcttctggggccagaactgagcagagcaggctcgggggttttgggtcgggggcaagggggtccctggctctgcctgagggtcagggaaggctttccagggaagggaccaggaaacagggtgttgaaggcggccacaggctttattttgtaaacaaagaccaagttcccaggagaactgacctcaggccagattggggccttgccaggggagggctgcggagggggcaggaattgggccaggccctgtggttgtttacaaccctggaggggctttgaaggcagctggccctgctgggcctcatccgcgtctgtgtcctcgttctgcacgtagcttcagaccctccccctccaccccccgcccccatgaggactttccaagcctgtggccccccaggtgggagctctttggcaccggtggttctgaggctccaagtcccctgatccgaagccatccccgagagggggtctcccagagtgggaagcgggggtctcccagagtgaagccctcagccccgtccaggccctcggcccccagcatcttcccaccctggctgggcccagccttcgccctggatggggttttctgcccctgcccaccgtgtgctggcccctcggttacgcacatcaccctatttatttatttagagacggagttttgctcttgttcctcaggatggagtgcagtggtgcgatcttggctcactgcaacctccgtctcccaggttcaaaggattctcctgcctcagcctcttaagtagctgggactacaggagcccgccaccaggcccggctaattttgtatttttagtagagacggggtttctccatgttggtcaggctggtctcgaactcccagcctcaggtgatccgcccgcctcggcctccgaaagtgctgggatgacaggcgtgagtcaccgcgcctcatcccctcctcagccccccagcacccacacgtcccctccctgtctctgtggatgggcctgtcctggacatttcatagacatgggatcacacagtgtgtgtccttctgtgtctggcgtctctcactgagtgcgacttcctcaaggtgcatccgcgccgtgggctgcgtccgagcctcgctcctgttcacggctgagtcgtgtcccattgcgtggatgggccatgctgtgtctgtccattcattctctgtttttgtttgtttgtttgtttttgagacggagtctcgctctgtcgcccaggctggagtgcagtggcgcgatctgggctcactgcaaccgccgcctcctgggattacaggcgcccaccaccacccccggctaatttttgtatttttagtagagacggggtttcaccctgttggccaggctggtctcaaaactcctgatctcgtgatccgcccgcctcggcctcccaaaagcaaccattttatttgtataactgtgtccaaattgttagaaataagtgctgggtcccgcaaagagaaaccagcccttagaaacctatttcccagcgagacaactttactatacagaatggggctgccccggagctcacgggacgaaggaaggaaggagcttctgttcccccgctggctggggctggacgccctcatctaagctcatcccggttggctaagacttaaaactgtctccaaatcgggtaaaggcaagatttgcgagaagaggagggctagggggaagaagggggtagggttgattgacaacttatgacctggaagttgagttttgtaagaggaatttggttgtctcaacaatttactccttttctgttttatacttcttcctcttcaaatttatttatttattttgtttgagacagagtctcgctctgtcgcccaggctggagtgcggtggcaccatttcggctcactgcaagctcggcctcccgggttcacaccattctcctgcctcagcctcccgagtagctgggactacaggcgcccaccgctacgcccgcctaattttgtgtatttttagtagagatgggggggtttcaccgtgttggccaggatggtctcgatctcctgacctcgtgatctgcccacctcggcctcccaaagtgctgggattacaggcgtgagccacggcgcccggcctagttttcttttttttttttttttttgagacggagtctcgctctgttgcccaggctggagtgcagtggcgcaatctcggctcactgcaacctccgcctcctgggttcaagcgattctcatgtctcagcctcctgagtagctgggattacaggcacgtgccaccaaacccagcttatttttgtattttggtagagatggggtttgaccacgttggccaggatggtctcgaactcctgacctcgtgatccacccacctcggcctcccaaagtgctgggattacaggcatgagccaccgtgcccggccttcaaatttctttaacaggatttggctttgttgttcttcttgatcgtctaggaacaagagcttatcggaatacagagcaggagaggtaggggaggtttttgtgagagctgcttctgtgagtctttgggttaacccgcgaatacaaaggtatgacacagcagcccacaggatgagtcctcctgtagcaattgcgagggaggtaaagattgaggtcagcccgggcgcggtggctcacgcctgtcatcccagcacttcgggaggccaaggcgggtggatcacaaggtcaggagtttgagaccagcctggccaacatggtgaaaccccgtctactaaaaatacaaaaaaattagccgggcgtggtggcaggtgcgtgtaatcccagctacttgggaggccgaggcgggagaatcacttgaacccaggaggcggaggttgcagtgagccaagatcatgccattgcactccagcctgggcgacagaacgagactgtgtctcaaaaaataaaaataaaaatgaagaaaagaacaaaaaaaagattgatgttatgagtcccttccattttccaaaccacctttccatcagtcccatcaaggggccatctattccagagtttatggctaattcatttgttaggtcggtaaggccctgtcaggctttcgagatggtcccatcagggcctgtattatctgggatcgaagtaacgatgcgctttatttatttatttatttttttgaaacggagtttcgctcttgtagcccaggctggagtgcaatggcgtgatcttggctcactgcaacctccgcctcccaggttcaagcaattctcctgcctcagcctcccaagtagctgagattacaggcgcccgccaccacgcccggctaattttttgtatttttagtagagacggggtttcaccatgttagccgggattgtctcgatctcctgacctcgtgatcctcctgcctcggcctcccgaagtgctaggatgacaggcgtgagccaccacgcccggccggtttgtgactattttctctaactttacctaatgtttccctttaatatttctgccaccatcctgagcgaatttcaacagggaatggcaccccagggtaccggttactacaagggctgggccaaggattttcttcagaagaggctgtctttggctgtggatatctttacggggtatatgaaccagacaggcatcaaacgaaactagctggggaaagggtgatcaccttatattgataataagacgtccttgggcggctacagggagaaggaagagacagattaaacctttttgaatgttaatttggaaggcgttgatcctggagtgaaggtccaagatccctccagggatggggccctttccgaccgtcatcttggtggtcaggagcacccgataaagtccttcccaggttggctgagtttttcctctttccaacttctgacaaggaggtgatccccaggctggtgtcggtgaactgggaattcgaggggtggaggccttgggtccggagggaggaaagggtggaagacaaaccacacatatagtttttgagaaactgatcttttgtttcaaatgtaggaaggtcagtagtggaagtcagataaggtagcccatagagcatctcataagggaacaggccaagatctttccgaggggcagttcgcattctttttttttttttgaaacggagtctcgctctgtcgcccaggctggagtgcggtgggcgtgatctcggctcactgcaacctccacctcccaggttcaagcaattctcctgcctcagcctcccaagtagccgggattacaagcgggcgccacgacgcctggctaatttttttgtatttttagtagagacggggtttcaccatgctgcccgggctggtctcaaactcctgagctcaggcggtccacccgcctcagcctcccaaagtgctgggattacaggcgtgaaccaccacgcccggcctgttcagattcttagtaaggcaaagggaaggcattctgtgcgtggtaaccaggtttccaagattaattcggttaggtggtttttttagagtttgattcattctttctaccctccctgatgagggtggatgccagggaaatattcccatttcattcctagtgctggggttagccccgtaatgatgtgtgcagtgaagggggtccccttgtccgaatccacgttctctattagtgcaaacctgggtgtgacgtgttcccacaggcctctgactacattgctggctgttgcgctcgggaagggggtggcctctacccagtgggtgagatggttgactgttcccagtaaatgtttgaggtgggctattgggggcatttcagtgtagtcaacccaaacactttggaacggcctcaaccctgggtttcttccctgggaggttgcctcttttttttgagatggagtcttgttctgtcacccaggctggagtgcagtgggaccatctcggctcactgcaagctctgcctcctgggttgatgccattctcctacctcagccgcccgagtagctgggactacaggtgcccaccacacctggctaattttttttgtatttttagtagagacggggtttcaccgtgttagccaggagggtctcgatctcctgacctcgtgatccgcccgcctcggcctcccaaagtgctgggattacaggcgtgagccaccgcgcccagcctggaatggcctcaaccctgggtttcttccccgggaggttgcctctttagggtttgcttattagcttttctgcacacgatgcaaccatccacatttgcctagcgagggtctctatcccacacacccacagactccaagggtctctatcccacacacccacagactccaagggtctctatcccacacacccacagactccgagggtctctatcccacacacccacagactccgagggtctctatccccacacacccacagactccgagggtctctatccccacacacccacagactccgagggtctctatcccacacacccacagactccgagggtctctatccccacacacccacagactccgagggtctctatcccacacacccacagactccgagggtctctatccccacacacccacagactccgagggtctctatcccacacacccacagactccgagggtctctatcccacacacccacagactccgagggtctctatcccacacacccacagactccgagggtctctatcccacacacccacagactccgagggtctctatcccacacacccacagactccgagggcatatatcccacacacccacagactccgagggtctctatccccacacacccacagactccgagggtctctatcccacacacccacagactccgagggtctctatcccacacacccacagactctgagggcatatatcccacacacccacagactccgagggtctctatccccacacacccacagactccgagggtctctatcccacacacccacagactccgagggcctctatcccacacacccacagactccgagggcatatatcccacacacccacagactccgagggtctctatcccacacacccacagactccgagggtctctatcccacacacccacagactccgagggtctctatcccacacacccacagactccgagggtctctatcccacacacccacagactccgagggtctctatcgcacacacccacagactccgagggtctctatccccacacacccacagactccgagggtctctatcccacacacccacagactccgagggtctctatcccacacacccacagactccgagggtctctatcccacacacccacagactccgagggtctctatcccacacacccacagactccgagggtctctatccccacacacccacagactccgagggtctctatcgcacacacccacagacttcgagggtctctatcccacacacccacagactccgagggtctctatcccacacacccacagactccgagggtctctatcccacacacccacagactccgagggtctctatccccacacacccacagactccgagggtctctatcgcacacacccacagacttcgagggtctctatcccacacacccacagactccgagggtctctatccccacacacccacagactccgagggtctctatcccacacacccacagactccgagggtctctatcccacacacccacagactccgagggtctctatccccacacacccacagactccgagggtctctatccccacacacccacagactccgagggtctctatcccacacacccacagactccgagggtctctatcccacacacccacagactccgagggtctatatcccacacacccacagactccgagggtctctatccccacacacccacagactccgaggctgcattgcacgtagcttggggacccgagtgagctccttgatgaagctctgacagtatttccctcatgaggggtttagacagcatttcccttcaatcctacttgaagggaaatccctacagagggaaagtggtacctactttccctctgggttctcctgagctcctatatccctcccaccctcccttccttcctgatggagtctcgctctgtcgcccaggctggagtgcagtggcgcgatcaaggctcactgcaacctccgcctcccgggttcaagcaactctcctgcctcagcctcccgagtagctgggactacaggcacccgccaccacacccagctgatttttgtacttttagtagagacggggtttcaccagtgttggccaggatggtctcaatctcctgacctcgtggtcactcacctcggcctcccaaagtgctgggattacaggcgtgaaccaccacgcccggcaacaggaggatttttattaaggtggtcaccggctcactggattcgcatccaaagactgagcgtggggccgggcgcagtggctcacgcctgtaatcccagcactttgggaggccgaggcgggcggatcacgaggtcaggagatcgagaccgtcctggctaacacggtgaaaccctgtctctactaaaaatacaaaaaattagccgggtgtggtggtgggcacctgtagtcccagctactcagagaggctgaggcaggagaatggcgtgaacccgggaggcggagcttgcagtgagccgagatcgcgccaccgcactccagcctgggcgacagagtgagaatccgtctcaaaaaaaaaaaaaaaaagactgagcgtggaacaaagggcttgactttgaagcgtgcagcggcgtgaaacttgcagtgcgggaaagtgaatttacagacgcaggacagaggcagttaatcgtacagtgacaggtttcgtaacctcagccgagcttgtgagcttgcggccgcattgagaaagaacaggagcttacaaaactggcagagtattttacggggagcgggaaacggaaggaggagtctggttcttatctttgcacggggggagtgcagtgctgggaggcgtctgggcggcattccttggggttctggctttttaaatggtgttttcaaggccttgcctgggggctttgcctgttgctggctttggggcgagtcagctttatacgaaaaaggtattttccgtttcttcaatttccgctttattccctccttgatgctttttataaataaggtttaatagaaagcatcactattttttatttacttctacagggggaagtagctcttttcctggcaggggtggacacgtagttatgggatgagctcggtggtactcggcctgtccacacgagcgtctctggctttgtcgatattcttgacaaggaggggaagagacaagagtacgaggcggactcccagtatggccagaactactcctagtaaggttttaaatcccccgagggatgaaaaccaaccacgggggggcggggggaacctggagaccattccggtttccaggtttgtgttggaacatgagctaagtctcgcattctcgcaattaattcatgacgtcctcctcattgtcatcgatttttaggcaacaattagttaaattaaactctccgcatatccctccttctgacatagatctagcgagagcagcaagaacaaagggaagagtagcatgtttgtacctaggatggacaagagatgtttgcccagaggagggggttgagcaaagcgacaggttaatagtaaaacaattaagatgacaaggaaaattactgggcttaagatttctaactacatttacttccttgacgaagcttcggccgtgcgtagactggtcagcttccggggtgactagagcagggctgtggtcactttcactggcatctgggtcctgtcgtaggatcagccggtttggatggtctgggtcttgctggctggtccacttgtcctgggctgctggtttcagccgactgtggagatcgaaggcacagttcctgaaacattaacagcagtgggagtggacaggatcgcagtctaggcccatcccatctgggtcccaaagtggttggattctatttctttttttttttttttgagacgaagtatcactcttgtcccccaggctagagtgcagtggcgcgatctccggtcactgcaacgtccgcctcccgagttcaagcgattctcctgcctcagcctcctgaatagctgggatgacaggggcacaccaccacgccccgctaattttgtatttttagtagagacagggtttcttcatgttggtcaggctgctcaaactcccaacctcaggtgatccgcctgcctcggcctcccaaagtgctgggattacaggcgtgagtcactgcgcccggccgatcttctttcaatatactttccagtttcttgggcaaactaagcttttttgtttggagaataacgtgggacctctgggaggggaggctccgggaggagaggcacagccagggcttcctctttagaatgtggtgtccttattactgcccgttttgcctcctcgtctgcctttgtttcctttggcctccagtgttcctgccttttgtgcaccctgcaacgcagaacagctacgtctttggggcccacacggcatcctggagctgtaaaatttctttttttttttttttttttcatatggagtttctctcttgttgcccaggctggagtgcaatggcacgatctcggctcaccgcaacctccgcctcccaggttcaagcgattctcctgcctcagcctccctagtagctgggattataggcacctgccaccgcgcccggctaattctgtatttttagtagagatggggtttctccatgttggtcaggctggtctccaactcctgacctcaggtgatccgcctgccttagcctcccaaagtgctgggattacaggcctgagccaccacgcccggcctaggagctgtaaaatttcttctttgtattttatttctttgcccccagcagttaaaagttctctttcttggctgggcgtggtggctcatgcctgtaatcccatcactttgggaggtggaggcaggcggatcacttgaggtcaggagttcaagaccagcctggccaacaaggtgaaaccccgtctctactaaaagtacaaaaattagccaggcgtggtggcgcgtgcctgtagtcccagctactcaggaggctgaggcaggacaatcgcttgaacctggcaggtggaggttgcagtgagccgagatcgcaccactgcactccagcctgggcaaaagagtgagactccatctcaaaaaagaaaaaaaaagttcctctatgggatggtctttccaattttcttttttctttctttcttttttttttgagacggagtctcgctctgtcgcccaggctggagcgcagtggtgcgatctcggctcactgcaagctccgcctcctgggttgaggccattctcctgcctcaggctcccgagtagctgggactacaggcgcccccaccacgcccggctaatttttttgtattttagtagagatggggtttcaccgtgttagccaggatggtctggatctcctgacctcatgatccgcccacctcagcctcccaaagtgctgggattacaggcgtgagccggcagctgcatattttcttatctgtttattaagtctgtttaagaattccacgggcctggccaggcgcggtggctcacgcctgtaatcccagcactttgggaggccgacgtgggcagatcacaaggtcaggagatcgagaccatcttggccaacatggtgaaaccctgtctccactaaaatacaaaaaattagccaggcgtggtggcgggcgcctgtaatcccagctacttgggaggctgaggcaggagaatcgcttgaacccgggaggcggaggttggagtgagctgagatcgcgccactgaactccagcctgggcgacagagcgagactctgtctccaaaaaaaaccccatgggcccttcatgtttcctctgttgtacgttaaatgctcgggaagtattttgggtttgcagatctgattcccgaatccttgtaattatcccatctccgagatcgctcatgttttttaggtcacattgtcatcccacccaggatcttgggccaggaatttacgctccgctgaaaggacgttctgaccggggggtgttcacgctcccagactaacacagcggcctgtgaatcatggttctctctctcctgagacgagagtactgagggtagacattaattcagcccaagcgtacagctgtggccccagaaattggtcaatttgatccgcgaatccaaaagggtcatctaacagtggtttgagttcttttagatttctaacctctgaactggttaaagggggcatttacgaagtcaatatcccttcctcccggtggtccttccctaaaggggaaaagggctgaggcaggtctttttgagcaggaggcaaaaggaaagttctgtgggtttttgtttgtttgtttgttttttgagacggagtctcgctcttgttgccgaggctggagtgcggtggcgcgatctcggctcactgcaagctccacctcccgggttcaagacattccctgcctcagcctcccgagtagctgagtagctggaattacaggcgcccgccaccacgtccggctaattttcgtatttttagtagaggcgaggtttcatcatcgtggccaggctgccagtcctgaactcctggcctcgtgatccacccgcctctgcctcccaaagtgctggaattacaggcgtgagccaccgcgcccggccgaaagtttcgaatatccctttggcattgttctgtttcccgttggagctttcctgaggaaggggcatgttctagtggctgtccagcggggatgtgggtggcaaggtccaggtggttctataggggagggatggaggggcggaggagcgggtgggggaggggcggaggggcgaggggtgggtgggaggggcggaggggcgggttggggaggggcggaggggtggggtgggtgggtggggggggcggaggggtgggttgggaggggcggagggggtgggttgggaggggcggagggggtgggttgggaggggcggagggggtgggttgggaggggcggagggggtgggttgggaggggcggaggggtgagtgggggaaggtggtctagaggatcccacccttctttagatatggggcgtctctgctaaaaatacaaaaattagccgggcgtggtggtgcgcgcctgtaatcccagctactcaggaggctgaggcaggagaatcgcttgaacccgggaggcggaggttgcagagagtcgagatcgcgccgctgcactccagcctgggtgacacagcgagactccaacacacacacacacaaaagatatggcgcgtctcattcattcacaagttcctcttcaaaggtttggctcgttcagcgccctcgttcttcgtttcctacttccaaggccaacctgacttcctcaccctctgggcctccccgtctgagtctcagtaaacaagtttcccgccggtcctgatctgcagagatggcacctgccacccactctgcacatccccctcccgtcgccacgggctcttcccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaaggtaaccgccagcctctcctgaaacagaatgggatccaaatgggatatttgggggcggcgagtcggtcccgcaaagagaaaccagcacttagaaaatttctcagcgagaccactttacttgtacggaagggggctgcctgcgtgggatgcaatctccagagcacacgggacaaaggaagggagcttctgttcctctgtcctttccctgttggctggggttggacgcccacaatctaagctgatcccggttggctaaaacttaaaacttttttaaaatagggtaaacgcgccacctgcgaggaaagaagaagggggtaaggttgattgacaactttagacctggaagttgagtttctgaagaggaacttacttgtcccaaccaaatggtgcacaggacgtttatactaagaaattattcattttctgagatccagattcaagtgccctttaagtatttttatttgggcggaggaggtcacttcctcccacctaatttattaatacgttcatatatatatatatatatgtacatttttaaaggcagagatgtgcgtctcgccatgttgccgcgtctggtctcgagctcccgggctcaagcgatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctggtgaggagcgggtagggggcgggggtgcggtcctgcaggggccgggaatggaggccgcggtgccgacccgaagccgacgggagcctggggcctcggcgcggggcggcctggggtgcgaaaggccggccccgggggcttcccgcgccagcatggagcttgggggtgaagtcccagggtttgaggggggactagaggttcctcccggcgcggcctgccgggctcccccgggcgctccggcctcgagcccggcctctgtgtgtgggcgtgaagctccctgcttggaggcgggagccagggggtcctggccaggccggtcttggtcaggggaggtgggcgtcttgcttttcggtcacctggggttgggggtgacctgcttcctgggtgagggcgtctgcgaaggcggttggaggtggcccgcccgccggtcccatcggccaggagaagggagacccaaagcctgggtgagcgtcccctttggcctggagccaggggtcaggggctggttggtgcctgcccaacccgtcctgctggggctggactccgcaggacctggggaaagcggcctgggcgtggaatctggagacgggtccaccctgcctgcgagtgttagggtcagagaccctcccctgagactctctggggcccccgcaagggcccgtgcggcctggagcgatcatcttggcgctcccttctggaaaaggggcttttgtcctccaagagcacatggaggctctgagtgggtcagccctccggatcgggaagggattaccgttcttcacgggatttagccctggcgtcttgcctagggcgtgcacctgcccccgggtgttctcccagactcttaagacctcgcaggctccctcgaggggccctgcgtggaagggaaggcggaatctccctctgattctgcctggattcagcacccagaatgaggtggtctctgaacgcccctcctcctttacaggcgaggaaacagccctgtgggaagtcgaggttccaaggtcacagtgagggggccctggccacccgattcagcgcaggaaatagtgagaaagtcgtttttagccgactctgacccgcattcggtttccagtgctgtcttaggagggccgtgtgttgagggtgggcaaacgtggtttggagagcgcatttgggaaatggattgaggtgtgtttttccgggagaaaagcatgacatcctttcttgcttcatagaaaatttcttcctttgttgagacccccatttggttctgggttaaagatttatagtgaggccgggcgtggtggctcacacctgtaatcccagcactttgggaggctgaggcgggtggatcacctgaggtcaggagttcaagaccagcctggccaacatggtgaaaccccatctctactaaaaatacaaaaattagctgggcgtgttggcgcacgcctgtaatcccagccactcaggaagctgaggcaagagaatcgcttgaacctgggaggtgaaggttgcagtgagctgatatcatgccactgcactccagcctgggtaacagggagactctgtctttaaaaaaaaaaaaaaaagaggtcgggcatggtggctcacgcctgtaatcccagcactttgggaggccgaggcgggcggatcacgaggtcaagagatcaagaccatcgtggctaacacggtgaaaccccgtctctactaaaaatacaaaaaattagcctggcgtggtggcgggcgcctgtagtcccagctgctagggagtctgaggcaggagaatggtgtgaaccagggaggcggagcttgcagtgagccgagatcgcgccattgcactccagcctgggcgacagagcgagaccccgtctcaaaaaaaaacaaaaaaaaaatttattgtgaccgatgtgttgggaacaaggtgcagagctggagggtctggcctcctgaagggtcaagagcaagggcttcgagcctctgtcctgggcattgagccgtagggggccttgggcagaggctggggagggggctccttcttccagaggctttgccagctaactcctgacctacgtctgagatttcgtcttcctggtaaccaaagtggccctttatcgaatgtctcctgggcaagggcctggccccagcactgcggccagctctctggggagacacagataggagcccatgggtgaggtgagcgcggaagataagccgcccccgccagccctgtggaaacccagccaggcctgactgggtttcaagcacagcacgaggttcccacattgagctaatttggacagccaagtgggtgaaagacctttggtctctccctgctgggtagggtggttcacagttttgttccttttgtgcatttgtgcaggagactgagaagggtttcttctgagcagaaagcttagcctggggcttactggccagagctgcctgcagcctgggaagcaggtggagtctgcagtgctggcagcgccgccgtgcagcggtgtagccgtgtgtgcgcgtgtgtgtgtgtggtgagaaaccccacttttgctggggactgactcgtgaagaccacaaggtctgggcaacacagccttggcccgtgtggggtggacactgctgtttgctctgtgaattcgtgactgtgtttgcctctcctgaaacttgcttcaggggcgtctgcgggttggtggggcacagccgggtggggtgagtgcccaaggttggccgtccgcgtctcctgtgggcttgtcggggaccggagggccggggtgtgctagctgggtcccgagggtggagggcttcacccccgagcctcagatgagaggagtgggagtgcctggctgcggccggtgggggtgggtgggggaggtgcccgaggctgcttcccagagctgttctcgctggctgctgtctgagcactggggtgggtggggaggagggcgggtgggggcgggcagccttatcctgcggggctgcttgtgtacaagtaccacgcggcctgcctggccctgagccctgggcaaggaggcggaggctgtttttagatgaaggtgactttacttgagaacatgggttacgtctcatgtggccagaatcgaattctaacctttctggggctgtggccgagggtcaggcgccgtccctcctcctgctgctcatgggtggaggctcctggtgcggcgggcgagatggggtggtccgtggggtgggggcgctctgcattgtccccgaggagcctctatggaggctttctcttccggacgcccccccacccccagtgacacgtcaatacacagacaccagcatcatcagcatccggagggacacagggttgttccatccaaagccttttggtccctttgggagcgatgctgcccgctgagaagctggcggacccagcgggagcaccgggaccggtgcagatggcgcctgggagcccgggactcctggaaaggtggctgggggcagctcggctgcgggccccacctggtcctcctcactttcctgtgtgccctgccctgcctggaggtggggtgaggtgagtcaggggccagccctctcctagcacccctgggtgaggaggatgtggagcccagccctgcaggtctggaggatgaggagaggggctgctgcagggcaggaaggagcttgccagctgggcagcctctggctgtgcttcctgccctgactcacctcgcccagctctgcacatagctgccagtgttgcagtctgggaaatcttaactcccaagaaatgtaggttaccaggaggagatccctttgtgaaaatggcactgccagccaggcgcggtggctcacgcctgtaatcccagcactttgggaggcccaagagggtggatcacgaggtcaggggttcaataccagcctggccaaaatggtgaaaccccgtctctactaaaaatacaaaatattagctgagtgtggtggcaggcacctgtaatcccagctacttgggaggctgaggcaggagaattgcttgaacccgggaggcagaggttgcggtgagctgagattacaccactgctgaacagagtgagactctgtctcaaaaaaaaaaaaaagaagaagaggagaaagaaaatggcgctgccaaaacttgtcaactgcgcctgcccagagctcacctgaggtgctcagacgtgaacattcctgtccccgtggccttgggggccgtgacctgtgcactgccacgcagcctcggagccgtgtgcacgcatatgcacgtgtgtatgtgttgtgtgtgtttgcagacgtgtgtccttgtgtgtgtgtgtgtgttgtagcggtgcctggggagtctgacctcagaaggtgctgtggggagggctgcaaggtcctggcgggaggaggcactccccacgcttccccttgggctgggctgttcctggcaggcgagtgctaggcacagtgtgaggttctgtgtggattctgctgtgctccttggcagctctgggggccttcccttgcatttcgaaggaaggggaggcgtgtggctggaggtgagaggccctgaggccctgcctggctcccagcttcccaaatccgcctctctctgggtcgccgccctcagagattgctgaggacacgagctttccacccacgggctgtcctaacggagccgggctaggggcttctggacagaggccgcctgcccctttgggctttggggtttgtttttctcagcagctcacccgggtctctggggtcagggtatcgggcagaagtcagaggacggtgcgcttgggacctgagctctgggcagccctcggggctcaggactcctggctcttctgcccagtttcatgtgttttgtgttttgaaaccacgtgtggtcccacagttgtgccctcagaagccgccgtggctgccgtgaggtagcagtggacgggacgcccacggtctttcccatgccatgctgtttccagccgggccccatcactctcccacaagctgaaaggaagtggcttctccaccagccctggctgggagtcctgtgggcgaggccttccccaggagctgccctcccaagtgccccaggcactaacaagaccccacgcgtgctctccccacagccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacgtgagtggcgggcacctccctccccgcctccctcagtttccctcctgtgccgctcgcctcccggctcctgctcagtagaacccagacgcctcctcccctctccgtcccgctgtgccccgttgggcccaccgcctggacggaggggcccggacctgaagggggtgggctcgccgcctgaccaccagcgctgggcggcctggctcggggcaggcagggctctgccctccagcaggtgggtcctcgtcctcccctcgaccctcgtgccatccgttccgtcgtttctgcttccccgggcgcctgcccggctccctccctgagcgtccatactgcaagcctgaggggccctccaagctcagcccaggcttgcaggtctcagaaccttctgtgtccttcgcagcatctcgttctaagggattttcaaatttcaattcctagcgggaatattgtaaactaaccaagaaccaagagatttgcttggttggggattggcagaagaaccggggtgctcccagcactgctggagtgccgtcagcctggggctggggggatgtggggccacctgagtgcctcctagagaagggcacgggagccttggccgggggtgctgtggctattttttttttttttcctggagatggagtcttgctgttcccaggtggagtgtggtggcacaatctcggctcactgcaacttccgcctcccgggttcaagcgattcttctgcctcagcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcctggacccagccctcaggactgggtgagaggcctagactgggggtcccggacccagccctcaggactgggtgaggggcctagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggtgagccgtctgccctcctgcccacatgccctgctctcggggtggcccagggccactcctggtccgtccctgccagccccaccgctgacccagagcttggaactgaggagccccaggcagggagttgatgggaccccgaaagaaagtgtgggatggagggtctagccccgggcagctgcggctcagtgggcagcgggaccccgggaggaggaggcggcacctccgccccacagcctcacccggcccttccctcccgctcacttggctgcaagccagtgtcctccgtggtgagccggcccttgctgctctgcatgatcaggctcgggaacctgaggtcagccatgctgtgctccggcagcccctgcctgcctcctcgcggagcccttctgccccttgggctgcgtgtgccggggcgaggcctgtgtggggcctgtgatggcagctcctggaaaacgctgtggggcaggggtgaggcccacgaggccatggggacagctcaccatggggagcacacctgcaggtggggagggctgcctttccccacagcactcagaagatgcacgtggccggggctgatgagctgccccgagccacccctgggggtcactgagggcagggctggcagcacagatgcccctgctcggggcctgagtggggccagtgctgacaggctgtcctctcgtcctctttttcatggcggcggtccttcttcagatgacgacgccggctctgcacccctgtaagttccagctgtgggggtcgggggtcccaaggagcggcctgctgccccaggcctttaaaacacaaaggcagagcccctgggcttcagtattcgggggtcctgggggccggggtgggcaggggtgacttggagagagtgacttgcgggggacaccctctcacccggcccctcgtgccccaggaagagcagcgggcagcaccagaatgacaaaggcaagaacgtccgccagaggaactcttcctgaggcaggtgcggtgggcgggagctcctcctgagccaggtgtggtgggtgggtgggcgggaactcctgagccaggtgtggtgggcgggatctgctagccaggtgtgggctcctgggtcccgcctgtgggtcgctgggaggtgggtccagtctgagcgcccctccctgtccacaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaccctctcctggctcctgtctgtgcctgacggggttgggttttccgagagcaggtgcaccctgggctctggtggtcacagcaggggtgcgtccagtactgggatttcacatgcgaggacgggtctgctgagaccgcagtgggtgttgggtggctcggggcatgggctggacagggcctgaggctgtcagccggactgggaacttggaaggtggctggggccgaccccgtgcctcagagccacacagaagagagtgggcactgacctgagccttctctgagcctgttactcctctcggcatgttttgggcctgacaaaggctgaggctttctgctgcctgccctgcagctgcctgcacccacccacctgggcgggctgcttgggcaaggttcaggggtggtcctggctgctcctggagagtgggtgtgtgaagctggtgcccagaggctgagggatgcccagcccctgcccgcccagcacacggaacagatgtggttgcagggctggagagcttgggggaccaggagcttagagcgtggaggttgcaagttgcaggaccagtaactgggtctggagggaggtttgcagcggctgtgtcagccctgcaggccgagtgtggcactgggccttctgctggtctgagcgggggtctcagggtggaggtcagcaaaagaggcttagtgggggcttagggagcctgggtgggttcccagagaagctaggaatcagatgggaagatgggaaggcagtgtgtttccgtgttgggcaaatccagcgttttcatgccacggaagccaagaaagggctcacggcctccggcctcacagggctacgcaaagggggagttgaataaacacggtgacgggccccgggcggcagctgctcccggcactgatcctgctgggccagcggtggacttgcagggcccacatccggagctgcccactggtcctcgtgctgcacagccttggaggatctgaggctggctcagggtccctggcagcaactgccctgctaggtgggggctgctgggttccacagctgggccctccctgccggctgccaccaggcggcgctgcacgcccacgctgagtggggcaggccctggagcccctctgcccgggcagcctgacggcccctcctcctcggctgagaccgcagagtcccaggcatcacccactgaaagtgtgctcagtgacctgtgaatagggatgccacgtctgcgtgcagacattgattaggcgcctgtggtatacctggagctggagggtgtgcgtggacaacaggcagaaaggtccagtgggatggaggctgccaacaggacgatggggaaggggcgcgttggggacatcgccgggcacgcggcccaggtgggcccctggctcaggtctccccccacctccctgcctgggctctgtccatctttctgccgcaccctcagccccaggtgtgggcccaccgtgcttgtggacgcctcatgctctgtaccgggtgggaggtgtgggagttacaggtcagggcagccttgggagacgggcaggtttcctggggtgcttaccggcagatggggcgcctgggtccgtgcagggtcgtccgcccgagaaagcagcccctcacccctgggcactaacttcatcttttttctttgcacacagaaacgtaaacctgattcacaaaagtataaccactcagcatgtagctttgtacacctgccctcagcatttagtgtcctcgttcatccaacaagcatctaataagcactggggtacgcagtggtgggtgtccgccccgtcactgggtgtccagcgtggggtgcggaggtggatgtccaccccgtcggtgggtgcccggcgcggaggggtgcggaggtggatgtccgccccgtcggtgggtgcccggcgcggaggggtgcggaggtggatgtccgccccgtcggtgggtgcccggcgcggaggggtgcggaggtggatgtccgccccgtcggtgggtgcccagcccgatgtccaccccgtccctgggtgctcttggtggcaactcgctgaagcctgcctcggtttccccagaggtgagatggggaagtcaccaccgccaggtcatgagatgagattagatcatccttgccaagtatcaggaaaaggcctcagggctcccctgggaaccttggggtctcaggagtcccagctcccagtgggcaggggtagggttggggcggccagaggaacaagtgtttgttcatgggctggaccccaccgcggccccaaagctgggctgcctattcctgtcctgggcaaattggcctctcctccctcttaccccccaccccagtgggagcccacaaggacagggcctgccccatcccctccactctgggctgtggctctaagcagcacgtcccactctaggggctcagggcagggacagtgactcatccaaggtcccgccgtggagggcagagctgaaggagtgagaaggagctgctgacatggaactggcccgtgcggaaagactttggtcttccccatatttttcaccaggctcctggggcaaggtgagcccagcagggagaaggaaacttgtgtgaatcccaggccagcaggactgggggccctgctctcatcgcagacgctgcagacacggaggcctggggcaggggccctcagggctgtgctcctgcagagatggagcttgcgtgtgtggctgagactgggatgccaccccctttcctaagcctctgtttcctccgctgtaaatgtgggcccaggcctgccatgcacagctcatctctttaattttcttttttttttttgagacaagggtctcattctgtcacccaggctgtttgtgcagtggtgttgatctcggctcgctgcagcctcgacctcctgggctcaagtgatcctcccacctcagcctcccaagaacctgggaccacagatgacacgcacccctccccctggctcgtttagtatttattgagtcaaactgcagattttccaggcgggctcagtgcctgccctggcctgattttgtcttcctggtcttaaactgcttttcactccaaaggccccaaaattgtataagctttcagggcgtgcgacctggacctgtcctgactaagtgggaaatgtaggtccgaggttggtaaatccggtaaacaatgccgagagaggctgcagggggcggggagatggggaagaccctggggagggaatggcagggcctggggaggttcagcgaggaggggtctgggagttcggggtccagtgacccaggcacacaaaggccagactcgggcggaggagtacaagctgctggagggacccgggctttcttccaaaggcactgggagctgtgagtggttttaggccacagaccgatgtgactgactgaggggccaggccctggggctccatgctccctacacaagccaggtgcggtcccacctcaggaccctcgcacaggctatgccgcctgcccagagcttcctgcagcttcccgggccgcaccccctccttcaggccttctcccagcacctggccccctccccaccctgagtgtttggacaatgctcaccaccttctgctggacagtatcttacttgctactcataaggttgactgtgatacccagctttctcccctggctggctctctgagtcagctgtactggcctctgagtcaatactcggcctggagtaggtgcttaataagtttttgttgattttttttttttttttttttgagacagagtctcgctgtgtcacccaggctggagagcagtggtgccatcctgactcgctgcacctcccaggttcaagcgattctcctgcctcatcctcctgagtagctgagattacaggcatgtgccaccacatccggctaatttttatattttttattagaaacagggttttgctatgttggccacgatggtctcgaactcctgacctcaactgatccgcctgcctcggcctcccaaagtgctgggattacaggcgtgagccaccgcgcccggcttttttttttttttttttctgagacggagtcttgctctatcaccaagcgctggagtgcaatggtgtgatctcagctcactgcaccatctggctcctgagttcaagcgactctcctgcctcagcctcccaagtagctgggattacaggcgcccaccaccacgcctggctaatttttgtatttttagtagagatggggtttcaccatgttggccaggctggtctcaatctttaaatattttttaaattaaaataaatgagcatggctgggggggtggctcacacttgtaattccagcactttgggaggccgaggcgggtgggtcacctgaggtcagcagttggagaccagcctggcccaacatggcgaaaccctgtctctactaaaaatacaataattagccgagcgtggtggcaggcgcctgtaatcccagctactccggaggctgaggcaggagaatcgcttaaacccgggagtcggaggttgcagtgagccgaggtcacgtcactgcactccagcctgggcggcgacagagcgagactccaactcaaaaataaataaatacataaataaacagataaatacagagtactccggcctgggcaaggggtcagagtgagtgtgccgaggccagggagggtccccgtgcacactgacaggcgctggcctgggtaagcctgtgggctgcagagccgtcgccaggatctggtgacaaggaccccgagccacagcctcccttgtgacttgcgggttctgccggcgcctgcaggaggcgtctttctgcttctcccactgccaggcatgggcggttctcgtgccgtgcgggtcccgcctcctccctgctcccagccgcgagccctggggctctggcgacctgcccggcctgacatcttcccagggtgaacataaaagaacccccttcagctggagcacgcatctgcctcggggcgggccacagcctggcactgccaactgtgccgcccgcccggcctctcccgcaccaccttgggacaaacagctgtcctgcccgcctatgcggaggtggccggcggggccggcgtgggggcgcagggatccccagggtgtggggcagccaggccgaggcgagagacacggtcgggctcagcccatccactgtcagccgggcacatgctggccctccctcaagtaccactgagtgcctcctgggtgtaggaagagggccatctctgccccggtggcctcgaggtgcagatgggtggggggcacccggcacacgggacatcgtggctgagaggacgtcaggccaggtgccaggagggtcccaggagggcctcctgcctccaggtggggatgttcagcctccacttcttcgagtgtgactgtctgtctcctctctctcacttgccagcttcctcacctgccccctcccggctgtctggtgggctgggtggctagggacagaggcctcatgtcacctggcaccaagcagcacccacgcccagccggcttcggcccagaagcagagccttgggaagcacctgtctcagagctggggactggaggcactgggggcacagctgcacccggagtccgaggggtcggggaaaggaggcaaccccggggcagggggctctggtacccgtgcgaaggcgctagtgggctttgggtctccctgtgaccccaatctaaagcccaccagacctagaggagacccccgccgcacggctccccagggcactgtttgaggggtgggtgggaaccccacaccctcgggtggcttttccagttttccttgtctggctgggcttggcctcagtttcctcaaatgcagaccagggagaggagtgcctgagtctcccagaacggcgcccaagccggcctgcccctccccacgcactcaagggtctctgtccagggcccacaggcgacccagcaagggctcctgtgacctttagaaacaccctttcgtcgtggaagtcttcaaacctcacagaaagcaaggaggcgctggccgtggcggcctctcccgtctcccaggcccgcgtccaccctccccgcgccggtgccctccggacagaggtggaagccgcggcgcaggagaggcggctccggccgggcagcggggcccggtgaccttgggcgcgtccttacacgtcgcgggcctcagtttcccctcctggggagaggcccgcgcggggctccgaggcctcgggccgcgtgaccttggggcgcccccgaccccgcggcccgagtttcccggcgccgagcggaggcggcgcgcggggagggggcgcagccgaggcgggtctcccgcccccgcccctcccccgcccctcccccgccgcgaggctccgccccccgcggctccgccccgccccgcccccgcctcccccctccctcgggctccggccggcggcggcggcggcggctccgctccgcactgcccggcgccgcctcgccatggacgcgcgcgggggcggcgggcggcccggggagagcccgggcgcgacccccgcgccggggccgccgccgccgccgccgcccgcgcccccccaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggtaccgcctccgggagggccggtcggcgcgagggggcccggggagccgggcgcgcggggagccgtccttggagcgcctggggagggcggggcggcgcgccgggccggtgacctcggggctcctcggtgacctcgggcgtgtccgggacccgccccggagtgaccccggcgcgcgaggctccgcctctgggggggctccccgggtgaccgcggagcgcccccctcccacgcaccccgacatcctccgccctgcggcgcggcgggtggggtgggccgcagggccagggtctgagcgcagaggggcagagaggacgaatagaggggaacgtgggccccagagaggcggcggagcgggagggaggaggaacgaagggcgcccgggaaggacgcgccccagggaggccgggggagagggggttaagcggctcccacggcgtccacccgcgccccgcctgcgaggaggcgcgcccggggccgcgggcctggaaagcgtgcgggtccccaggctgtgtccccgggagccgctccacccgagccgcgggcggtgcgcgcatgcggcggtgggtgtgtagacgccgctgtggatccagccggctaatgcgtggaaggctcggagcagggccggcgcggggccaccgccactgatgtttgcggtcgtggttcctgggctgtgcgtgctgtggccggagagcgagaccggcgcgtgtccccgtgggctgtgtgtgaacaggggcccgtgaccgcggcggggttcccggggcgcgagcctgtggccggagaggtgtgtctccaggagtgtgtttgcgtggtggtcgcgggcgtgtgcgcctccggtgggtttattttggtgggacgtgtggtttgtgtgtgttgggaccaggtggcgggcgtgcgcgtgtacgcccggggccggtgtgcaccggtgggcagtagtgtgagccgcaggcaggtctcacacacgcgaccatggagggatgcgtgtgtgtttgtgtatccacgagtggggtgtgaggtggggtgtggagggtgcaggtggagggtgtaggtggggcccgccgggctagcgaggccgggcgcgcgggacgggcgcggtttcagcaccacggacagcgcgccggacctgggaagcctgcggttttcccgcctgtctctcctcctccaggcctgggcgccccaggacagcccccacggaccctggacccccggaactgggcagggaggctgtggggttctctcttcccctggattctctgcacccctagtgcttgactggagaaactgaggcctggggcacatgcgtcctggacagagcctggaggaaggccctggaatcctcctcccaccccaggccttcctgagaggtgaatacagctttgaccagaagcctggatttcgagacaggccaggggtgggaggagccccgaaatccccagaggggctgtgtccggcccctcccaccctgcctctgtgccccaccgggagagcttggtcagcatctgggctctggcctgcgaaatgtggacagtgagcgggaaggactggacttccagggctgctggtcggcctggccccacttccagtcgggcagtggcaccccctgaccggagagggacgcggtggagagggagctgtagaacgtgcccactcccctccgtcccctccagcatgaccttcgacagagatgggtgcaccgcagcgtgggggctggcaggtggaggcccacaccagccactccctcccctgggcagctccagcgaccccctggctgcagaggggcggtcggtggcctggggggcaggtgggcagatggctgatcccggggcttggggggaaggccggtggtaggagtgaagccctctcatccttccaccctccttgggcgtggtcgcctggaggcctgggcaggctgtggccccgctctgtgctctgaggcatagagggctcagaggcccctgtgtggaccaagtgcagccccaccccggcagatgagtgttgaagtggaactgagcaggcagggaatggggttagcggggcctgtcttcgggactaggggagtcacggcagtcagattttaaaaaaggatttcgatgttgccaagctgggtgcacggggcccctaggaccctccccaggcttgggacctgtgccagtgtggaatcagtgtggaaaaagacccccaagaatatctcaaaagctccctaagcaggcggccggaccctgctgtggagggtgttttggggcagcccacagcaagcgaaggggcctctacgtttgcagctgactcaggagcctggccccaactggcttcgggcccaaggcctcctgtgcctggctgggtgtcttgggtcctcgctgggcccctctgcctcagtttccccaattgcacggtggggatggtatgagggagaaggatggggtctttcacagccttgccagtgtctcagcctcacgtctcacactctcttcacctccccttcctgctgagagagtgctgtgctccttgcccagcctgtgccccccaggcacgccctcaccccggttcttcctcgctgcccagctgtctccgccacgcccaagtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcggctcacgcctgagatcccagcactttgggaggctgaggcgggcggatcacctgaggtcaggagttcgagagcagcctggccaacatggtgagatgatcccgtctctactaaaaatgcaaaaattagctgggcatcgtgacgagcgcctgtaatcccagctactcgggaggctgaggcaggagaatcacttgaatccaggaggcagaggttgcagtgagccgagatcgcgctgctgcactccagcctggctgacagagtgggacttggtctcaaaaaaaaagaaaaggaagaagaagtgcagttggtctattgctgaagtctctggggctgtgggtggctctacaccccggcctgacgtctgaaagtccccagaggcatgctgggcgcttccctggggtgctggtggaagagcaagttcaaggacccaagttcaaggttttgggttccagaggctcaagttcccttccttgtaggtgatcacggttggtgcctgaattggaacaggcgtgaaaaccaagaaggaaggggtttggccttatgcaacccccagggcttcggcagggtcttctgtgcctcccagagcaaaattaggtcaaaaataagtatagttcattcctactcccttcaccccagccgccgctgattctaaaggccacacaggtccacttgggaaagcctgagtcgtgcaaaggagggtgtctccgcaggagaggggcaggggctggaggtctctgcacgagaagggctggggctggagggtgtctccgcaggagaggggctggggctggaggggacacgaaggcccagggaggggcggtctgaggaggtcgcgttctccgaagcttgctgtcatccaccctccctgcccccggtgtcaccgagggggctgggcagacctggcggggtggagacctgggcagatccggggtttgtgccctgggagctctggggggcacagggcaggtgtcgggtggagagaggctggcggcttcctgactgccctcggtccagttccagggctaagtgccctgtggccgccctgccgtctcctgctgctgctgacttgcaggtctgtgtttctgaattgtcttcagctggggaggccccgtgtgaggggagacagacgagatgctccccaaagccaggatctgttatgtcccctggggtccccgagaggactggtcggggaggagctgctccaagaccccaccaggacaggcggcccctgggccccgcctcagatggctgagtgggtcagcgggagatcagcctgggggtgcagctctgcaaatccgcagtgatgaatcccagcattagggcgtgggaataaaccccccattatcctggggggatggccccgggggcagggcgaggcgagggtttgtctggctctggtcacggcaggaaggcccagcgtgtgcaggatggtggggtgtgcatggacccatatcccaggtggcggtggcctgccctctggtctgcgtggaggggtcaggggtcggggtggccaaggcctccccgctctcttcagggccttccctatgttccctgctcgaaaacggacatctttgtccaggcactgtggctcatgcctgtaatgccagtactttgggaggcggaggcgggaggatcgcttgagcccaggagttcgagaccagcctgggcaacatagcaagacccccatctctacaaaaagttaaaaaattagccaggcgtggtggcgtgcacctgtagtcccagctactctggaggctgaggcgggaggatcacctgagcccaggaggttgaggctgcagtgagctatgatcgtgccactgcactccggcccgggaaacagagtgagaccctgtctcaaaaaaataaaaaaaacctaaaaacccacatattcaagtcaccttcatcagccccccactcacttgggccgggccctgcctcaccccccaccccacggttcagcctcgcaccctgtgcgctggccgcctctctcctgccagatgcctccccgtccccctttctggcctcccggctgtcagcatgggcctctccagacatcggtccttctttccctgtcacctctacctcctccctggctccagccctccccagtcatgtcccctggtcccgaggccgcccaccggccttgaagggaacccggagcatcaacctccgcacctgctgcccctcttcagccactgccctcccctcaccatctcatccacccacacgccacctcctccaaggagccctcccacctgcctggggctgacaggcccatcccatgtgtctgtcttggggctgggcctgtgtggtcatcgtgtgccccggcgcccggcgagagttcggtgaacatctgccccgtcgggatcacccgggaacccgagatctcccccacccgtagcagctccctttcttaatcctgggcacctgccacggatctggccatgactccacagctgagagtgccgtctcctaatcccccggcccgaggctctcccttaatcaccgacctccggcccctaatcctctcccggattgtccccatctgtaaatcctggacggcctccggcctgaggctgggctcctgcggggagggcctggctgccctcgcccgttccccaacccgggactcaggctccagcaggggctgaagaccccctgggcaggccctcccctgggatccaaggggctgagggtcctgggccttctgttgccaggagacctggtgtcctcgtggggtttgggagccgggtcggcggcctcctcccccaagcttcatccagccctggagagacggggacctgcgtcggctttgggaacttcaggggaagaaccctgagctcggggcaggagaatgacatggtctgtctgggttcccatcccactgtttcacttatggctggaggagcctcagtttccgtgtcagagccgagagagaggctgggcggctgttggaggagggctgagctcacatcggtgtcaggtgccgggggccccactgaagccactctggagtgagagggggtccgaggcttcttccggtcccccaggtgtgagagctgaggccggaaggtttccccagggacccagcctcatcccggcctccggagctggtctccctccctgcctgcgagggccaagctggacaaagtggcaggacccccgcgtttccgaggaaggggccctcgtagaggcctcactgttacctgtcggggatgggttttaaatacaggatttaatgatggtcactgatgtttctgtgacagctgaggggggcctgtccctgctcagcactggggttggacaaggagggcacagggtgcccggggagtgctggggcccgcctgggtccctatggtggccggatggggaaagggctgccggacgcggctgcacagagtgtgagggggagtggggttgggctttgggccttcccctgaccccaggtcccctctctggggtcctgtcttctggagctgcctccccctccccagggcgagaggcaggagagggtctcccaaggtcactcagtctagtgttgggcaaggagagggttggggtggagagggttggggtgcaccggcagagacagtgacgccctgcagggctctggggtcccctctgccccaggcctcggtttccccttggtaggggacatgcgtgggcgcccttcttccttctgacctctggctggtgacgacgagggttgcggccccaagccctgcttggaggcattgtggttggaacgggcaggcccagccccacaagggaccctcagggtggccaccccacctgtcccttctcctaggcccctctgctctgacccccgtaatccccaggaatactgccctgctgggcaagatgggctgaggagtcctttctggggacacaggagcagaaggctcaagggaggtggtttccagacagtgtgggccgtggataagaggacagtcctggggtctcatcctgcagtcccacttccatcagaggggaggtgtggtacctgcccccagctcaccccaagaataaagggggagaatgtctgttaatcatcacctggaaaggaggccttcatgttatatggccgtttaaaaccaggtaccccttggcggtttctaggtcctcctggtggtttctaggtctccttggcggtttctaggtcccccttgacagtttctaggtctccttggtggtttctaggtcttcctggtggtttgtagatctccttggcggtttctaggtcctcctggtggtttctaggtcccccttggtggtttctaggtcctcctcgtggtttctaggtctccttggcggtttctaggtcccccttgacagtttctaggtctccttggtggtttctaggtcttcctggtggtttctaggtcctcctggtggtttctaggtcctcctggtggtttctaggtcccccttggtggtttctaggccctcctggtggtttctaggtctccttggcagtttctaggtcctcctggtggtttctaggtctccttggcggtttctaggtctccttggcagtttctaggtcccccttggtggtctctggagccccctgggagtttctcctcgcccctcgtgggggaggtttctaggccctgtggccttctcaactgctctttcctgctggttttgtcccaagactggtgctcgaaggtgggaggcaggtctcaatccagagggtgaggctggggctgagctccacggtgagccccctcggggctgaggggcagggggccagcggcaggcgggtggcatcccctcagcccactcggtgctggggccctgggggtctcgttgctgagcagatgtgtcggactgggggcctgagccctcatgtcctgtctagactcagggaaaggaaggccttaaatttctagtccttttagtcatttgatttcacccttcaagcttgtgaggggacccctccccaccccgagatcaagtcagccttttttttttttgagacagagtctcactctgtcacccaggctggagtgcaatggtgcagttttggctcactgcagcctcgacttcatgggctcgagcaatcctcctacctcagcctcccaagtagctgggtccacaggtgcgcaccaccacgctggctaatttttgtattttttgtagagacgggatctcactatcttgcccaggctggtcctgaactcctgagcttctgtgatcctttagtcttggcctcccaaggtgctggcattagaagcatgagcccctgcacccacccttcccttcttttttgagacggagtctcgctctgtcgcccaggctggagtgcgatggcgcgatctcggctcactgcaagctccgcctcccgggttcatgccgttctcctgcctcagcctcccgagtagctgggcctacaggcgcccgccacctcacacaaaaaaataatacatttttgtatttttagtagagacggggtttcaccgtgttggccaggatggtctcgatctcttgaccttgtaatctgcccgcctcagcctccttaagccctggaattacaggcgtgagccaccgtgcccagcctgagtcagcccttctctaggttttatccccagcctgggtggttcttggggggtgtcccgaaggctcagcccctccccatcccgaggcggtggatgcttggaagaagagactgaggttctcaggggctgcaggaacttgtccaaggtcactgtgccagcaggcgggtgccagcccaggtctggctgatgccaccacgatgtgagtcgctgggtcccttccagcgtttggctcttgcagaccgagctgctgtgaacattttggtacaaatggctttttaatttttttctcttccttttggaccgtttcctcgggatcatttccccgaagtggagcgtctgggtcaccccgcagacgtggtgttaacagcttttccctcgaggagccgtccagaagcaaggagccgactttcggcggctcctgaaacaaaggtcccggcggccacgccagcgatgagctcccaggtttttctttattggtgttaactttggggagtccctccagtccctcagcatctcctccgaaaggatgtggggaccccggccatgatagggaggggctgggcctggggtggggataaggcctcaagaattggccgggcgcggtggctcacgcctgtaatcccagcactttaggaggccaaggcgggcggatcacgaggtcaggagttcgagaccatcctggctaacatggtgaaaccccgtctctactaaaaatacaaaaaaaaaaaaaaattatctgggcgtggtggcgggcgcctatagtcccagctactcgggagggtgaggcaagagaatggtgtgaaccctggaggcggagcttgcagtgagccgagattgtgccatcgcactccagcctgggcgacagagtgagactctgtctcaaaaaagaaaacctcaagaactaagaaggctgagttggtacagggatgggaaggggtcccgtgtgtgtgtgtgtgtgtgtgtgtgtgtgtgtgtgtgtgtgtgtgtgtgtcagagggtctcatgttacccaggctggtcttgaactcctgggctcaagcgatcctcctacctcagcctcccaaaatgttggaattataggcatgagccagtgtgtttggcctagcccccagtgttaatggcaaaatcctatgaatctttgtgctggaaattcaagaccctcccttgtctgagtcaggcacacgcaggccatgtgggctcagaccccagtctggaacctccccttcagcaagagcccttggccccagagcccagaggtttttgttttgttgtgttttgttctttgagacagagtctcgctctgttgccccggctggaatgcagtggcacgatctcggctcactgcaacctccacctcccgggttcaaacaattcacctgcttcagcgtcccgagtagctggtactacaggcgcccgccaccacgcccggctaatttttgtattattattttttgagatggggtctcactctgttgccaggctggagtgccatggcgtgatctcagctcactgcaacctccgcctcactggttcaagcgattctcctgcctcagcctcccgagtagctgggactacaggcacgtgccatcatgcccagccaatttttttttttgtattttttgtagagctggggtttcactctgttggccaggctggtcctgatctcttgacctcatgatgcgaccacctttgcctcccagagtgctgggattacagacgtgagccaccacacccggcctaatttctgtatttttagtagagacggggtttcaccatattggccaggctggtctcaaacccctgacctcaagtgatccgcctgccttggcctcccaaagtgctgggaacacaggcgtgagccaccgcacccagcaggcttttttcttttatcagttttccaattagccattgtaaaacctatcaatcagtgtcattaagcccattcttgctgttgtacaaccgtcaccactatccatagtccatacctttctcattcccccggacagaaaccgcaccccgcacatgccacttctcacccctccaacccccggcccccggcacccatgcatccccttcctgtctctggattggcctgtcctggacatttcgtagaaatgggctcacacggccgggcgcagtggctcaggccggtaatccccacactttgcgaggcctaggcagaaggatcatgaggtcagggtttcgagaccagcctgaccaacatggtgaaaccctgtctctactaaaaatacaaaaatgagccaggagtggtggctcatgcctgtaatcccagctactcaggaggctgaggcaggagaatcgcttgaacttgggaggcggaggtggcagtgagccgagatggtgccactgcactccagcctgggcgacagggtgagactccgtctcggaaaaaaaaagaaatggcttctctcactgaacgtgacgtcctcaaggggcatctgcgccgtggcctgggtcagagcctcactccttttcgtggctgagtcgtgttccatggtggacgggtcgcgccgtgtttgtccctccgtttggtgatgggcacctgggctgcctctgcctttttgctactgtggatcgagctggtgtgaacacagcggagtggtcgtcgtccgcagtcgagctggtgtgaacacggtggggtggttgtcgtccgcaatcaagctggtgtgaacacggcggggtgctcgtccgtccttgttttcatttctttgggtataatctcggggcagggagaggctggtaattttatgtctttttaaggagccacccgtgtttgctccgagtcgttttgattttcattttctcgatagcgaaagggttgggcatctgtccagtagccatttgctgaccctctatgacctcctgtgtggacgcggcactcccagcaccgtgtctggcccgccatacgcaggccctgaaccgacaggaccttttctgccagagcttcccagggagagttttgggatccaccttggggacttggactctggccgggtgtatctgggagtggaaacgccctctggtctcttgtccacgggtatttatcatacggaacgtccgaatggtgccaagtccggctcggccgttcctcccaccctctcggcctcccctgtggcgccagccccgtctctgcttggcttccctccctcctgtgtggacgccccacttcctcccctctcctcctgcgtggacgccccactccctcctctctcctcctgcgtggacgccccacttcctcctctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccacttcctcctctcctgcgtggacgccccactccctcctctctcctcctgcgtggacgccccacttcctcctctctcctcctgcgtggacgccccacttcctctggaaatgcagccggtgctgccctggttcagtcttcctgtggcccctgtggaggctcccgcttctcagtaaggcatctggggccctcacctcccggcgtgagctgagcacggttcatttcccaccctggcttcccgccttcgctctccctgtgcgcgccgccctgcctcgccctgctgcttcccagtgcccctctgcaccccggctcctctctgctcctctgctgtcctgtcctgtctatttttttaacgccaaccttgtgccaggcacattgtccctctctggtcatgtgaagcacttaatctattttgagccacctcttgggccttgtgaggtctcctgcatcttcaaggacacggggtcaaagttgggcctgaggaagggacctgggctagggcagcgcagtgggcgttgggctccctcggggctgggtggccttcctggggtgggagcctggtcccgagggaggagtgcccagggcttgtcctgcaggcgcctggggggaaggcaccggcctgagctgtgggcaccctcgtcccccagggaggaatgcccggggctggtcctgcaggcgcctggggggaaggcaccggcctgaggtgtgggcaccctcgccccccagggaggaatgcccggggctggtcccataggtgcctgggggaaggcaccagcttgaggtgtgggtgcccctcgtcccacagggaagagggcccggggctggtcccataggtgcctgggggaatgcaccagcctgagctgtgggcaccctcgccccccagggaggaatgcccggggctggtcccataggtgcctggggggaaggcaccagcctgaggtgtgggcaccctcgccccccagggaggaatgcccggggctggtcccataggtgcctgggggaaggcaccagcctgaggtgtgggtgcccctcgtcccacagggaagagggcccggggctggtcccgcaggctcctcggaggaggcactggctcgaggtgtgggcgcccctcgtcccccaaggaagagtgcccggggctggtcccgcaggtgccccggggaggcaccggcctgaggtgtgggcaccctcgcccccaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggaggtgaggtggggcgggggcggggccaaggcagcaggggcggggctataatggtgcatgggcggggccaaggcagcaggggcggggctataatggtgcatgggtggggccaaggcagcaggggtggggctatgagagatctgggtggggtcaaggccccaggggtggggctatgggagatctgggtggggtcaaggccccagggatggggctatgagagatctgagtggggtcaaggccccagggatggggctatgagagatctgggtggggtcaaggccccaggggtggggctatgggagatctgggtggggtcaaggccccagggatggggctatgagagatctgggtggggtcaaggccccaggggtggggctatgagggtgcaggggtggagctacaatggtgcagtggtagagccaagacagcaggggtggggctatcaggttgctgagcagggtcgaggcagcaggggcagggctatgatgctgctggggtggagtcaagcagcaggggtggggccgtgatatctgggtggggtcaaggagcaggggcagggctgtgagggtgctgggcggggtcaaggcatcaggggcggggctatgagggttgtgctgagcggggtcagacatccgagtggagatatgagggttgtgctgggcggggtcaggcagcaagggcgggactatgagggttgtgctgggcggggtcaggcagcaggggcggggcaatgcgggttttgctggggcagggccagacatcaggggtggggatatgagggttgtgctggggcggtgtcagacatcaggggtggggagctgtggatttggggggtgtcctagggcgggggctgtggatttgggggggtcctgcagtgaaggctgtagaggtgggcggggtcctggggtgggggctgtgggtttggagggcgggggtcccggggcagggctgcagggtggggcgggggtcctgtgcggggccttggatttgggggagggggccaggagctcccgcagtgggggcgcacggggctggggctctgaaggtgggggccgggggtcagcgggtagggtgggctcacggcgccttcctgcagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtggtgagcgccgcgggccctgacggagggggagacgcaggctcccatacagaggggggacccaggcccccttatcccgcttacagagggttgaacccaagcctttcagaggtggggacccaggcgcccccttatggaggggaggactcgggcccttacagaggtggggacccaggcgcccccttatggaggggaggactcgggccctttcagaggcggggacccaggcgcccccttatggaggggaggactcgggcccttacagaggtggggacccaggcgcccccttatggaggggaggactcgggccctttcagaggtggggacccaggcgcccccttatggaggggaggactcgggccctttcagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggtggggacccaggcgcccccttatggagggaaggactcgggcccttacagaggcggggacccaggccgccttacagagggagagacacaggcccttcaggggtggggacaagacccccttacacgggaggactcaggcctctttacagagggggacccaggactgcagccccggcactggccccttaatgtccctgggggtctgaaacagccacttggaacctttcaggcctgggatcatccgtggagagaagctgagtgtggttatgatgagtcctgtcacccagacatctgcttagcgcgttttccaatggatttcccttttaattaacccacattaattattattattttatttacttatttttttttgagactgagtttcactctgtcgcccaggctggagtgcagtggcacgatctcggcttaccacaaaccccacctcccagggttcaagggattctctcgcctcagcctcccgagtagctgggactacaggcgcccgccaccacacctggataattttcgtacttttagtagagacggggtctcgccatgttggtcaggctggtctcgaactcctgacctcaggtgatccgcctgcctcggcctcccaaagtgttgggattacaggcgtgagccaccgcgcccggcctggttggatcccttgagcccagaagttgaggctgcagtgagccatgattgcaccactgcactccagcctgggtcacagagcaagacctgatctctaacaactaaagaaaaatttacaacatggccctgaattgggaaagtggtatcaccatgccaaagaaataataaatgggccaggcatggctgctcatgcctgtaatcccagcactttgggaggctgaggcaggcggatcacctgaggtcaggagtttgagaccagcctgaccaacatgctgaaaccccgtctctactaaaaataaaaaattagccaggcgtggtggcgcgcacctgtaattccagctactgtagaggctgaggcaggagaatcgcttgaacccgggagcagaggttgcagcgagctgagatcacaccattgcactccagcctgggcaacagagccagactttgtctcaaaaaaaataaataaaaataagtaaaagcaaaaggaagaggccgggcgcggtggctcacgcctgtaatcccagcactttgggaggccgaggtggggctgatcacctgaggtcaggagtttgagaccagcctgaccaacatggagaaaccccgtctctactaaaaatacaaaactagcttggcgtggtggcgcatgcctgtaatcccagctacttgagaggccaaggcaggagaatcgcttgaacccgggagcggaggctgccgtgagccaagatcgtgccactgcactccagcctgggcgacaagagcgaaactccgtcaaaaaagaaggaataataaatgaagttaggtcccagatactccttgcttcctagctgagatgtgctgactgttaagaagggttagttatgggagccctcggccgctacagtcaggttagtggccagtgagcctttgtccctgcctggggagtgctgtgccccagcgtccagccacatatgggacttgggatgtgtttggtttggacacagagcaggtgggcattgatggggtcaggagctacagagggaagacccgccagtgcccctccccagagcctggcacagctgcccaggctgaggcagcccattgtctggctgccacccgcacatgcggtcccatttcctgaacagagccccgcggctcccctttcccggccgggtcagctgaggacttggtgcggcaggacctcctgggccggcctggtgtctctgcccgccctgcccctctgctctggcccagatgctccctggaacttttgccccctcttgacctcacagatgctctgatctcagaggctgcaaaaggcgggacccagactctcgcccttggggtctcagtttccccaggagtgaagcgggcaggtagaatcagccctggccctcctgccaactcactgtgacaagtgtgcaaaccatgtcatctacctgggtctccatttctcttggttacctctgaacatggggagctcaccacctccagtgcttggcagagggtgggcgctgggcccttgaggaccgagggctcctggggcgtgagcacctgcccaccaccgcccctcctgctggccttgcagaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaaggtctgagggaggcgggccccggcctgggttctgatgggggaggcgggcctggatctggggtctgagagagagtcaggccaggccctggggtctgatggagggaggcaggcccggtcctggggtctgaggctggagggaggccttgccctggggtctgagggcggaggtagtccttgtcccggggtctgaggggaggggcgggcccggccccggggtctgaggggagaggcagtctcagcccttcactcagcttcaagtggcgcgctcagggcagagaccgcgtgatggggagcaggggaccctgggggtctgtggctgtgattaggaggagaaacggccggtggtgagaggttctctgaccctgtgacagggagggaggtccagagcctggagatggacgtggggcgggggctggggaggggatgcaggctgggcaggaaggggtgagttgggatcagggcaggacagggtcagtctttggacatcgggaagcccccgggctgaaggggcattgccaggaggctgggcccacctgggggtctctaggccggctcaggatggggctgggttagggaagggcctggcggggtctgagaggcctggggttgcttcaggacacgccggtggccggcagtcagggccaggcttcagggagagcaaggctgccccactgctcagatgcggcctctggcctgcagcgtccattgggttaatcctaggcttggcagtggaggggacacgggggagctgggaggggtggagggagattaggattggccccattggcagcccctggagttgggcctcatgcaccactctgtgcctcagtttccccatgttaggcggctggctggtcctggctgggagccaagtgcccccctctcccgcgccccgagcagtggctggctgggtcagctgggccccgtgccaggcgccctgctgtccggaagccacgggcctcacacccaaacataagctggtgccaccacccgcccgccgtcacgggttccgctgagctcagggcagctgcggccgggcggggctggggcggaagtgaggctggagctgccggggggcaccgtcctggggacagcagggcctggcacccccgcccagcacccacgctcccttccctgctcaggaggggctgacccgatggtttctggaaagatcatcagggaagggccagagcccccgggaagggggtcctgtgtgtcagggtacctggggcctctcctcgtagagtcaggtgcccacccattcctcagggatagggttgctagataaagttcagggcacccggcctggtgcagtggctcctgcctgtaatcccggcactctgggaggccgagacaggccgatcgcctgaggtcaggagtttaagaccagcctgagcaacacggcgagacctcatcgctacaaaaaattaaaaaattagcagggcagggtggtgcacacctgtaatccccactactcaggaggccgaggtgggaggatcccttgagcccaggagttcaagaccagcctgtgcaatatggcgagacctcatctccacaaaaaataaaagaatcagccaggcgtggtggcgcacacctgcagtccctgctactcaggaggctgaggtgggaggattgcttgagcccataggcggaggctgcagtgagctgtgattgcaccactgcactccagcgtgggccacagagcgagacagtgtctcagaaaaaaaaaatggaatttatcattgaaacgaattcaactttgatttaaatagaagcatgtttatttgctcttgttgaatctggccgcccctgtgtgtggcggaggcctgtctccccgctgtgggcgggggctttgtctgacccagccctgaccccccacagtacaagcaggtgtgaaggcctatctccccgccacaggccggggggctgtctgacccacaagcaggtgcccgtgtgcccgctgcaggctgggggcggtgtctgacccagcctcgcctccccacagtacaagcaggtgcccctgtgcccgctgcaggccgggggcggtgtctgacccagcctcgcctcctccccacagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggtgaggcgggcgccgggcgggcgggaggcagcctccggtacagggccggcctccctctcctggagcccaggagccggtccctgagggaggcgaggtgcctaggctgcagcaggagggactcgagctagacctgcgtacacaccctcccctccccgccccgtgagcctctgcacccccaggacccccgccacccccgccttgcttcccgctgcccccttagcagaactgcctgggtctgtgcctgacagggcggggcagaagcagggcagggggtggggagggaggagccgcagaggccccgctgagcaccaggtcctgggggcactgaggctgattggagcgggtttaactcccagctctgttccggtagcctgagtgaccctgggcaagtttcccagggttgcgggaacaaatacccacaggctgagtggcttgaacagcggagattcggcctcccaccgtcctggaggccggaagcccaacatcaaggcgtgggccgggccgtgctacccccccggagcccctggggaggatccttcctgcctcttccggcgtctggggctccaggcgcccttggcttgcagattgatctccctgatctctgcctccatctgctcacagccttctcccctgtgtgtctctgtctcttcttgtaaattcatccgtcgttggatcagggcccacccggttcctcgtggcctcgccttaactgggccatgtctgcagagaccctatttccacataaggtcctattcacaggaaccgggggtcaggatgtcagcctgtctttctgggagatgtagttcaacccacaacacacatcaaacagttattgagcgccgactgcgtgccctgccgtgtgcttgaaggtcccaccctcaggaagcggggcctagggatggcggccgtgatcacgcaggcagcagagagcagctctgggaagcggggagggacgaggacggggaggcgacatcagcaaggccgtgtgtgagccaggcagggtgtccccggtgtagcacctggctcgggcagaggccccgaggaggggctggaggagctgggcgaggaggcgggcaggacgggcctgacactagggacctcgggccccgggaatgcctctgggggggcgtgtacacccgttgctcccaggaggcacacactgcggttcgcttcgccaagaatgtttaattgcatttgatgactacggtttccattcattcatttgtagagatataacactcagaccacaaaatgcataaaatgcggtggcttttagtattaacagagtgctgcacccgataccacagcctcactccagaacattctcatgggcccaaaaggagacctggggtgttagtcaccagctcactccccgtccccagcccctggcaacccacgctacttagtcattatttaggtgtttaggagttgcaaagtcaaatctttaaacccacatatggccaggcgtggtggctcacgcctgtaatcccagcactttcagaggccgagacgggcagatcacctgaggtcaggagttcgagaccagcctggccaacatggtgaagccccgtctccactaaaaatacaaaattagccgggcgtggtggtgggcgcctgtaatcccagctactctggaggctgagacaggagaatcgcttgaacccaggaggcggcggttgcagtgagccgagattgtgccactgcactccagcctggacaacagagcgagactccgtctcaaaaaaaaaaaaagtaccaaaaagtgccccaggtcataagggcacagctcgatagctggtccctaaagggaacgtggtgtaaccaccacacagaacgaagctggaacgttcctgccgtccttagaagctgcctttgctaaggggaattgccctgacttcccacaccattgattcatctccagacccttggttttcatgttgatttttcaaaaatcacctgatagtctgaccgaatgtagctttccactggtgtgtgtgtgtgtgtgtgtgtgtgtgtgtgtgtgagagagagatggagtctcgctctgtcacccgggctccagtgcagttgtgtgatcttggttcactgtaacctcctcctcccgggttcaagagactcgtgcctcagcctcccgagtagctgggattacaggcacccgccaccacacccagctaattttttgtatttttagtagagatggggtttcaccatgttggccaggctggtctcgaactcctgacatcaggcgatccacccaccttggcctcccagagtgctgggattacaggtgtgagccaccacgcccggccttatttttcccccattttctttttttttttttttgagtcagggtcttgttctgcgctcaggctggagggcagtggtgtggggatcacggctcactgcagcctcgacttcctgcaccaccacgcctggctgttttttttttttccggtagagacgggggtcttaccgtgttgcccaggctggtctagaactcctgggctcaagcgatcctcccgcctcggcctccgcaaatgctgagatcacacgcgtgagcccccgcacccggcctcctttccaccgctcttgtctacagccgcccctcctggtccgattgtattggcagatgtcgccaatacggtgtcaaacggcgaaggggcactgagcgttttttctttctcccgtccttggcggcagcagctcggttccggctacggggctgagcccgtctctcagacgaggaaactggggtccgagaggtgagccggtcccagaggcagggcgagggggaagcgggagtggggtccgcagcggacccagccctgcctcccccctgcaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcgggggtgagcttgaggggggcgcgcctggagggggagggggcacgcgacccccgcggtgtgcagagccagggggccggggccggggccggggccggggatggggatggggatggggatggggccggggatggggatggggatggggatggggccggggatggggatggggatggggccggggatggggatggggccggggatggggccggggatggggccggggatggggccggggccggcaccagggagagcctgggtgggaagcgcccacgctggccaaggtgcagaggccgggccgtgtgcctgggcggggagggccgcggcgcccgcctcgtccagcaacccccccctgcgcgccacgtgcagagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggtgagcgggccgggggcgtggccggggcgggtgccctggcgggggaggggcgtggccaaggcatcaggagagtggcttggacagtggcagggggaagggcgtggctgtggcatcaggggcacggttggggcagagacgtggccaaggcatcaggagtgtggccatggcagcaggggcgtggctggggcaggggcagcggctggccgctcctaggacccctttgggtctagaggctgattttctgacctattgtcctacttcagccagaggcagcctgtttcccaagggagggaatgcacagggtgtttgcggttgtgccgaatgctcggtgagcacctgctgtgtgctgggggtgcaggggacagacccgggggcccactcagactcccagggaggcttatggactggtgatgaaatcacacacgactgggctgtgtgccagcagggcaggtggggccggtgggcttccctgagttgggaatgcagagtggagaccagggtaagggatgccatgtggaaacggggaggaagatgtgttcgtggagtggacacagcacatcccaaggccctgaggtggaaaagaggcctagagtccagagagccagggaggcctggaggaggttggggaagaaggggaggccagacacacagggcccagtgggcggcagggagagtttagactaaatcaggagcatcagggagccatggagggttctaggtgggcggaggacctggtcagattgtatccgccaaggcgggccgtgtccaggagggagacggtgacctggcctctcaggggggcagtctctggggcagggagcggcagagccctgatgactggatgtaggcgccagagagatggcggctcatgctgctgttcgtgggaatgggaatgaagaccatggctgaaacgcaggacaggtgcgacggagtggtgtcagggagctccctggtgtacagtaggaagctctccacaacttgctctatacagtgagtatgcaacccgttcctgagtatcaggtgcttaggttataacttctgtatacagcaggtgctcagcacaggctgtgtacaggcaggtgttttcggtatgcctgtggcacactggaggcagtcattacataatcagcgtatacaggtggtacacatgcatacttggtgcacagtgatacctgctccatgtacacagcaggcattaaatacctgtttactgccaggcgcggtggctcacgcctgtagtcccagcactttcggaggccaaggtgggtggatcacgaggtcaggagattgagaccatcctggctaacatggtgaaaccccgtctctactaaaaaaaaaatacaaaaaattagccgggtgtggtggcgggcgcctgtagtcccagctactcgggaggatgaggcaggagaatggtgtgaacccgggaggtggaccttgcagtgggccgagatcgcgccactgcactccagcccgggcgacagagcaagactccgtctcagaaacaaagcaaaacaaaagccctgctttctgtatgcaggtgcttcatgcatgctggctgtgcatagcaggtgctcagcctgtatatggcaggtactcaatatccatactataggccagagatgctacatatgtgcttattgtatacagtaggtggtaaatgcatgcttgctctacacggcaagcactgtgtgcgcacccgcggtgcagagtaggtgctcggtgcccgctgtacgcagcaggcgctccctgtgcacacgctaacgccccctctcccgcaggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgcccccggccgtcccccctcatcgccccgcgcccacccccatcgcccctgcccccggcggcggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaagcctggccgcgtgtgattgcccgagacccgcagggcgtgcacccttcctgaagacagtggctcctgggggtggcaaaagagctttatttacacactgacaaggctcacggggtgtcagctgaagaagtaggtggaacgcttcacctgctccaggtcgaaggcccctgcggaggaagcagagcggacggcgtgggtggcgggaaagccccgccctggcccgcagttcgagccacccttgcgaggctgcccacccgcctacctggcttgggcaccgcctgcagtgtctccttcagctggctggcctccaagatcttctggggcctggggttggaagcagggtggggtgaggctgaggccaggttttggggtggggggggaatccaggtagttggggtcagggagcgccttactcagagcagaaccgcttgaccaggaatctggacaggtcctgcaggatgggctcgctgtgcaagcggacaaactgctcccggcacacctgggcaggagtcagaggatccccaggggtgatcaggcaggctctgggcaccacccctacccaacgccccagtgtgggggccccacccatgggtggactgaggctcagactacgggggcacctggttcatgacggagacatcagctgcgtgagtccagtaacagtcgtgcacagagacgaaggtcaggcccttcctgtggcagagcggaggactcctgaagggaggggagctcacagggccacccagtgaccagcatcctggccctgcgctcagccccctccacttgaggtccagggaagcccaccctcctgcaggcctcgccccacccctcgccccgcccctccccaaacatcctgggttaggtatcagtacagggggaggaaatgttcccagaagcctcctcgccccacccctgccgccccccacgctgctgtgggagcctcagctccgagggcggctacgaggtcccctcctgccagggccaccaccccgcatcctgagcattcccagctcccgtggccggtagattctgctggaacgacctccacgtgctccagatctaaccacacatcgcggtgccaagaaatgcccagcaggaaggggcagcgcccatgctcggctctccctgtcgggccacaggaggggagctgccaggaccacctacattcggggcacacagcctcagggcctctacacaggccccacagacacagcagatccactctgcccagtccctgcccccagctagacccagccttgccagctgtgccctgctagccagaagacgcccctgggaggcgagcggcacccacgccgtccggagacgcccacctgtagcagtgcagggcggtgagcatcatgtgggaggagtccagcgagtggatgaagttgggcgggaagccgttcttctgcttacgtgtgttgggctttctgaggacggaacaggtgccggtgggggcggcccagggacacccctaactggccgctgtctccaccgtggctgctctccagacccccggccaggccccagcccgggccccccactcaccggctgatgtctccgttgtgggtgtaggtgatgctctgaattccacctcctatttgctaaaaaggggaaggggccggtgagtcccacccgaggcccagcacggtggtggtacattgaggtggtggtacactggggtagtggcacgctaggatggtggcacactggcgcgggatggggtggcacactggggcggtggtacactggggtggtggtacgctggggcactggtacactgggacgctgttacactgggatggtggcacactggggagggatggggtggtacactgaccttgaccttggagtccaggcgatagggctggatgacggggacgcccaggggtgtgacccactccaccacagagcccatgtgggagatgaggcgggcactctcggtcagccagtgctgtgggacacaggccgtctcagggcagggggctcaggccggggatcccgtccacttgcttagggagtcctggccgagcggggacaggacaggacgtacctggatggcccgggtccccgagaacatctcctgtagactcttgaagacctggcgtacgagatagtgagaggcctcccacacgaactcctgcagagggcgggcagcaggtgcaggtcctcaggggctggcccgttcacgccctactcccccctatttcagagccactgaggcccaaggcctagggcctagcaggggggcaggggaatggggcctggcgcccacgcagtcagcaagaaacgcccaagccctaacaggcagccagtggtctgggggagcagccagggctcctgctgggaggctgggtcgggggcacacccgtctgagttttaaatggcagtgaaaccaacgtgttcgcagcgcgacatgcctggcgcacctggggaaagtcgctcagctcccggaggcgcttctcaatctgcaggcgcccgccatagcgcgtgaccccgtacaccaccgtcatcaccgtctgcttcaccaccttgcgggtgatgaaaccttccagcacctgtgccacccgcatgccccgctgggcgtcctgcctacggaacacctccacctgcacggcgggtgggccgggggcgcgggtcagccccgctagcagcccaggggccaccaagcacccatgaagcccccgccccagccccaccacatcctcaggacaggccaaggtgagggcacctggggccgagactcagggctcacattgcccccacgccgagatgcccccgggcagcagggcacaccctacctgcgcggccacgccgctgtacacgtcctgcggcacatccgagggctccaggttgacggaggcggcgcccacgctgtcgcggcccagagcagcataatgctgcaggccgttgcaagagccgtcctgaggaaggggcggcaaacgggagatggaagctagagaggcagagacgtgtgggaccccaaaccaccccccaggtcgagccgttcctagggccgtgcaccccccagccaagtgcaccggagcccccgcacgctcccgggagagaccaggagccatggctcccgcacactctaggaccacctccagagaataccacgagcgaaggtgaaatctcacaccctcaagtcgagccccaggcccagtgcacactgcacggcctcgggggccagacccagctggctcacctgatggacggggaggtgggagacataggcggcagggtcggaggcgcgcacagcgttcgccacctccatacagcaggccagcgtctgccagggttcctccgcgcccatccaccactttcggccctgcggggacagcggatggggggcagtgaggcccgggcccgatccctgagcccgctgggaggctgtgttgcggggaggtgggaaatggggaggagacgcacacccgtgatagtgaacacgggacgcatgtgggcgagagacggggcggtggctggatgagttctccatagccacggatggaggatgggagctgcgggtggaccgggctgaaacaagcgtgtccggagctgccgggggaggagggtggacagaggacctgggggcgccgggggaggaagcagctcggcggatgcaggggaggggggaacgtggggaacgcgggggccctggggcaggggagaagggagaagcaggacgggcagggggcgcgggggaggagagcgggcgggggacgtgggggcgccaggggagggggaggggaggaggaagacgggcagggggcgccaggggagggggaggggaggaggaagacgggcagggggcgcgggggcgccgggggagggcgcgggggcgccgggggagggcgcgggggtgccgggagggcggggaatgcgggggccccgcccctaccgtcaagggttggtccgcggagtccaggatgtcatccatcacctcctccgcaaaggccaggcgcttccgcagcggctcccgcttcttcaaccccgtgagattgaccaggtggatcttgagccaatccaggccgtgcgggccgagcgggcggccctgggcgaactccagcagggcccgcgccacgtcgctgcccaggtggttgaagtgcggcgggcaggggtaggtgcggccgcggaagtccatgttgtgcggcagccagaagacgcggtcccgcaggtgctgcgccagcgagaggcggtacagcgcctccgcccgcaggctgtgcatctcccgggccaccttctggcagtgcgccagctcacggcgcagctcggccttgcgggcgggcgcggcgctgtgcggcaggtgggcctcgggcggctggggcgcctcggagggcggggccggcacgcctagctgggggcagcccttggcctggaagagctgcagcaccaggtccagcacgcgcccgttgacgcgccaggcgcagttgcccagttgggtgagggcgtccagtgcgccatgcagcgcggtgggcgggcaggtttccagcagctcctggtgctgcgtggcgccttccaccgtgcgcatcagcttggtggggctgagcaggaaagcaccagagtgcggcgatgtccagggcagcggggggcaaagcatgggtacatccaccgcctcgaaggtcagcgtgggctccgcggccttctccagcagctgcacgtaggccgggtgcggcttcaggatgccgatctggggtgcgacaggcagacgggtcagggccccggtgctggggctttcctgttcccaccccttaaacttgggtgagaggggccggctccccggccaacaagaaaccagtgtggcctcccacgaacagaagccacctccagaaacggccggacacctgcatggacacccatggtgtgtcccgagtcctgggaggtactgacggctgcgctgagatcaaggctccgcccaaaggcgccaaccccatggggtccctggtcctcccagcgggatgccccccagctcaggagggcactgcctggcacctgctggacgttgcggaaggaatacacgtggtagagcacggggacaagccgagaggaacgatgcggcttgtccaggctgcatggcatctgcgtagcctgcaccagcatctccgccagcagcttgcccagctccatctgcactggcaggggccagggctgctcccgcagggcctcgggcgcccccagctcctcccagtactgccgcggcaggcagggctcgggcacctgtaggacagggcggtcagggcgctgggcaccggggcccctgagctagatgccccaccgcccgtgcctgacgcccggtggggcatctgtcagcccaagcatacagatgaacagactgaagcttgggtgcaaacccggctgctccagggagggagagcgcccacccaccactggccccagccaggaggagagggggtgcgagcctcacctcggcgtcggaggccagcaagcagaggtacttcctgtagtggttctgcagcgcctgcacctggccactgacccgctgcctctgcaccacgtgccggctgaaagtgcgcgcactcagctcccgggccagggtggtgaaggactcaccttgggcgggcagcgcctgcaggacctgcggaaggcagccgtgagtgcctgcccgccccgcccggggacccggccgcgcggaggaagacgcacctgcaggagcatccgcaccacctcgcgctcgtccagcaggcacaggaaggggtaaagtgagaaccggccctcgtacacctcgcgctctaggcggttcttggtctcccgcagcgcccggcacagtgctttctcccattggtcccgcagggtcttcagggtcttccgctgcgggggatgaacgggcccggtgagccccgtggcagctggtgggacccaggctcacaggacgggggtcaccgcagctccctgcagagacctcatggccctcaaggtccctgctgtgtgttccgggtagctcctcaccccggcctgccctctgccggcttcagcgtgcctgacgcagccaagagcaaaagcccagctgcagtgtgcgcagaagcacaggccaagacccaacctcgggaccccacaagttttccctgagcggcagccaggctgagttcctaggccctgcatgaccagaccagggcatgagcaattcaaccgcatacacggagctcagcccctgcggcggacacgcgaccccggctcagcccctgcggcggacacgggaccccggctcagcccgtgcggtggacacgcgaccccggctcagcccctgcggcggacacgggaccccggctcagcccctaccgcgtgcttgacctccttgcttggcaacgtgggcttctccacggacaccacgcacaccctgctggccagctccatgtggagctgcttctcaaagaggcactgcagggtcttcaagggcaggtgcagcttcgggtaggacacacgcccatcctgcagggatgggggtagtgaggttgggggcttgccagagggcgacctgccctcccaggaccccgagacagcatgggtgcacgcgtttctgcgtctcctgcaagttgctggtggctatcgctgacgcggggaaaggcgggctgcgggtaaagtcagtgccagcagtgcaaaccaaaggccttgaccctcctggcctcgacccctctagaagggacactgggcaccgtgcagggggtggcaggggcggtgatgctgggagctggcagagcctggggagaccgttcactgcacccccagatgttggctgttttctcctcaaactcagaactgtatgaatgtgacccatccagaaatagatgaattaaaaataacaactaaagcctagcgctttgagaatcaaagacgcacgtccacataaaagcttgtacacaaacgttcacagctgcatgactcgcagtcgataagtagaaacagcccaacgtcccataaacggacgaacagacgggcacggcgcggccatccacgcaccggagcatgactcagccctgacccaggtcgcctcccggaggcaccatgaggacgtcacgctcagtgggagatgccaaacacaaaaggtctcgcagtgtgtggtcccatttctatggaatgtccagagcagactcatccacagatggggaggggatggggagtgacggggatggggacgaggcttccttttagggtgatggaacattctagaattagacaaccgtgactacactaaaatcgctgaattacacctttaagagggttttatggcaggtgaattacacctcagtaacagacgagcccactgcgtgcacctggcagccccactcaaacgcactgctctcctgtcaccccaccctctctctgcggcccccgaccacctcgtccccctgagcccacaccctcagggccaagaccctcccagctctgggtcctcccatcttctcagaggaggaagggaggaattcagggcccagcccaggtgagccctgggcaccggggaggcccattggtctgagctgaggctccaggaacccccaaagggcagctataaggactgaagtctgccggggcccacgtgggctcaccttggcatacacgtccctgagcagcttggaggtgttgaccgggggcggcagctgcggcgggaggctgaaggtgggcttcaccttgtgcacggccttcagaacagtggcccgatcctcctcagacagcagaacggcggtgaagagtgcctgcagcttcagcccctcctggctcatctgttccagacacctgtggtgcaggcggcctgctcgagggacgggccagccccacgctgggcttccacagaccccaggggaacctcgtgaccacctcctgctagcctgcaggtctcggtgtggctgtcaggccctctgggggtccccagcccccagcccaggcaccgtcccagatcttaaaaccctgggagggacatggtggggggtgggggccctcccgacaccacctacctttcgatggtcccggcgtcctggtcctgcctccccatgcactggagggcagccgcataggacagcaggtccggagtcaagccggcatccttcaccatgaataacacatataccagctccttgaaggcaccctgggagaccaagccagggtgagggtctggggggatggcccaacctccacatcctccctgctccctggagaccccttctctgtagccaccagctcagcaggggacagggtcaccaggcaggagtggccagctgggcagaccgatgcatccccctgaggttctgacacacaagctccacctgcagaggcagccgcatggcccgccaggtgggactgtgggaggttcacgttcctctgggaggcagcttgttaaacctccagatttgtcaattgtgtggatcttttcaaaggactgacttggcttgactgttctctgctgtttctgccttccatttcatcgatttgttttaatctttgtaacttcctctcatctacttgctttaggtttagtgacagcttcttcttctagtttcctaaggtgaaaggtgacgtatttggtctgagatgtttcactttttttccccccaagatggagtcttgctctgttgcccaggctggagtgcagtggcacaatctcagctgggccgggttctctgcctcccaggttccagcacttctcctgcctcagcctcctgagtagctgggattacaggcacacgccaccacaccagctaattttttgtattcttagcagatacggggtttcaccatgctggccaggctggtctcgaactcctgacatcgtgatccgccagcctcagcctcccaaagtgctgggatgacaggtgtgcaccaccgcgcccggccatcacctttccgaatataggcattttgtgactataaattaccctgcgagcactgtgtcagctgcatcccaggacttctgacaggtggtgttttcattttcattatctccaagtgttttcgaacttcatagtttacttcttctttggaaattttatttaattatttttttagatagagtctcgctctgtcgcccaggctggagtgcagtggcgcaatctcagctcactgtcaacctccgcctcccgggttcaaccgattctcctgcctcagcctcctgagtagctgggactacaggcacatgccaccacacccagctaattattttgtatttttagtagagatggggtttcgccctgttggccaggctggtctccaactcctgacctcaggggatccacccgcctcggcctcccaaagtgctgggattacaggtgtgagccaccacgcccagccatgtatagcttaaatatcccctgcaatttttttttttttcatttaatttttggccaggcacagtggctcatgcctgtaaccccagcactttgggaggccaagacaggaggatcacaaggtcaggagtttaagaccagcctggccaacatagtgaaaccccatctccactaaaaatacaaaaaaaaaaaaaaaaaattagctgggcgtggtggctcatgcctgtgctccctccactaaaaatacaaaaaaaaaaaaaaattagctgggcgtggtggcacatgcctgtaatctcagctactgggagcctggggcaggagaatcacttgaacgcagaaagcggaaattgcggtaagccgggatctcaccactgcactccagcctgggagacagaaactttgctgtcgacagacttggagactctgtcttaaaatatacacacacacacatatatatatatatataaaataacatatatatataatttttttcttgtattcatttttcctgacatccctgttctgagcaatttctcctttgacccagtggctgcttaagagtggcctgtaactgtaacagactattccaaagggaaaaaaattcccttacatcctcccaccccatagtcctgcagctgaagacatgctgtgacatgaggtggccacacaccagagaccagagacatgagttttggggcatttttttttttttttttttttgagacggagtctcgctctgtcgcccaggctggagtgcagtggctcgatctcggctcactgcaagctctgcctcccaggttcactccatcctcctgcctcagcctcccaagtagctgggactgcaggcgcccgccaccacacccggctaattttttgtatatttttagtagagacggggtttcactgtgttagccaggatggtctcatctcctgacctcgtgatccgcccgcctcagcctcccaaagtgctgggattacaggcgtgagccactgtgcccggccggttttggggcagtttctaaacaacctctgtatggtagacctcactggccacacatagtccttaaattgaaatattcagttcttccctttcaccagcttcaagtgttcagtagcacacacagctgttggcagatgcggaaaattcccaacatcatagaaagttctactggatggtgctggttagaatacgtggccgggcgcggtcgctcacgcctgtaatcccagcacttagggaggctgaggcgggcggattacctgaggtcaggagtttgagaccagcccggccaacatggcaaaagcccgtctctactaaaaatacaaaaattggccgggcgtggtggtgagtccctgtaatcccagccactcaggaggctgcggcagggagaattattgaacccaggaggcggaggctgtagtgagccgagatcatggcactgcaccctagcctgggcaacagacagagagtctatctcaaaaaaaaaaaaaaaaaaaagatagaagcaatgccttagcctggctaacatgctgaaaccccacctctactaaaaataaaaattaaaacaattatccgggggtggtggcacacgcctgtaatcccagctgctcgggaggctgagctcgcagtccagcgacatccaggactgctggccaccccggaacgctgggagaggcaggaggggcccctgctagagcctctggagagacttcgggtctgcagacatcttgattccagacttctgggctcgtgctaagagtgcgtttctgctgtgcaagccgccaggtttgggacactttcgtaggggccgatcccaaaagcgccctgttacagtgtgggctctctgcccagggaatccagggggcttgtgaccttggaggggaaaatacacgaccctcatcctcagtcctcccggagtctggcgccccctgcagcaaggaggaaccaggcagcacgccgcctccacctcgcggtaagagcactgcggacttcaccgcaagactggccccacctgatcctgaatttcgctgtttgatgcgttaataaagaagcacatcaagttctctaccacgaattggtcttaatattgcgatatctgtattttaatataatagtatcccatgtttacccaaatattaagagaagcttttactgttgtttctcaaattagggctgaaggatcatggggggggagaaagctgggaacgtttgctgctttgaaagggtgtgtaaacaacaccctccaaaacaaccaagagttccgaggagaaactttggccggatacggtggctcacgcctgtaatctcagctcctcgggaggctcaggggggcagatcacgaggtcaggagtttgagaccagcttggccaacacggtgaaacccccgtctctactcaaaatacaaaaattaatcgggggtggtggcgggcacctgtaactccagctacttaggaggctgaggcaggataatcacttgaacctgggaggtggaggtggccatgagccgagatcgcaccaccgcactccaacctagtaacagggagagtatgtcccagaaaacaaataaataaacaaacaaaaagaaaacggcaagggaaattggaaaatactccagatgaaccacaacgaagatgggtgggatacatctaaagctgtgctcagagggaatgcggcgccagtgaacacccacatttcacacagaaggatctcagcacagcagcccgaccttccacctcaggaaaccagaaaaaggagcaaagtcaaccccaacaccaaagcctcatcctgacgagggctctgcaggctgccccccgacgaggccaaaagcacccctgcccagacagattcacgagccccgagaaagaacggaaggaaatgctcaaggcattagcagaatttctccctacttttttggtcattttcaaaatttgagagtcacacgtgatttgtatttgaaaagcctaaaagaattattaaaataaaaaacaaaggacttgaacctgggggctaagagagaaaagtccagtctaaatgagggcaagttcctgtctccaacgaccagggcaggtggcccggctcccggctgcactcacctgccgcgcccagccaagcatcacggcgttgtacatgtccagcgtgagcagcttccgcttctgccgctggccgtggtggacgaccagcaggtggtgggcgaggggcagctggtcagtgagcaggcagcacttgaagaaggccaggagcctctgctgctgacctgagagctgggcctgcgagtgctgccccgacggggcctgctccacatcgaggctcagcttcccaggggcctcctgcagcagccgggccagctgctcctcccaggggctctcgggggcctggcgcgtgcagtcctccaggcacccggccatctgcttgctcaggagccggggctccacctgcaggcgcctggtcagcgccttgaactccccgctctggaatggcatctgcagcttcgccttcaaccgctgcatacgcatctgctgggtccgcttatccttctccagtatctttgcccagcggccacagggcaccggggtggcatccttggcccccatctggaccttcctgggtggctggaggctaccatctccactgccacattctgggagccgcgccacatccaccctgttcaccaccacctccgacacgctctcagcctgcagctgccgcacccgcgcctggagcactgtgaggggcagaaggcgaggacatgagagggaccccctccccattcgagcacccgtctctctggaccctgagccaggccaggaggtgcaggtggctgagctcgctgggacccaaggcgtgaattcctcatacttgccaacaacgttgtaaggtctgcccgctgctttccagacacacgcaccccaccacctccgcacctccccacccgagcctcacagaactcagcagccctaacaagctgccaccgaaacctgcagcaccacgtctccccggtcactggccgctcagaccctccaggtgcacaggcccagaacccggggtctgtgacaactccctccgtccacctctcagtacctcctctgggcttgcctccagaatctatccaggtggcccccgcctcccctgcccctctcactgtctagctcagggcctctgcacagactcccaggaccctgaaccgcccactccctggctcaaccatggcctgcaagttcgcaccccgcctcagcaagacccccccagctggtggagctgccacacacacactcctaggctcccagtgtctacaccggtggacgctgagccactagctcgcagggaaaacgcggctcctgctcgtgccgcctcaggttgcatttttgccaaccaatcaatgcctaagtgttctgtatctctttaaagaagccttgttggaaatctattgctggccgggcatggcggctcacgtcggtcatcccagcactttgggaggccgaggcaggaagatcacctaaggtcaggagttcgagaccagcctggccaacatggtgaaaccccgtctctattagaaatccaaaaaattagctgggcgtggtggcatgtgtctatagtaccagctacttgggaggctgaggcaggagaattgcttgagcctgggaggcagaggttgcagtgactcaagatagcgccattgaactccagcctgggcaacagaacaataatccatctaaaaaaaaaagactgttgaaataagccgggtacagggccgcgcacctgtggtcccagctactccggtggctgaggtgaaagaatcacctaagcctaggagttcctggctgctgtgagccgtgatcaggccaccgtgctgcagcctgagagacagagcaggaccctgtctcaaaaaaaaaaagggggggggggacccaggtgtccagatgtggtggctcacgcctgtaatcccagcactttaggaggccgaggcaggcggatcacgaggtcaggagatcaagaccatcctggctaacacggtgaaaccccgtccctactaaaaatacgaaaaattaaccgggcgtggtggtgcgcgcctgtagttccagctactcgggaggttgaggcaggagaattgcttgaactcgggaggcggaggctgcagtgagccaagatcgcaccattgcactccagcctagcaacagattgagaatccgtctcaagaaaaaaaaaattgctgaaataaaaagacaagcgtgatgtccgccttcagagtgctccaaaactcaggagatacttttaggattaacagttgagagctttgttttgttttgttttgtttttgagatggaatttccctcgttgcccaggctagagtgcaatggcatgatctcggctcaccgcaacctccaccttccgggttcaagcgattctcctgtctcagtctccccgggttcaagcgattttcctgcctcagcctcctgagtagctggcactgcaggcgttcaccaccatgcccagctaatttttgtatttttagtagagacagtgtttcaccatgttggccaggctggtcttgaactcatgacctcttgatccgcccgcctcggcctcccaaagtgctgggattacaggcgtgagccaccgcaccaggcctcggacccttgacctcttgatccgcccaccttggccacccaaaagtgctgggagtacaggcgtgagccaccgcaccaggcctcgaacccccgacctcttgatccgcccacctcggccacccaaaagtgctgggattacaggcgtgagccaccgcacctggccaggttttttccctttataaaggttctcccgcctctcccttcccggctgcctaatggacgcagacaggatgtgggacagaagcaccggcgggaagcaagcacagggaagctcccacctccctcccacaccaccagccaggccaggacgagggcctgccaccgctggagcctgggctgtccctcccaagtttcgcagtcatccagtctccattaggcgcctaccccccagagccaagccaggacagctgagtcagttcagggttcacatcctggctctgcacatgtggccttggcggcggggccggggggggggtctctccagacataatcttgggcctcacctatgtccctggaaagtgggagcacctggtggggttctggggagggggaattacgagagctccaggaaggagcctgctcagcaaggacagggcccatgagcggtgcaagagatgtttcagcaacgccgtctgggcgtgtcctgggacccgagaggtggagaccgccctcagcctgtctcagaatctgagcctttgccttttctcccggcagcagggagcggactctcctctcccgggccgccgtgggggtcgcgctcaccctccagcagctccacgtggccccagtccttcctgcggtcttggtcttgctcctgggggctggcggacgagctcctcctggggccgcagacgccaccggcggtccctgcgggaaagacgagagcggctgagcggggccgggcgtgtgggcgggggcctccataaaggcagaagccgaagggtcgaagggcaaaggagccctaaacgcagcggaaactctcggagcacgggcttaagttggaaagaaactaagacagcgaaggtggaagggccccgccgcggcgaacacgggcgcggaaccgccgagagagggttcctcgcactcgaggtgcagcaggtcaaaggttaagagccctaaacaccacacctggggtcaggaggctgcataagaaaccacgagtcaaaggtcagactgcacggaggagcctcagtcgaaaagcgggcaagggcgagtggaaagcggggccgggtcggtgggctgcgcacgcccaggtgcaaagaggcaaaggtcaaagcgccaaaggccccggccgcgcggggaggagcccacgccgtggcccccgggctgcctggccgtctccctttgtgttaccttctttgccggggagtcccgggcggccgcaaggccgtagggctcgtttgagccccgccgctccgcggccccagcaaagtgccgacattacgcacgccgctccaggccaccccaccggcccgcgcctgcgcatgcgcccgcgccgcctgccgggagttgtggtttcatggtcgacggaggctgcgaagggaaaccccagccggaagtagactcccaggatgcagcggaggcgcgaaggcatgcgccggtggacgctctgattggttcctcctgctgtttttaaagggagggggcgggacagagctgttgccgtggcaactgggaggcactctcaggctgttttcccgaggacctcaaatccggactttttttctgtttttctttcttttttggttttgttttggacgcgttgtggcccaggctggagtgcagtggcgtgatcatagctcagtgcagcttcgaactgctggggtaaagagatcctcgcccctcggcttcccaaagcgctgggattgcagacgccgccaccgtgcccggctttttttttttttttttcaaggcatactcatctaataacgaggacagcatctgcaatttagagattcctgtccgcaaccttcattgctccaacgacaacttttgggtaagagtcattaggatgccgtctatcatggaggaagctgaggctcagagagggccaccaagttgctggaagacacagcacgtgcgacctcagggaggctgcaaggagagaaagccccagtccgcgagactcccagcctccagcttcagtttaccctccaatccccaagccctcaggggcaggagccgaatggagcggcaggcttggattcacctgctaagtggggtgaggtcaagggaatgaaataaacctcggagcctagagcctgccctggtctccgcgtgatcctgcctaggaggagcagggcgggagctttagaatggaacctggaaggtgtgcccacctgtgtcgttcagccggggcagcaggccagaggcgggagcgcctgctgtggggcagtaggcttgggaagggtgagaataggaatatctgggggtaactgtgttccaggctaatatcccagttgcaaaggggagctggtttggtggctcaggcctgtcatcccagcactttgggaggctgaggcgggcggatcacctaaggtcagagttcgagaccagcttggcaaatacgcaagcatgcctggcaacatggcaaaaccccgtctctagtaaaaatacaaaaattatccgggggtggtggcgggcacctgtaatcccagctactcgggaggctgaggcaggagaatcgcttgaacccgggaggcggaggttgcagtgagccaagatctcgccactgcactccagcctgggtgacagagcgagaacctgtctcaaaaaaaaaaaagtgcaaagggaggtcagttcagtgcctcaggcctgtaatcccagcactttgggaggctgcggcgggaggatcgcttgagcccaggagttccagacaagccttgggcaaccgagatactgagacccagtctccaccaaaggaaaaaaagaaattagccaggcatggtggtgcacacctgtggtcccagatactcgggaggctgaggcaggaggactgcttgagcccaggaggtttagactgcagtgagctgagatggcgccactgtactccagcctgggttgacagaacaggaccctgtctcaaaacaaaacaagtgcaaaggccctgaggcaggaacaagcgtggacagaggagcaatttgagcagagtggggctggggagagggagcaaagatgtagctggggctcagttagggggcctgaccacacgggggctcgggggcctcagctcaagctatcctccatccccaaaccctggcacttcagtttccccatcagcccagaacgaggactcgacctcactctggaagggcctggcagcctccttacagcacattccagacgctgctgccgacgcctgcgtgagcgcactgatgccaccggctgggaatgttttcgacagacggcagcaccctccctcacctgcctcagtccacctcagggtgccccagcgggctgtgacctcagacctcacccactactggggtcacctgcctggccctgaatcagccaggcctggtgtgccaagacctacagacaccccctgcacccctgcaggctggcagagccagaaacttgggtggaaaccgacttctgaactatttcaccattccttatgcgttagtcttttcttttatttgatgagatcccagcactttgggaggccgaggcgggcggatcacgtgaggtcaggagtttgagaccagcctggccaacatggtgaaaccccgtctctactaaaaatacgaaaattagccgggcatggtggcctgtgcctgtaatcccagctactcaggaggccaagggaggaaaatcacttgaacctgagaggtggaggttacagtgagccaagatcgcaccactgcactccagccttgggcaatgtagccaaaccccatcactacaaataatacaaaaaaattttgttggctgtgatggtgcctgcctgtggccccatctacttgggaggctgaggtgggaagatgtagaattgcttgagccaggaggcagaggctgcagtgagctgtgattgagccactgcactccagcctgggcgacagagcgagaccctgtctcaaaaaaaaaagaacataatctgggttttggaataagacagcagtttctgaaacagctcattgcccaaattccagcctcgcaactctgtagccgccaccaccccccagccccaccatttattttaactacatctgtctccaccactcctgtattaagtaaatgcaatattggctggtcatggtggctcatgcctgtaattccagcactttgggaggctgaggcaggcagatcccctgaggtcaggagttcgagactggcctggccaacgtggtgaaaccctgtctccactaaaaattcaaaaattagccggacgtggtagtgggtggtgcctgtaatcccagctacttgggaggctgaggtaagagaaatgcttgaatccaagagactgaggttgcagtgagctgagatctcgccgctgcactccagcctgaacgacagagcgagactccgtctcaaaaataaattaataaatacaacattaattatttttcttgcttaagttttacgaagagacttaatatcaccatcaaaagtgggaaaccatatatctggccgggcgtggtggctcccgcctgtcatcccagcactacgggaggccgaggcgggcggatcccctgaggccgggagctggagaccagcctggctaacatggtgaaaccctcatctccaataaaaataacaaaaattagccgggcatggtgggtgcctgtaatcccagctattcaggaggctgaggcagaagaatcacttgaacccgggaggcggaggttgcagggagccgagatcacaccactgccctccggcctgggcgacagagcgagactctgtctaaaaacaaaacaaaacaaaacccaaccaagcaaaccccacagagtcgagaatcgctagatggaaggggatggcccaggtccctggagcccctgtgacaaattaccacaaactcggtgccttaaagcaacgttcattttcttacatttctggaaatgaaaagtccaaaatcaggactgcggggctgaagtcaaggtgtgtggaggcctcgctccctccagaggccctggggctccttcctgcctctcccagcttttgaaggctccaggtgtgcttggcctgcggccacatcactcccgtctcggtctctgtggtcgcactgcagcctcctcgtctgcctgtgtgaaatctcctcctgtctccgtattgtgaccgcgtttaggatgccccaggacaatcttctccatatcgttcagatcttcatggtgtcaatatattgagactctttttccaaataaggcaaatgtcacattctagggatcagggtggggacttacctttgggccaaccacagaggctacaaagaggaagacaccactcaatacaaagcgtgcgccagcccagccctgatcggtgtttgttgttgttgtttttgtttgagacagagtctcgctctgtcgcccaggctggagggcagtggcatgatctcagctcattgcaacctccgcctcctgggttgtatagattctcctgcctcagcctcctgagtagctgggattacaggcgtgaaaaggagcaaggctctgccccagccacagcgcggatgcaccttgaggatgtcatgctcagtgaaagacgccagacacagaaggacacacagtgtgtgatcccctttatatgaaatgtccacaacaggcccatccacagaggcaggaaggggatgtgtgggtgccgggggctggcagaggggatgagtgacagctgatggggcttcttcttgcggtgatggaatcttctggaactagacagtcgtggtggttgcacaactctacgaggtactaaaatcactgaactggctgggtgcagtggctcatgcctgtaatcccagcactttgggaggcagaagcaggtagatcacgaggtcaggagtttgagaccagcctggccaacatggtaaaactctgtctctactaaaaatacaaaaattagctgggtgtggtggcaggtgcctgtaatcccagctactcaggaggctgaggcaggagaatcgcttgaaccagggaggcagagtttgcagtgagccgagatcgcaccactgcactccagtctgggtgacagagccagactccgtctcaaagaaataataataaaataaaatcactgaactgtacagtgtaagtgggtgaattgtgtggtatatgagtgatgtttccgaggtgtcattaaagaaactcagacgcctggggtggggccagtctcaccgctgtgggtcccatccccatcatttctcacaaggccctcagatcacccttccgcggtggggggcggacactctaagaagggaagacctgggctcctgctggcgagaaggcggtggacatttcttcagtgtctggtgccgcgccctctgcccagcgtgctccgtggagggtctcattgtcttcctccagacgtctctttactggcccattttacagaggcggaaccgaagcttggggtgttggccacagggctctagtgtgggaagccaggccaggctggacctcagccatggggacccctgtccctgagactgtggcacctgccacaccctctgtgtgacccgcctaagccaggaagagagggtcaggagatgcctgagccaccaagaaggcatcccagcgtccagccagaccggttatccctccagagggctccccggcaggacaggctggtcgccatgtcttcagcctggtgctatttaaaggtgggtgccacctggggctgtggccgcagggccaggactgggctgctgggagctgtgtccccacagcggaggtcgccgcccctctcaggcctcggtttccccagttgtcaatgcctccacttggctgtgagtctgtgagggtcactgtgctcaccttttggggcccagcgcatggggcaggcagaggaagggtgggggccagccgccttgctgggtggttccccgtggggcctggggtatggctctaagggaggagcaagtgtgggtgcgaatggggccgccccattcctgccgcctccgacgtgccccgccagccggccaccgacaggtctacgtggctatcctccctcctgcccacctacctgcccaaacacacgtccccagtcgtcacctgcccacccacccgcgcattcccacacccttgtgggcctggctttcgggaaactacaatttgcggggagagaagtcccacgagggcatgccccggagcctggctggtcccacggctgacgcacgcggcaggacctcccgtgtccatctctgtccccaagcatctccgcctctgcccctctctgtctctgtgtctctctcgtctctcccggtcatcttccttgtgtctcttgactgccgccgtctttctgtctctgtctccctccgggtctctgtctccctccaggtctctgcggcccgcgtctcacactcccgcccccgcaacccgaggtcctagcccgcccggggactcggctgactcacggacacgccccgcgagacaaacaacaaacgcgcggaggccgagcgcggagtcccgcacggccgcgcccctgtgcacctggcccccgcccccgagacgtcccattggccggcgccctagcctggtcccgcccaagtggaccccgcccccgccccgaggcaccccattggccggcgtccccgccccagcgaacccggccccgcccccgaggcgccccattggccccgccgcgcgaaggcagagccgcggacgcccgggagcgacgagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagtgagtgcggggcggcgggggcctggggtggggaggcggcgggtgacggcaacgcggccgccgtcttcacggtgacctgcgcccgcgggggagtcccggaggctcctctgtgcagcctcggcctcagtttccgtggtctgtgagatgggtgcagcctgcctggtgggagggttgcactgttaaagcgaaggctgcagcggcggacccggctcaggggcagagaagcgtccgtgtggtacaaccctgtgggtggggccacccatctgcaggtgggaaactgaggctccagaggggctggggcaggcccagctgcatggcggaagcggcggggggctgacctccggactcctgacatcacagaatccagtcagggctgcctgagtcggggccccctctgcttcttcccagacaccccatctggcaggtgaggacaaggaggcacacagaagggatgggacctgcccagggtcacactgacaggggtggcggagctgggtccccacagggcccaggacgtcacggagcgggcgtctctgtccccagggtctgccgagcacactgaggtaggccctcagtgtttgtggaatgtcaggagcaagaggagaggctgggcacagcaggggatgtgggtacctggaggccaggggagtcggtgtccccgccgggcggggggcactgggaagggggcccgggcccgctggctgccgcctgaatcaccaccatcagggcaggtaatcaccccctgtccttcccaccgctttcatctgggcgccaaggccctcattaggccgcacgtgacgagggcggacaggggactggctgggccggtccatccatggcgggcatggccaggcggggtggcctcgggccggggcagaggcctggctccgctgcctgacctggaacagtctctgcctctctccaagcctcggtttccccagctggacggtgatgggggtgagggctagctgagggctctcctgcccttcgtgcattcgctggtcactaatcgggcaccttgtgggtgctgtgctccgcatgggggacccagtggtgacagagacgcccaccctcctggggctcccagagcagaggcgcgcagcagttagacacgtgaacaagggcgcaggtgggtgcacagaacagtgaacggttggccgggtgcagtggctcacgtcggtaatcccagcactttgggaggccgaggcgggcagatcacgaggtcaggagatcgagaccatcccggctaacacggtgaaaccccgtctctaccaaaaatacaaaaattagccgggtgtggtggcgggcgcctgtagtcccagctactcgggaggctgaggcaggagaatgacgtgaagccgggaggtggagcttgcagtgagctgagatcgcgccactgccctccaccctgggcgacagagcgagactccgtctcaaaaaaaaaaaaaaaaaaagaacagtgaatgacgtgaacaagggtgcaggtgggtgcgcagaacagtgaacggcggtgttgggaggcaccttgccaggggaggggaggtgcagggcgaggaaggggccaggggagatcgtgacacagacgccccagaacaaccacctcaaagacgttcctgtgtgtcctggaaggtcgggctgggaggctgccccgaggagctttcactttgacagggagctggccgggcacgcagggaactgtacacccagctgacaaagcggcagacacccaggccggggtgagcgagtgtgggtgaggagtggcggctggccccagggtccttgctggacaagacacttcagctcagggtggggcagggctcacccagggctacccacagacgatggcgtccaaatctggctctgccactcccaggcctcaactggcccctctgcaacgtgggctgctgagcgggcttggtaggacagctggcatacagtcggcgctcaagcatgtctgtggtgtcccataaaccaccggtgtcccactctaggccactgccagcccggcctccagtccagagtcccagtccggagtcccagtgactgtgcgtgggccgggcagctgagctgtgagggccgggctgggggctccatatggggtggtgtgagctgtgagggccgggctgggggctccatatggggtggtgtgagctgtgagggccgggctgggggctccatatggggtggtgtgagctgtgagggccgggctgggggctccatatggggtggtgtgagctgtgagggccgggctggggggtccctggggtggtgtgagctgtgagggccgggctggggggtctctggggtggtgtgagctgtgagggccgggctgggggctccatatggggtggtgtgagctgtgagggccgggctgggggctccatatggggtggtgtgagctgtgagggccgggctggggggtccctggggtggtgtgagctgtgagggccgggctgggggctccctggggtggtgtgagctctgagggccgggctggggggtctctggggtggtgtgagctgtgagggccgggctgggggctccatatggggtggtgtgagctctgagggccgggctgggggctccctggggtgctgctggtcgctggctcattgacagttatcagtggtctgggtgggccctgccccttctgactcccacatcccaggaaccctttcccaaccttcctcgtggtgttgctgcccccctgacgtccgtccctctgggtgtgtgggagcccccccgccatacacacacacagatgctgctcttgggctgagctgcagggacagcgctgacctggccctcccacggggtcctcatcgatctctgcactcccccagctcgtgggggccgtcctgcttcccgttccctctgcctgctccttgctcctccctcacatgctggggggggctcctggtgtcagtcacggctctgggggatcctgagtgtccgtcgtggtcgggaggggactcgtggtcccgggggtctcctggtatctgtcgtggtcctgagggccctgcacgaagcacagcggacagcagcggtgctgggggtgagccagcaaggccctccccgacccccgcctcccccaggcatcctggagatccgctctgtacacgtgggcgtcgtggtcatcaaagcagtgtcctcaggcttctacgtggccatgaaccgccggggccgcctctacgggtcggtgagtgccgggcagggctgggcggcgcgggcagggtggggagggtgggccggcctcacccccgcccgcagcgactctacaccgtggactgcaggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctgaggccctgagaggccggcggctccccaaggtgcctgggctggtggcgaggggcccggccacgcttgttcttccccctgcgggctctgtaagcgctgagtgcccaccgtgtgcgggcgctgtggacacagcccaggagccctccaggggggtcccagcctgagggggtggtggccaccaagcaggttcaatcctgagttggggacctcgaggacccaacagggcgcctctcgggctgaaggacgcagacgtcgaaaggtcgagggggacgtcccaggcagggcccggcagaggcaggggctcggggtggggagcacgttgggagtgggggcaggagcggaggggaggggagggggccggggagacggtgacagacgccgcagaacaccagcctcgaagccggtcccgtcccgggaatctgcaaatacaacgccttgcgaggacaaaggcacctgcaggtgggacggagatggaggagcatccagggtggggggtccagggccccagtgtcctcacagggtcctcacgacaggaggcgggacagtgagagccagagagagatggggatgggccgcgctgtggccgtgaaggggaggaagggccctaagctgagggacgtgggtgcctccagatgctggggaaggcgggaacggttccgcactggagcccccgggagggaccggcctgctcctgccttgatatgagcccagtgggacccagtttggactctggcctccagaaccgccagaaaataaacgtagtaagccatcaactttgtggtcttttgttacagcagacgtcggaaatatgcacacggtgtctgaaactgttctcatgacaaaataagcctcagatcccccggggaagggcggaggccaacgcctcggtgttcctccgatcccccgggaagggcggaggccgacgcctcggtgttcctcggatcccccgggaagggcagaggccgacgcctcggtgctcctcagatcccccgggaagggcagaggctgagggcaggagccgtgctgggtgcagggcaggcctgggggcttcatgccgctgtcctgcgggacgcagagagggctggccgtcggtgtgggggcgcccccacctgtgcccagcgccctcctgacatcctgactccgctgggacttctgcctacagccctgggagtcaaactccagcctctcagagaaaaggtcagagccaagagccccacagcctggagccaggcagtgacaccctgggcctgtctccccttctgtgtgtggggcgacagcagcatcgccctggtgaagtccccggggacggccagggctccatccccagccgccgccttccacataaatacaggaagactgggccgaggcacttgctgggaggtgctgagcagcctgacacggaaaacccttctgggaagggagggtcgtgcccggcccgagagcttctgctcaccctgcagacagaagcgagccccaccccaggggacaccaggcggcctctggggacatctttggctggcatggagtgggtggaggacagggctgcacccaggatgtccccaggttggcagtgtgaggggagatcggcccacgttggccagtcggagggcgtcgccacttgagttgtcactgggagctgcacaggtcaccacagctgaaataaaacttgctggcaccccacgcaggaacgtaacatgtgcctcgaagaaacgggtcagcaggccgggcgcgggggctcacgcctgtcatcccagcactttgggaggccgaggcgggtggatcacgaggtcaggagatcaaggccatcttggtcaacatggtgaaaccccgtgtctactaaaaatacaaaaaattagccgggcgtggtggcgggcgcctgtaattccagctacttgagaggctgaggcggggaatcgcttgaatccgggaggcggaggttgcagtgagctgagatcgcgccactgcactccagcctgggcgacagagcgagactccgtctcaaaaaaaaaaaaaaaaaagaaacaggtcagcagttgtttctttgtttctaaaacagagcgtggaatgggcgtacagctccgcacatcccagggcagtgaaatcccggttcacacagagccctcagcagcttattcgcaagcccaaacctggggacccccgttgtcctcaggcagtgaggtgggggccccccaacagagaggagcggcctgggggcacagaaccagcggctccccaggaaatcgccagcagtgaaaataagacaaccccaaactgttgcaaactgtgcttccgcttacgaagcactcctgagcggcagggcggatggggagagggcggctgcaggcgcgaggggcccggggacgcaggggtgcgggccttaccagggccctgtcctgtcgtgcagcaggctcctggggcagggaagacaccaggggcggccacttcttactgctgtctgacctcgagcaatgcggcctcacagcccccaccagggtgccggtgtcctctgggcccagcgcccccgaggctcatgcctgggtggggcgaaccaatcggtcctgctcctctggccactccacgcgagggaagtcccagcctcacaggcaggcgcacaccccggcagcatctctgacaaaggccctccagttccgagtctccaggtcccgccgctgcaagcctcacctgcccagccctcctctccagctccaactccaactcccaagaaccaccacggacacacagaacccgagccttgtctccctcaacgcctcctgactcaaaactccatcttccaacaggaaaacggctcggccgggggactgtgacccggagcaggcggcccagcctgtcgcgcagactcggggcctaaaacacttgttctctcagtccggagatcaaggacgatccgaggtaacctccctacctcggtgtcctccatgcaacctcgtcttagggcaccgggtacgttacctcgtgaggagccgagtccgcgggtcctggggttgagatgtggacgccctcagggctggcactctgccctggcggccacagtcatggaagtcccaacgcttctctcggctccgcaaccccagagggcggccacgaggagggcccgccacgcacgaccccagagggcggccaccaggagggcccgccacgcgcgaccccagagggcggccaccaggagggcccgccacggcgttgcggcagcagcccagaaggtgccctgcgcacggtccggacaggtgggatccgagttacctggccaagggggctgacgcagacacgtcgcgggacacagtgaagagtgtggtgcagagcggagggcgggagtctttggagaacaggtaggggcgtggggcacgcgcctcccacgcgcaggagccgtctaccgtggagggacacgggtggtcctgctggaggctcctctccgttagctgtctccatcgtctgattcttggatcccaggatggtgggatcatcagcaactgagatgaacccactgccccggccccctgagcccgcaggtccccacgccttgccagctgtgcccgagctggctgcaccccgggccaggcatccagcaaccttgagcagtggggtccggcttttcagaaggggccaggaacccgcgtggctgaggtgtgaccgaagcgtggggcagaggcgctgggccctggcgctttaacgctggtgtttctggttttaaatttcacgacccagtgacactgccaccctgctacctcgccagcagccctcctgggcttaacttcgggagagcagttttgctagccggccctgggtgccaagccctgcaggaggcgcagacccctggagacaggaccggactctgcagagcccgaccagcctcccagcttggccttttcctgacgcacgggcgcagaaggaaagccacagcaccggcttctctttgtaagtagtgtattttaaatagctttcaagatacacatattttttcctttaaaaaagtctgttggagcagttttgttcttgaattttgctggtcatcctcatggtcccgagcccccctactccgggtcgtggaggcggccgagggggaggctgggggcccacgtggcccgtcctggcggcacctgcagcactgggggagccgctgaaccccgtgcttcagcgctgggggagccgctgggccccgtcttccgccacaaaccatgcatggccgccacgtgagctcaaacgtccgtttatttcaaagcagtaataatttaaaattataaaaatctttccaccgctgaacgtttagagggtgaggttagacagaggacggggaggctggggacgccccagaggggaccatgtggcccacgccttcccaagccagggggccggtgggccgggcccgggtcctgccctggaacaggcgggacctgcagcgctgaccagccaagcgtggcgccgccggggcacccagtctgtgggtgccgtgtggcgctggctgagggtgggtgggaaaggccccgtgctttcccgacggccgacgtgggctcacgagttgcttgtggcgttctcgttgctgggcgagctggaggaggacgatgacgacgaggaggagaagctcaccccagtgaggccaggggggttcgtggccgtgttctgtcccgtgaggctttttcggcagacggggcagctgtcgtgctttgtggggacagaggcagggacgggagaaggggcaggttagaggcgggagggccgcggtcggggtgggggggcgggtgggcggggcactcacctgctccagccagggcacgatgcagccgtcgtggaacaggtggttgcagggcagctgccgcacacgctcacccagcgcgtagtcgtccttgcacacagggcactcgagcccggagcctgcgggagtgtgcagctgcggtcacagcgggcgtggggggcctgccgagccttcaagggcaggctactccacagcctcagccggaggccgcccctgagcccagcgaggggagaaaagccgtgtgtgtgtcccccgggctgccagaggggacctggacagaaccctctcctcccagcccaccttcagggaaatgctcgaggccgggtgcggtggctcacgcctgtcatcccagcactttgggaggccgaggcaggaggatcacctgaggtcaggagttcgagacctgcctgaccaacatggtgaaaccctgtctctactgaaaatacaagtatgagccaggcgtggcggcgggtgcctgtaattcccactactcgggaggctgagctctcatacctacgtgctcctcagtgacggggacggtggggagggcctggattttctctttatctgccggtggggggcctgtgttttcaaactgattgaggagctgaaagacaagaggcgagagtgccgggagctcctcgggggcccggcccggggctctgaaacgcgaggctgcaggacctgcaaaagcaccgaggccgcgtttgtcctgggccctgggccccttggagcccgcccggggtcggagatcactgtggagcccacgcggcccccccgctcctgggtcccctgacggtggaatgggggaatgggcggaggcccgcgctcctgggtccctgacagcggaatgggggggggggccgcgctcctgagtgccctgacggcggaatgggggggccgtgctccggctggtgggctactgtgagggtcgggtcctgccagtgacaaaatgctccaagggctcctcagcaaggctgagacgggtggcacttggaagcaggtcagggcgcgacctctcgggaagagggaccgcgtggcctcctgaccatgtgactgtgggcgagtcctccccgcggttttgctacaacgttccgcgtgaacacaggagaacccccaaagttgccaagactcagaaatggcaggaggaaggccggagctgccccctgtgcccgccagagcgtggaggctgtgcccgcatcccctttgacctttgtggggcttcgtgggtccaggcagtggggcagctcccaggggtgggcagcccagccctcccccagcaggcactctgggccgtggccacgctgtacctgtgtgatgatggcatccaggccgttggccccccaggcgtagtccatagggtttgagtgcaggactcccctggaggtggaaggtggggttcaagtggctgacgggcagctggggcaggtgcgtctatccaccccactcaccaggggcccaggctggggatggggacaggcaccccctcctactcaccagggaccctggctggggatggggacaggcacccccacccactcaccaggggcccaggctggggatgggaacaggcaccccctcctactcaccagggaccctggctggggatggggacaggcacccccacccactcaccaggggcccaggctggggatggggacaggcacccccacccactcaccaggggcccaggctggggatggggacaggcaccccctcctactcaccaggggcccaggctggggatggggacaggcaccccctcctactcaccagggaccctggctggggatggggacaggcacccccacccactcaccagggacccaggctggggatggggacaggcacccccacccactcaccaggggcccaggctggggatggtggcgggcgtgatgatgccgttgacgagctgctggatgatcctggaaaagagagcgccagtcacggggtgaggccgccccacgcacaggagaggcgccaggcctgccaggtccgtggtgagcaccaagggcagggccagcatcagcttctagattagcttctatttatttattttactatgagccagggtctcactctaatgccgaggcaggagagaagcagcttgatcttggttcactgcagccccaacctgctgggcttaagcgatcctcccgcctcagcctcccaagtagctgggaccacagaagaggtccaccactctcggctactttttttttttttttttttttttttgagacagagtttcactcttgttgcccaggctggagtgcaatggcacgacctcggctgactgcaacctctgcctcccgggttcaagtgattctcctgcctcagcctcctgagtagctgggattacaggcgcccaccgccatgcctggctaatttttgtattcttagtagagacggagtttcatcatattggtcaggctggtctcaaactcctgacctcagtgatctgcccgcctcggcctcccaaagtgctaggattacaggtgtgagccacctcacccagcctcagctactttttaaaaattagagatggggcctccctacattgctcaggctggtcttaaactcctgtcctcaagagatcctccctctttgacctcccagagaactgcaaatacagcactgagccaccgtgcctggcaaaattagccacttttaaagatgacatttccagcaggtgagacacacaaccataaaagcatcaaccgccaggagtagggccctgcgacggctcccccaggctctgttccaccaggagcagggcccagcgacggctcccccaggctctgttccaccaggaatggggccctgcgacggctcccccaggctccgttccaccaggagtggggccctgcgacggctcccccaggctccgttccaccaggagtggggccctgcgacggctcccccaggctctgttctgggcccaaggcctggacagcgtttgacgacacgcgtgtggacagcagtctccagagcacgtgggcctggcaggcacacggtgccccactctgtggtcaacccacacaccctgaaccggcatacttctgtctccgaagggccgtgtggggagtcacagggggctggagggcctggccgggcggcctctccagagagcctatggatgatgccacgtttccgtggaacccgtgctggattctaagcgccagaacttccgacctcaaggcgtggggccctcgcggccacccccggggccccctcacccttccagcgtggggacgccttcgtgccggccggtggcccgccgcgtggtgaggcgggcgcggggctgtcgggcgccgtaccggtgccgggacggatggtctctctcccgccggctctcagggtccctgccgtcgtcagcctgcgccccaggagggaacgtggggatctcgaagctgtcatcgaagatgccgaaagcaaactgtccgtagccctgcggcagcgtgaacaggtgctggtccacgtgctggggagaggaggggggcgtgacctcgggggctcaggcccgtgcagtctgctgggggcgctagggcacaaagacaaaggagaaagcaagacgggccctgctgggtgccgggtgggagggagacgcagacagggaggcaggaattgggcagagcctgccccgctggtgtgagatgcctcggtggaagtttcgctttcatccaagaaaccaaccaagcagcgtgggccgccccaatccctggcccgggcccctggagggaaaaatttcctccgccgtgcgggcagggagagccggggaggcgaggtggggacaggctggcgctcggggccccgagcaaggctgacacgatcgggaagcacgaggggcgggcgactcacctccaacggtggccggctctggtctgtgggagctgtggagggggcagaaccattttctgtgctcctggggagagagtgcaggtcagcagtgccggctaccctgtgcccccatgcgccaggcgctccctcccctcaaaagcctatgttgggagagcaggaattgtccttggcactgcttcccacccgccaccgccccagcatttggtgccgtaacccgctgctgcttccctcgccagtaaaccacgggtttctcgataaaccggtgcagaccccaacagcctcctaagcgtgagaatgtgggtagggcccccgtggccccttccccggagggcctgggtcaccagattagccgccgaggctgagggaggtgagcggctgcacaggttgccggcactcccctctggccccggcccggccatcacagaagagaacggcacgctgctgtctgcacagagaaaagtgctcccggagccacagacaccagggcctgacggccccacactcggcggggcggacgccagcacagcccacacccctacaacagctgaggcccggctggctcttccagcctcttcaacagggggctgcattacctggtctcttccggaagctcctcgataaaaccagactcgcatcttggacagatataatcctgcaggagagaacaggaggccgggtcacggtgacgccggcatcacctgcaaacccccccaagtgtgaggacagaggggctccggacccagcggtctctggctggccaggcacacgcaggccagggtggctcccaacccgtgggtcctggagggcggccgaggggacctggcctctgccagccacccgctgaccctttggtggctcccggcgatctgagcccctccgacctggccccaccgtgacgggcgtcaccagcgtcatcagcgccttggctgagcccctccgacctgccccaccgtgacgggcgtcaccagtgcctgggcacctcctcacacaggtggcaccactcggaggggtgccccaataccccacagtggcatttccaggacgctctggcagccccgcacacagcccgttcccctggctcgggggaggccacgtccacgctggccacacccctgcaagaccccatccccaggtccccctagagccaaggacaacacaaggccaacatggtgatgtcccagaggagacgtgaggaccctgcccagggacagccgtgggtgagtcccaaaaccacgttcacagttccccagcaccagcctcaagccacagctgtgccgagcaggacggatgccatcccctgtggatctcacactgcaacgggatccccagggctgaagggcctgctggagacactggctcacagggcggactcctcatggatggctgggcccctggtgatggcggagcgtgccgagcattcgtggggcctgggctgaaacgtgcatggtgcctcccggcctcaccaggggctgggcagatgccgacacacacttcccgcacagcctgcagaactggaaactggaagctaaatcaactgctctctatgaacgacccagtctcaagtgctccatcgcagcaacgtgaaaatggcctcacacggcacgtgtcatcacgccaggggctcacatgggggtcccaagaccacccccaggtaacacagacaaaaacaggagacaaggctcccaccgtgcatgggggagtgctgtgaggggagccaaggtcgaccccaggctctggggatgcaggttgcaccggggctgttcagtcttcgcaggggcaggggctgggacctctccagcaagcaagatcccggcctcacccactgactctggggagaagcgggggtctggcgtgcagtgcccaaggggagggccgacagctgggcccccgcccacaccacgccgtgcctgcctcacctgctcctgccactgaagcacaggctgggtggggagggactaaggccagggtgagcaaacgatgccagatgcacatgaacccaccgtgaggggagagtgaagaggcaccatctacaatatagaaaaagtgcggcccggctcctggtgaggccgggaggcaccacatgcgtttcagcccacgccccacgaattctcggcacgctccgccatcaccgggggcgcggtggctcaggcctgtaatcctggcacttcgggaggccgaggcgggcggatcatctgagatcaggagttggagaccagcctggccaacatggtgaaactctgtctctactaaaaatacaaaaattagccgggtgtggtggcgggcgcctgtaatcccagctacttgggaggctgaggcaggagaattgcttgagcccgggaggcggaggttgcagtgagctgagattgtgccattgcactgcagcctgggcgagggagcaagactccgtctcaaaaaaaaaaaaaaaaaaaaaaaaaaaaaaaaaaaaagtgctggccgggcgcggtgtctcatacctgtaatcctggcactttgggaggccgaggcaggcgaatcacctgaggccaggagttcgagaccagcctggacaacatggagaaaccccgtctctactaaaaatacaaatgttagccaggcgtggtggcacgtacctgtaatcccagctactcaggaggctgagacaggagaatcgcttgaacctaggaggcggaggctgcaacgagccgagatcatgacattgtaactccagcctgggcgacagagtgagactccgtatcgggaaaaaaaaaagtgcttacaactcaaaagaaagaaagaaagaaagaaaaaaaagcccaggccaggtgcagcagctcacacctgtgatcccagtactttgggaagccaaggtgggcagaccatttgaggtcaggagcttgagaccagcctagccaacatggccaaaccccatttctacaaaaaacaaattagctgggtatgctggggtgggtctgtagctccagctactaaggagggggaggagacaggcaggagcgggaggcaggaggcagaatggcttgagtccaggagatcgagaccgcagtgagctgtggtcccaccactgcgctagcctgggtgacagaaccagaccctgccaaaaaaaaaaagaaaaagagaaacagacaacgcaactaaaaacgggcaaagtcgggaggctgaggcaggagaacggcttgaacctgggaggcagagcttgcagtgagccgagatcgcgccactgcactctagcccgggcgacagagtgacactccatctcaaaaaaaaagaaaagtggggggggaaaggacgtgtacaggacatgcctccaaaaacacgctgggtaaacgcagccggccagccccagcgagatgccacttcccagggccagccaggacgagatgcaagaccccgtcaggcctgctgggagcccagaagtcccccagatggaactaccccatgacccacgagctagaactttcactccaggcgcagaccccagagaaacgaagacacctgcccaccaaatgttcacatggccagaactggcaggtgagagttcacggcagcacagttcatcatcgtcgtcggcagatgcaaacagctccagtgtccacccgcacctcagagcacgactcaaccatggaaaggggcaaggcccagaccaggccacggcgggggggaggggggattgcatcttgaggacatcacgtccagtgagagatgccagacacagaagaccacgcagcgtgtgatcccacgtctatgaaatgtccaggacaggccgagccacagagacagagaggggatgtgtgagcaccagggcctgggggaggggacggggagtgacggctggcagggctgaggtgggttctttttgcagctgtgagaatgctgtggaattagactgtggtggtggttgcacaactttatgaatatactacaaacgtttcaccaggtgaattatatggtgtgtgaaaatactgagataaagctattaaaataaatgggccaggcgcctgtggtcccagctgctagggaggctgaggtgccaggatcgcttgaacctgggaggtggaggctgcagtgagccaagattgcagcaacagagtgaggcagcatctcaaaaacaaaaacaaaaaaaagaaagaaacaaagaaaaaaagggctgggcacagtggctcacacctgtaatcctagcactttgggaggccaaagtgggcagatcacttgaggttaggagttcgagaccagccaacatagggaaataccgtctctactaaaaatacaaaaattagctgggcacggtggtgggtgcctgtaatcccagctactcaggagctgaggcacgagaatcgcttaaacccggcaggcagaggttgcagtgagccgagatcataccactgcactccagcctgggccacagagtgagaccgtgtcagaaaaagaaaaagaaaaagggaaaggggaaggggaagcagccaacgaccaccactgtggccctgagcttagtgtgggagcagtgtggctctgccacagtggccgtgacaactctccccaggcgtcggttcttggggtgtgtttggggtgtcgggattgggacgccccacgtaaacacgctgagacttcacagtcaaatctgaacccctggtttctgccggtgtcgggtctatcggggctcctctgggctcaggggttgccgccgtccgcccgccagctgaccgggagcccagggccgctccatcgcctgggtgggtctctgggaatggaggggtagctcagggctcaggctctccctgcatggtgactccccaggctagcaccacccagtggacctggaacagctgcactggcccccactgagggcaggacgtaagtcagctgtgcagctgccccgaccaccatctctcctgctgggtgcatccacaaggtcaggcagccccagaagggcctgagggagaagctgtctccctctgaggaccctggcttgccagccccagccccgaatctctcctggacaagcacgaggccctgcacacgcccacgtggcctggcacagcgctcggccgctctggtccccatgtgccgagctcagcccctctgtgcatcactggctttctgtcgggctcccgggttcccgtctcagtccagggcacaacgcatgctcccgccacccgcactgccggctcacgacagcccgacctggccacatacacactcatctgccccagccctggcctcctcttggcccccgctgtcctgcccgcagcggccgtggggcctggtgccacagcactgtccagaaccctctctctgcagcacccactccagcgtcggggcctgtgcacgtcggccctgctgctggaacgcccaccctaggggtttcaaaggtcacctctctgctccaagcctctgccctgtcacagaggacagcctggacactcactcatatctgaaatccgggtgccatcgaggacgccaagggctgcgacccaactcctgcgtattgtcagggctctgggctgtctctcaggcccccggccagcccctccagggccaccgaaggccggaaccgaggctctggtcacgaaggcaagtgacaggtggatcccggatatccagggtggaggttgagcctctgctggccgacggtgggaggggctggacctgggggtctccagccgccctcctcctccaagggcacagccaagagaccgcttggtctcgtattaaatcggggcagctgcaggtagaaacgcctgggcaagggggcctggtgaaggagctgccccaccttctccgggggcagcacgcactgggggcccccacagaggccccattggagcctctggccctagcagaagacggtgaatccattcacctctccgtcagagaacagatgcaggaggtacgatcacccggcatcatcaccatagcaacagctggccaggcagccagggtaggggggaccctgccagtgccgggctccacccatgcacccctgcagcgtgatggcctcatccccgggtgggacctggcagggcagcagaggccccttcatccacggggcctgcacggggcgcatgtcctgagggcccagggccaggcgcatggaggggagtgggctggcgacctacaggccccagatgactgacagtgaccagggcaggcaggcccctggtgacagtgactcggcccctgtgggtggcagggccctcgggaagctgtgcacatcaggagaccccagggagagtcatggtgcagtgctcggcctcggtaggagcccccgtgctggctactgttttcctaaagggtgcccaaagcttcccggctgatccacagtgtgtgggccccgcagccccagaggcacgggcacgtgcggcgcctgcacccctttcttcccgccctcagcagctgccaccacatcccacattcacaccgtctgtccctgggccccacgcaccacacactcccaagacaagctggatggacgaggcgtgagcgaagccactgcctcagcccaggctggggccccgcctcacaccccagggcgtgcctcggcccaggccccgaactctgccttcttcttcccaggtggcttcaggcaccaccactagggactggaaccccacaggtgcccatccgtgccagtgccaggggtgctacggctcgcccgaggctcagaggaaggtcctcatggtggcagagttctaagtgggaggaaattcagcaccggcatctgcccgaggcagaccccagcgccagccggccagagagggcagccgacatccacaggttcccggggtattgctggtgcccgatcacaacgccaggctccatgttcacagggtgctgcagggagcccgttccggagaacccagctgtgcagagccgctccagggtgctggccggacgcttgagaggcaggggcaggctgtcactgtcacggtatctggcacaaccgcagacacacagagcaagcagcggccagagacagacccaggccgtcttctgaagactcgggccaggccgccgcagggaccaggagaagacagggtgggccggggggcagctggggagacttcccgcctggccccatcagtgacactggccgtagcagccctcacttcctggtggctccccgcccacgccggctcttccccgccaccgtgggcggcagggcccagcacccccaccgtcctctcaccgccacttggggacactgcggaggttgcaggcgttcgggggtggggggtcggcaggcagagctggaaccaccctaggaaccacccagagacggggaggtcaggggcaaggacggcacgcagggccacctccctgcgcccgcctggttcctgggggctcagtgccctcagcagctctcgcccacaccctacagtcacagctccagtcagtgcctcctcagcaggctcgagtctgggtctgcgcagccgcctgtggcctgagctccagctggcctgtctggttcctgccgccacacgccccactctggctgacgctccctttgctgctcagacacccagacaccctcgtcatcgccttttttttttttttttggaaggagtcttgctctgtcacccaggctggactgcagtggcacaatctcggctcactgcaacctccgccttccaggttcaagcaattctcccgcctcagcctcctaagtcactgggactacaggtgcctgccaccacgcctggccaatcttttgtatttttagtagggatggggttttaccatgttagccaggctggtctcgaactcctgacctcaggtgatccgtccacctcagcctcccaaagcgatgggaccacaggcgtgagccaccgcgctcggcctcatcacagcctttcatgggggcaactgctgcccctgtgccgtcgtcgcctgagcccccgaccgcaagtgtggctccccgctcaggacaccctcacgagtcaccaggagagcggccaggtgccggccactctgcacacacgtgcccaccagatgccacggggagcgaatcgcatcactaaacccacttggcaggtgaggagactgaggccaaggctgcccagcagagaatgacccagctgcgcggggcctcagcctgatcccagagcccaggacagcaaaggaggcccggaacggcccagctgcctgggagaagccctcgtgggcaggcacacagcccatggcagccagtcccccctgcgtcagaggcaggcaggagcttcccgacagccagcccaggtgtctcagcagcagcagtgccgcccctgactcagccgccgggcaagctccccagcggcagagacgccccgtttcgagggcactggttgtggctggggactttccccattgccagatacggagcagccgtccctccccagaacaaacgccaggtgtgcccatttcccagcataaaaaattcgtttttgagacagcgtcttgcttgtcacccaggctggagtgcactggcaccatcacggctcaccgcagcctccacctcccaggctcaagcgctcctcccaccacctcagcccccgccagtagctgggactccaggagtgcaacaacacaccccactaattgttttagtcttctgtagagacagggtcctgccacgtacggagaagttctgacactgccatgctgtctacgggcgccttgttgcgtcctgctccaaaggcacaagcagatgcccttgggatcacccgcggggtggacacgggcaggcccccgcagccctctctgcagttatttgctcttaaggaatctaccaacgtccatgattaaatatttgtcaatcactgttccatgctggctccctggccagcctgtaaattctgtgagggcaaagaccacagcggcctgtcaccacagagttcctttcactacaggaaggccctccccaggcccagtgacagtcggaggaggtcaaggtcctccgtgtccaaggccacggggcgaggaagtggctccaccacaccaggatccagtcctgtgcgggctctaggagcagctaaatgtgcagccgagtcaaggcagtgtcggccccccacagccaccactccaggcttcccaggggcttcccaggcctgtcccagggctcaaggggctgcaaggggctgccctgcaactcacccaggctggcgggctgtcaggcaaccagcctctcctgccacggccagtggggacagaaagctggaagaggcaagagcgagacccctgggagacagaggagtaaggcaaggctcagtctcagctccccaaccttcgccccacacccgagatttcactttatttgttcctcctgctggggaggggaagccctgtggcttcagtagagaggaaaccacacctctctctttccactcctgggcctggccccgctctcccgccatgccccaactctagcactcgctcctcctctgtgacccagagacaggcggcttctcctgactccctccagccccttcctgggtctctactcccggggaactgcactgcttctggggggcttggacttctcttacgggtcaaagcgtagcaacagccgggcggctacgtacacagcacagtaaatcctcaatgcctgcagcctcttcccctgggcacagggtggggagtccagacccctccacctcctgcggctgctcccctcaagctggccaagcggctcccgactgagccggctctgccactttcccgctgagccaccacgcgcctcagtttccccatctataaagcacgggtggctcgactaaatcaccactttgcacgtcagcctggcgaagggcaacacgggttaaaaatgcagaccaccgccgggcacggtggctcacacctgtaatcccagcgttttgggaggctgagccagaagaatcgcttgagcccaggagttcaagaccagcctgggcaacacagggagaccccattcctaaaaataatattagaaatgcagactgctgagcgcattccacacctactgactccgaaaccctggaaaaggggcctggaaatagcaccttcaacgagcgctgctcccacctcccccaaggtgacatcaggtccgcgtgggaaacactgccctaaacgagcaggaagtagcactcggcacgcccaggcccagggtcctcttcggtgaggggcggctgtaaacacctggaggaagggtgggctgcgcagccaagccccgggaggggaggaacgcaggctctgctcacaaagccccgccggcgggccgcggtcggaccccgggacagtgcctggggcgttccgggcctgggcctgcctccaaggcggcggccagggctccacgaggcgagcctgcagcgaggcgccggcgcccccaaccacgcgctcggcgggggtcccctggcgttattctcggggtccgagccccgccaggcccagcccctgccccgcgccgcgccaccgggcaataccctctctctgctcgccgggcctcagtttctccgtttgcaaaaccaggctcaccgggcttagggatcccacctgggatcctcgcggcctctcgggtcgggaacgccgcggatgtggggtcacccggccgcgatcccgctgcgccgctccggccaggccctgcctcccgcccgggcctcagtctcccgcatgtacaggacggggttcgcgcgcgcaccgcccgggctccccgcggattcagcctgggccggcgctgccccgagcctcagttttcccgtcgtggtcagctcgcgcaagaggcgggcgcaagcgacccccaccccggccccggccttgcctcaggcctgcggcgcagaccctgccgcccgccgccccggcccgggcctcaccggcaggcgcgggacgatctccacggagcagcagtggcagaagtaccgtccgggatgcggcgacgcctcggccatggccgccgccacctactccgcgccgcccgccccccgcgcggcacccgccgccggccgtttgctgctccctcgccggccgacgcgcccgcgcacgctcacgcacggcacgcacggcacgcggggcggagcgggggcgcgggagcggcgaaagctgcgtactcggcgggcagcggcccgggcgacggtggccgctgagagacaaactaggcccggccgttgggcggggctccaagcgggggcggggcttccggcgggggcggggccaaagcaggcggcggaagagacgagaagcggggcgtgcgcggggcggggccgaggccctcctcccctcccgaagctgcccaggccttcgtgtccctcagtgcttccctacctcatcgccgtctcccctcacggtacttcagcccactgtccccaccgttcctggggctcgccaggcgccctctcccccgcccgctgcccggtgcagcgctctcccgacgcccgcgtggctttcttccaggtctttgctcaaatgtcagcttacaaggtcttctctgctgccctcctgctccgtggcactgattccctcccgatgcactgtcaggtcagctgcgcagcaaagggatttttggacccgcagcagcgcctgacacacagcaggcattccctcagcgctgcggaatacaggcagacccggggctcagggcgctgtctgggcctcactgggacccgtggggtcagacagaggctgaggtctgtgggttgtggccttgtttccaagatgctccacgggctgacggcccaggcgcctctcgggtgcggagaaggcaggaaacctaacccctgcttccaaatttaatcagtagaaacggtatcatcacccagcacaggccaggatcatttctgaggttagttctggcccaatcatgcatgcatttcttttttctttttttttttgagacggagtctcactctgtcacccaggctggggtgcaatggcccgatctcggctcactgcaacctccgcctgccgagggttcaagcgattctcccgcctcagcctctcgagtagctaggactagaggcacccgccaccacaccggctaatttttgtatttttagtagaaacggggtttcactatatttggccaggctggtcttgaactcctgacctcgtgatccgcccgcctcggcctcccaaagtgctgggattacaggcatgagccaccgcgcccggcctcatgcgtgtatttctttcttcactcaacactcattgagcaactactgcacaccagaccctatgctgaatgcacgcagatacccccagtcccatgagattggacaggagcgtggaactcaagggtgactctggctctgcctggggaaagagagagagggcttccgaggggtaaggacattggaaccagggctgagggatgaataggatttggttggagttggacttcctgcaaaatgaggcattggagcgagactgttgaggaattaagagttggagcctgtgcatttagattttttgtttgtttgtttgttttttagagatggagtctggctctgttgcccaggctgcagtgcaatggcgcaatctcggttcactgtaacctccgcctcccgggttcaagtgattctcctgcctcaggctcccgagttgctgggattacaggctgggcaccaccacgcccgcctaatttttgtatttttagtagacggggtttcactatgttggccaggctggtctcaaactcctgacctcaggtgatccgcccgcctcggcctgccatagtgctgggattacaggcgtaagccaccgcgcccggcctgcatttagggttttgaatgtccagaggttggggacaggggcttcagcctccttccagtcgtctttgcagcagcgcgaatccagtcattcctgctctgaccaccagagagcgcacgggccccgtccctgggaatccaggaaaaccccaggctggggaggggcgaggcttgccagacgcagcccctgcaccagccttcacgctccgcaagtgcaggaggagcagcaggcctggttcaaacgacgccaaaccacgaactggctgtgtgtccctaggcaagtggcctaacctctgagaaggcggcagaacctgacggttttccgttggctcggagcagacatgaggaccgctggcacctcctcagccctctctgtgctctgctgcctgccccgagtcacctgcccctcgctgacccctccccagcctcactggcccccttgggtgggctaagcaggttcccacctctgggccttgcaaggctgtgcccttccccaagtcccctctccttcccctgcttttttttttttttttttttttttttgagatggagtctcactctgttgcccaggctggagtgcaatggtgcgatctcagctcactgcaacctccgcctccaggggtcaagcgattctcctgcctcagcctcccgagtagctgggatcacaggcatgcgccaccacgcccggctaatttttgtatttttagtagagctggggtttcgccatgttggccaggctggtctcgaactcctgacctcaggtgatccgcccacctcggcgtcccaaagtgctgggatgacaggcgtgagccaccgcgcccggccctttcccctggtttttaggaggctgccccatccaccactgcaccccacttctcagagccccctttccatcccccacagccatcctcacatctgtgggttattaatggcgtctccccatatgtgaggccaatacccagcgcaccagtaggtgttcagtagattcccaaatgcaccaacagttgccgagtgtctactgtgtgctgggctcaagcaggtgctggaaacacagtgggaatgagaaggaacgtagggattttgtatcaaactaagcagggcgaggtggctcacgcctgagaccaggagttcaaaaccatcctgagcaacatagtgagaccctgtctctacaaaaatagaattaggccggggacagtggctcatgcctgtaatcccagcaccttgagaggctgaggcaggaggatcacttgagtccaggagttgaagaccagcctgggctacatggtgaaaccgtgtctctactaaaaatacaaaaattagccaggtgtggtggcgggcacctgtgatcccacctactcaggaggctgagacagaaggatcacttgagcaggaggcagaggttgcagtgagctgagatcggaccactgcactccagcctgggccacagatggagaccccatcttttttgttttgttttgttttgttttgttttgtttgagatgggtctccctctgccgcccaggctggagtgcagtggcatgatctgggctcactgcaaattctgcctcctaggatcaagcgattatcctggctcagcctcccaagtagctgggattacaggcatgtgccaccacgcccggctaatttttgtccttctagtagagacggagtttctccatgttaagtaggctggtctccaactcctgacctcaggtgatccgcccacctcagcctcccaaagtgctgggatcacaggcgtgaggctaatcgttttaaatttttattttgtagagataggatctggctatgttgcccagagtgatctccaactcctgggctcacgggatcctcccaccttggcctcccaaagtgtggggatcacaggtgtgagccagagtgcccggccacccctttatcccaaacacaccaaaaagcaggctgctcttccctgaaggcagtagcacattgatcaaatcggccagtgggcactgacactgctgcacacaaatgcacacacttgcaccctgccccaggccccaccggccaccctggttccacagacggcaccgtttctcccatttcctctcaccagggacctcgacaggtgtgggcttggttccgtgagctctcttagcccctttttcaattcaggatcccgtccccgtgaaccctgggggcctcggcaaacatgagacgagaggactcctaaaggaatgacacgcgccactccctccggggcagagaggtgtgttgacagctcattctcacgtcccaggcagaccaagcccaggtggaccacgtcccaggcagaccaagcccaggtggaccacgtcccaggcagaccaagcccaggcggaccacgtcccaggcggaccacgtcccaggcggaccacgtcccaggcggaccaagcccaggcggaccacgtcccaggcggaccacgtcccaggcggaccaagcccaggtggaccacgtcccaggcggaccacgtcccaggcggaccaagcccaggtggaccacgtcccaggcggaccatgtcccaggcagaccacgtcccaggcagaccaagcccaggcggaccacgtcccaggcagaccacgtcccaggcggaccaagcccaggtggaccacgtcccaggcagaccaagcccaggcagaccacgtcccaggtagacctagtggttgtgtattcacttctcccaacccccctgggaagaaataactgcagctggccccattgcaccaatgaggaaactgaggcccagggaggaagccgattgcctgaggcggcagctttgggactggactgtggctgcctcctgaggaaggaaacagttcctccctccaccctcatcctggcaggggttgggccaccgttgcttcatcaagtgtcgtggagcctccgctctgtgccaggagcggggcctgtgccacaaacgtctgctgaaaccagccatccacccaacagtatcgagcaccatgatcggaagagtaaaggccccaaactgggccaggggcggtggctcattcccgtaatcccagcactttggaaggctgaggcgggtggatcatttgaggtcaggagttcgaggctagtctggccaaaatggtgaaacccatctctactaacaaaaaaaaaaaaaaaaaaaaaaaaatggccgggtgcagtggctcatgcctgtaatcccagcactttggaaggccgaggtgggtggatcatctgaagttgggacttcgagaccagcctgaccaacatggagaaaccctgtctctactaaaaatacaaagttaaccaggcatggtagcaggcatctgtaatcccagctactcgggaggctgaggcaggggaatcgcttgaatctgggaggcagaagttgcagtgagccaagatcttgccatttcactcctgcctaggcaacaagagcaaaactccatcttgttaaaaaaaaaaaactagccgggcatggtggtgcctgcctgtaatcccaggtactcgggaggctgaggcatgaaaatcacttgaacccgggagcagaggttgcagtaagctgagattgcaccactccactccagcctgagagacagagtgagtgagagacttcacctcaaaataaataaataaagtccccaaacacacttgattttagcccagcaagactcatgtctgttgcgggaagtcagggaccccgaacggagggaccgcctggagctgtggcagaggaacataaattgtgaagatttcattttaatatggacatttatcagttcccaaattaatacttttataatttcttacgcctgtcttactctcatctcttaatcctgttatcttcgtaagctgaggatgtatgtcacctcaggaccaccgtgataattgtgttaactgtacaaattgattgtaaaacgtgtgtttgaacaatatgaaatcagtgcaccttgagaaaaaacagaataacagcgattttagggaacaagggaagacaaccataaggtctgactgcctgcagggtcaggcaaaaaaagccatatttttcttcttgcagagagcctataaaaggacatgcaagtagggaggatatcgctaaattcttttcctagcaagcaatattaatattaataccctgggaaaggaatgcattcctggggagaggtctataaacagctgctctgggaatgtctgtcttacgtggttgagataaggactgagatacgccctgatctcctgcagtaccctcaggcttactacggtggggaaaaactccaccctggtgaatttgtggtcagacgtttccctattttttgttcaagatgtttatcaagataatacgtgcaccgctgaacatggacccttatcagtagttctgtgttgccttttctcctgttccctcagaagcaagtgatctttgttctgttttttgccctttgaagcatgagctctactccatgttctcacaccccctcccctcttgaaacccttaataaaaaacttgctggtttaaggctcagggggcagcacgatcctaccgacatgcgacgtcaccccccggcggcccagctgtaaaattcctctctttgtactcttcctctttatttctcagccagccgacacttatggaaaatagaaagaatttatattgaaatatggggggaatgggtccccccgatacatgtcagatttcttttatttatttatttatttatttatttatttatttattgagatggagtctcactctgtcgcccaggctggagtgcagtggtgccatctcggctcactgcaagctccgcctcccgggttcacgccattctcctgcctcagcctcccgagtagctgggactacaggcgcccgccaccatgcccggctaattttttgcatttttagtagagacggggtttcaccgtgttagccaggatggtcacgatctcctgacctcgtgatccacccgcctccacctcccgaagtgctgggattacaggcgtgagccacctcacctggccttatttatttattttttttgagacgggggtctcgctctgttgtccaggctggagtgcagtggtgcgaactcggctcaccaaaacctctgccctccaggttcgagcaattctcctgcctgagcctcctgagtggctgggactacaggcacccggcaccacacccagctaatttttgtatttttaatagagatggggtttcaccatgttggccagactggtctcaaactcctgaccttaagtgatctgcctacctcagcctcccaaagtgcaggaattacaggcgtgagccactgcgcccagctgttttgttttttgagatgaagtctcactgtcacccaggctggagtgcagtggcgcgatcttggctcactgcagcctccgcttcctgggttcaagtgattctcctgcttcagcttcccgagtagctgggattacaggagtgtgccacctcgcccggctaattttttttgtatttttagtagagacggggtttcaccatgttggccaggctggtctcaaactcctgacctcaaatgatctgcccgccgcagcctcccaaagtgctgggattacagatgtgagccgtggcacttggccagtggggttgctttagggcccagctcacaccgcacccggctgatggggttgttttagggcccagctcacttcccagtgttcccacaccgcccaccaggccaggccttcaggcctgagccatgttatcagcatcacaggctccggagtccagcaagtctttgcctcctggagcccaggggttggcaagttctagctcagaggctgcagacaatagacagtaagccaatgccaagtatctttgggctcaggaaggtgggaccgggtgtccctgactgttctgtaccaagccacaacccgcttcccatcctggaggccgaaggtggtaccgcagggtgagctccctagagccccacagaacacgctgctctgggtcctaaaggctctccttgcatgaatgcaaacctgctgactacaaagatggttattattatcagctccaaggtacagaaactcggtttaaactggcttcatctccctgcggaggaggagttcaggcacagctggatccagggacctccaatgtcactgggaattgttgctgtcccctttggctctgtggcccacggggctggcctctccctagccatcagaaagagccacctgcaatttcaggctcacacctctccagccccagcaggaagcaggtgtccctgtccctctcccagcaaaattccagggccgttggccaggcgtggtggctcacacctgtaatccccgcactttgggaggccgaggccggcggatcatgaggtcaggagttcgagaccagcctggccaatatggtgaaaccctgtctctactaaaaatacaaaaattagccaggcgtggtggtgggcgcctatagtcccagctgctcgggaggctgaggcaggagaatcgcttgaacctgggaggcagaggttgcagtgagctgagatcacgccactgcactccagcctgggcaacagagcaagactccatcttaaaaaaaaaaaaaaattccaggactgactcgtcctggtggttttgtgttttttttgagacagagtctcactctgtcacccgggctggagtgcagtagtgggagcagaaagggggaaccagccccaggctggccctcgtcgtgtggtccatgggaggcacaggggtcctggaagcttctgaacctggtgctgaccctagtcctgactctgcaggtctgtgtgactccaagaaaatcacttcccaccctccaacctcatccctataaatggggcgcctgcctcacagcctcccagcaagcagcaaaggggactcaccatggtcccgttctgcacgagcacccattgactgggtaattaacaggaatctatgcacgccatggccctactgtgcgcctggcactgtccacatcccacctggaacctctaacactggggtctgtgcccatgttacagataagaaaacaggcataggctgggcacggtggttcacgcctgtaatcccagcaatttgggaggccaaggcagctggatcgccagaggtcaggagttcgagaccagcctggccaacatggtgaaacccatctctactaaaaatacaaaaaattagctgggtctgctggtgcatgcctgtaattccagctactcaggaggctgaggcaagagaattgcttaaacccgggaggcagaggttgcagtgagccgagattgcgccactgcactccagccttggcaacaagagcgaaactctgtctcaaaaaaaaaaaaaaagaaagaaaaagaaaacaggcctagaagggtcccagggcctggcacacagtgggcacccacggctgctataacaaatttgcacaaactgcctggcttaaagcaacacacgggctgggcgcagtgtctcatgcctgtaatcccagcactttgtgaggccaagatgggcagatcacctgaggtcaggagtttgagaccagcctgaccaacatggcaaaatcccgtcactgcaaaaaaaaaaaaaaaaagtagccgggtgtggtgggaggcgcctgtaatcccacttagtctggaggctgaggttgcagtgagccgagatcgcacctctgcactccagcctggacaacagagtgaggccctgtctcaaaaaaataaaaatggccaggcatggtggctcacacctgtaaccccagcactttgggaggccaaggcgggtgaatcactgaggtcaggagttcaagaccagcctggccaacatggcgaaaccgcgtctctactaagaatacaaaaattagccagttgtggtggcaggtgcctacaatcccagctactcgtgaggctgacgcagaaggattgcttgaacccgggggcggaggttgcagtgagccgagatcgcgccattgcactccagcctaagcaacagaacgagactacgtctcaaaaaaaaaaaaaaaaaagttccacacgggtctggctgggagaagatcgaggtgttggcagagctgcattccttctggcagctccaggagagaatctgttccgcgcctttccaggctcctagaggccgcccacattccctggcttgagcccccttcctccatctccaaatcccgcaatggcagccaagtccttctcttatcctgtctctaaccatagagggcaggcgtctccttttttttttttttttttttgagacagagtctcgctctgtcacccaggctgcagtgcagtggcacgatctcgggtcacttcaacctctgcctcccaggttcaagtgattctcctgcctcagcctcccaagtagctgggattacaggtgcacaataccaggcccacctaatttttttgtatttttagtagagacggggttttaccatgttggccaggctagtctcgaactcctgacttcaagtgatcctcctgcctcggcctcccaaagtgctgggattacaggcgcacaccaccaggcccacctaatttttttgtatttttagtagagacagggttttaccatgttggccaggctagtctcgaactcctgacctcaagtgatctgcctgcctcggcctcctaatgtgttggaggttcacaggtgtgaacctaatgtgttggtggttcacaggtgtgaaccaccgcgcccggccaggcatctcctcttctacggacccttccaggacagtgggccatccgtataacccaggatgaacccctgtgtgaaagccctcaactcagtcccatctgcagagcccctttggccagggagggtgggacacccacgggttctagggatgagggccccatggtctctgggaccgccgttctgctgaccaccccccactgctctccccctcactcacagcacaagcgtctgtttccagcgcacacccctgccgctccgtctgacgttcgagtctcaacctcaacgtctctttcctctgggaagccttcctcagtctcccccaggcccgggtcaggcctggggcacctttgccatctgggcatcctccgccacagaacaacactggattgtcactgtctgtttacctgtcaggatgtacctggagggagacagaagcctggggggtgagcagaggccacgaggagccacggtgggtgtctgagccagggagaagtgttatggcagctggggtaggaagtgggccgcaggggccaggctgcgggctggaagtcctaggatgagcctcgggcctggatagggtggggagaggggcagagccgggagaggggaggtcatcactggggtctcaggaggaggcggcgctctggaaagggtcagtgacctgttagaggtcaccctgcacagagcctctgggttagggaagacagagccgggagcaggaggccactggcagctggcctcggtttccccggagagggccggaacccacgccagccagacaatgaccctttgattcgcacagcccaggccggagtggccaagccacggcggggtcaggtcttggccaaggtcacactgtccagcccccgcacatcctcagtgagaacacagggtcccatccctgccccactccccaatcccgggagagtcccgggggaatgccagaggccaaggccaggtcgagacggcggggtgtcccccgtcagtgagaacacagggtcctgtgcctgccccactccccaagccggggagattcccgggggaaatgccagaggccaaggccaggtcgagacggcggggtgtcccccctcagtgagaacacagggtcccgtccctgccctgctccccaagccggggagattcccgggggaaatgccagaggccaaggccaggtcgagacggcggggtgtcccccctcagtgagaatacagggtcccgtccctgccctgctccccaagccggggagattcccgggggaaatgccagaggccaaggccaggtcaagacggcggggtgtcccccctcagtgccactaaggcagaacttggcccctggccactggctgctgggggacacaggctgggcagctaaggtggaggaaagggtacaggtgtgtcttctgtgggcacagatctcactcaggccagagaaggggctgtgccgtggggctgctggacacgtccgtttccacctgcggggtgggcaatgccggcacagcgagtggccagacacaggcatgcccagcagacacccaaccgctctccaccacctcaaccttctgtattttcctgaaagcatttaccactccttgaagttatagattaatttgtctctgcattttgttgtccaaaccaggagctcggtgagggtgtgatggggtctgccttggtcaccgtggcaccccagcaccccgcagggtccctctggccaaaagagatgttcactgatgccctagaagcaggaacagaggggctcccctgcgctcgccaagggcgcctgacaaatctggaggcccccatgacagaatcagctccagagtaggaaatgtgtctggctgcacgaaagccccctcgggcgcagcgcctccaggcccacgcagatgtcgctgtcatacattgttggaaacgcctctgctggaaacagtgtttgctgaatcttggagggagaggaaaaaacctagtaaacattcttgttgaggtgatctgggggaatgtctgcaaaggcttggagggctgatggggcagagctgcccaggggcccaggacaaaggccaggcgtgcgcgcgcacacacacacacacacacacacacacacgcagtggcctccctgggggccgtggctgggcgaggcctgctgttgtccgagatgctggaaggagctgtgtctctgggtctgtcccggccgcaccccgttctgtcccacacccaaccactccccacccacaggccggctccagcggccaggtggacgggtgcgcggcccgcgctgtgagcagggaaccatatccagctgaggttttgggtgtgtggggcgggtcgggaacaaggaggccgggttggggggctcagaccacacttggaccatgaaagtgaccacatgcaaatcacagaaacgggatgcagggatccacagacgtgctcctcttgggtccccgttacctcaccgccacccctgaaactgaagacccccaaacccactttaattcctggagacggcccctcgatccacccaaaaggctgccaccacctcgaacccacacccctgtcccggttccgccctgggtccagccacatctccccaaatgcattctctggctccggaaggggacccgggcgctcgcccccaactgccccccgcagcggccgggcccggcgcctgcccaccccgcgcgggacacggcctcgcccccgccactcccgcgccgcgccccgccccgcgccccgccccgcccgcggcccgcgggacctttatagggagcgccggccgcgcgctgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtgagtggggcggccagaggggcgggcggggcgggccacccacgtggggctgcgcggaatgcggccggggggacgtcggggggcgcggcggcggcggcgggggcgagggcggtgtccggcgcaagctggagccgggaaggtctgaaggagggtcaccaagaggtcagcagagcagaggtttctaatcacaatgaccgctgacatttattgagcgcttagtgtctacctctcccctccctgaacctgtgccatcccgatagtgccggagctctcttcatctccgtcttccagatggggaaactgaggctcagggtcacacagcctgtagcaggcaaagccagggttctagccgcgaccgtccgggtcggtcctggtgccgagaggtagtgctgggtgtcgggagccaggccctccagctggggctgagagctttcccgggtcctgggtagacggggcatggagtctcacacctgggacttgccgggaggtgccaggcaggagacggccccactcctggcctcagtttcccctcctatgatgggtgccaaggtgctgcgttccacaagctggtccctggcagtgtctgtgaaccagcaagcgctctgggatgggggctgtggccgttcctgcccccagggacgggggaagaaatggggggctctctggctccccaccccccatccctgcagccccaccccaccccagccctgcgccaaagggagagcagagccccctccccgaaggccacgtccctggggagacagtgagctcatgcaaggggaatgttcccaagttggagtgagtaagaggcgggccaggcggtgggggggctgccaggcgcggggctccgcgtgccctcgccctcgggtgctgtctagacagagggcagaggcgggagaagcggctccagggcctgctgaccctgacatgcccagtgcctggtgtttggtggtgtttgaggggttgggcagggtgccagcccctggcctgggggcttggagggtacgggaagggacctcctggggtgggtgggggttggtggtgaggctgtgggggggggcacgtggagctcagaggggaggagacatttccagggttctggagccagggtggggacacccatgtggttttctgccccttcttcctgggtgggggtagatcattccgtgcgtaactactcagcaccacctgcatgcatctgtgggcgggccagaagctgggtgtcaggagtggcccaggagagcaccccgttccccggcccgcaggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaaggtgagacctcaggccagaagcagggcagacgtctcagctcaggaccagccacaaacagtcatggtggtcgagggccgaacgtccagggactgagcccgtcacaggggtatgtaggaggctgcagggggatcccagcctcagagagggactggggggacttcccggttcccaggctccagcctcttgcagctcaggactcaggaagagaccacgtggctccagcctttgctggggctgagctctctgcctgggtggctcttcccacctggtcgataaatgtctggcttgcacctagctcctgggaaggtgggtttgccattctggcctgtgaccccaaatgtccacaccagggaccttcactgcagactccagggtctgcggtggggttacagctgcatgtttaacaagcatttgcctcgggaccctgttttgagaggatgcctcccacatcagactaggggctcttggttggcgagtggcacagaacgaatgaataagattctccgcactggaggatgatggttttttttttttttttttttttttttcctgagatggagcctcgctctgtcacccaggctggagtgcagtggtgcgattttggctcactgcaacttcggcctccgaggttcaggtgattctctttcctcggcctccccaggggctgggactgcaggcgcgcgccaccacacctggctaatttttatgtttttggtagagacagggtttcaccacattggccaggctggtctcaaactcctgacctcaagtgatctgccagccttggcctcccaaagtgctgggattacaggcgtgagccaccatgcctggcctgttggggcacatcttgaaggaggtgggcattagagctggggtgttgggggatgtctaggagtttgccagatggggccggtatgggagagtggatcaggagagaacatggcttgaggttaggtcctggtgggtggggtcaggcagaggagccaaggggaggctgaagctgagggctgcagacccgaaggccaggctgaggaactctgctggcctctgagatgtgattaatcccagatcagcctggctgggtggtcctgaactcactgccacatacccctgctccctccagacccccctctggcttctgggagaaggacagtcttcaaaaagtgcctggcctgggcatgagacggcccaggaccccccacccccaacctcatctggccctggggacggaactcaggcccccttccgttctcgctcgcataaaagccaccctggccgagcatttccagatgtgcctgtgagccgctgtgccggggccgcccaggtgcggcccacatgccctgcaagggctgcgtggcgggcgctggccatcccctaaggagtgccgcactgccttggaagtggggctccctcgtcagccccactttacacacagagaaactgaggctggcacataaactcaacagctgtgttcagaggccctaccagacccccagataacagaaagggggttggtcatctgggtcctggctgcagctttcaaactgaggtgcttgggcccctgcactcatagctgcgacccggcctcagtttccccatctgtaaaatgatgacttgggaagatgcgataagcctaggaggcgatgagcattcacattgaaagcgggggcggggaccccagagagagcttccctagcaggacctcaatatccctgtctgagcagcggggctgcggggcagctcctggttcagaggcctagggctgtggggggccccctcccctggaatcgctccccaggccaggagggccgtccagcgccccgccctccccgacgcctcctgggggaaggtcctggcagccccagactcgcgcctggcaagggcggaacaccccaggctgacgcagctggggcccctccggccttcccagaagagcgcgtgcatcgggagcagacgtcagccagctgcaaggaggagcggcccggggctgcgtagctccgctggaccccgattccgggcagagacccccccccgccccggcccgcgcgcaccgagcccagcccccgccccccagcgcaggcgcagcgcggacctcggccccaccggtcccgcgcccggaccctgagccctgcccctgggaacccgagggccccgactccgactgaccctgacctgggacggcgcccccgcctccgccctgcagaaggggcgcagggaggggccccgaggccttcgcgcggccccacgcccgggaccctcccgcgcccggccccacgcgcgtgtcctctgtccgcagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcagtacgtgggggcgtggtctgtggaggggcggggcgggacctaccggacctgcgcgtcatgtatcgaggctgctgccgcagtaggcgggggcggggcctggggcgggaccacccggacctgagcgtgacgtatcggggctgctaccgcaatgcgtgagggccaggcctgcgggggcggggcctgctggaggggcggggcctgctggaggggcggggccgctgccgcagtgcgtaggggcggggcctccagcccaggacaggtcacatgggtggcggtggggcctgagtaagggcgtctttatacttccgagggagtatcacggggtagggtcttttgtagggttgggatttggaaaatagtgggcctctgggggctcacactgggcaagaggtatgtggcatggtcagagcgggagcgtgactcagagaggggcttgtgggtgtaaccagaggggcatgatggaaccaggggggtgagactgggtcatgtaaggggcggggctcttggctggggcgtggttcctgggtggagatgggcggggatttgtgggtggagtttgggtgggcggccccgcagtcgcggaggggcggggctttgggtagcataaggggcaggagctcacgaaagaggtgtggctcctgggtacaatgggaagggcagggcttgtgggtggagcctgaggggtggaatggagaggggggctcacggggggcgggggggtgcttgtgtctcctaccagagggttttcgcatcttgggggttaagggtgggtcttggggccaagagccctgcggggttctcagcgagatgtcccctgaacttcccctggcacccggcctgcagagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggtgcagacgcagggcgggggcacaggcctgtcctgggggccggagaaccccctgccctgcgccctcaatgctcttatcgacccttgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccattttggggtgtccaggcctcagtttgtctcctctctcaaggcttcaggccgcccccacggctgtgggatgggcagcctggggcctggggtgccgcatgggtgctctggaggcacgggaagagagacccagcattagtccttgggcagcctctggccgcctctgggcctcagtgcctctccaggcagtggacaagcccgggaggggctgaggcagagcgggaggggagggagagaaaggaggtcttttgggagggcacacaggatagacaagatggcttagggcagccctaagacaccagctggcttgggacccagaaatggaggcccggtcttgaatgacttgggtgtaacgatagcagtaataaaaataacaggattagggcccgggtggggtagctcacccctataatctcggcgctttgggaggccaaggcgggcgggtcacttgaggccaggagttccagaccagcctgggcaacatagtgagaccctcatctctacaaaaaaaaaaaaaaaaaaaaaaaagacccaggcatggtggcatgctcctgtggtcccagctactcaggaggcggaggtgggaagatggcttgagcccaggatgtcaaggctgcagtgagctgtgttggcaccactgcactccagcctgggtgacagagtgagactgtttctaaaataataataatagcataattggccgggcgtggtggttcatgcctgtaatcccagcactttgggaggccgaggcaggtgaatcatgaggtcaggagttcgagaccgacctggccaacatggtgaaactccaatctcggtgagccgagatcgtgccactaaactccagcctgggggacagagcaagaccccatctcaaaaaaaaaaaaaaaaaaattagccaggtgtggtgtcatgcacctgtagtcccagctacttgggagggtgaggcaggagaatcgcttgaacctgggaggcagaggttgcagtgagccgagatcgcaccactggactccagcctgggtgacggagtgagactctgtctcaaaataataataataataataataataacaacaacaacaacaaaaaggcccagcgcggtggctcacccgcgcctgtaatcccagcactttaggaggccaaggctagcggatcacgaggtcaagagatcgagaccatcctggccaacatggtgaaaccccatctctactaaaaatacaaaaaattagccgggtgtggtggtacatgcctgtagtcccagctagttgggaggctgaggcaggagaatggcttgaacccaggggcagaggttgcaatgagccgagattgcgccactgcactccagcctggtgacagagtgagacgtcatcttaaaaaaataataggccgggcgcggtggctcacgcctgtaatcccagcactctgggaggccgaggtgggtggatcacgagatcaggagatcgagaccatcctggctgacacggtgaaaccccgtttctactaaaaatacaaagaattagccgggtgtggtggcgggcgcctgtagtcccagctacttgggaggctgaagcgggagaatggtgtgaacccgggaggcggaacttgcagtgagccgagatcgcaccactgcactccagcctgggggacagagcgagactccatccaaaataaaaataagtaaagataaaaaaataaaataataataaagaaaataaaatctaaaaataaaaaaataataacacaataacaaactgtgacaataacatcacctgggacttgctgtgcaccccgcgctattctctggttttcagaggatgaccacgaggcttgatgtgtggccagaccctcttgggactcctcggcgcggccggtgcaagcccgccctggtgtccagcagcccccacgccctgcacagggagctcagggcttcctggcctccgtttcccagcggactcgcctgcggtgtggttaggcggctggagggaggtggaggaacggcattccaggtgggaggctgcaggagtgtgggttgcaggggcgcaggggtagacccagaggggttcacggtggggggcatgggaaggtggaaaggggctgcggaccgagccgcgacacgaatgccggtggaccctgcagctgaccgcccacgggtgaggctggaagtcagttaacattttactgggtttgcttctgccctttgcatgtggaatgggtgtgccccaccgctgcccgtcccaccccaaccctgaacatcaggcttcccgtggggcccagccacggaacattccaggcctggagcggccatctcatttgcatgccgcaaggttgtggctcaggcggcttctcctgggggcctggtggtcccaggcagggggccgggctggggactgctccgccgaaccacgtcccagatccaggccacaaaggcggacacctgcgtgtacacgtcgggggtcttggggtcgccgcaccagaggcccgagaaggaaacgaggccgtgagcccggttcctgcacaccaggggccctccggagtcggcctggagtgaaaggagaggtgaggtcagggcctctgggagctgctgcaggcacatctcaccacggccctccctgcctcagaaccctctgtggctccctactgctctccaaggaaaaagtaaattcatttctcccctccaggccctgaggacccagcccccacccacttctctgccctccccgctgagcctcctcagtgctccacggcctttgtatagcctggagacctgttcctgccctgcgctggatgctgcctgtgtgaacattcgagtctgcagtgttttgggcagtgcacaacctacacagctgtacgcggcagccctctactaacaggtctctctgccttgcgtgtgtttcctcagatcttctaaggattccttcaagtctcagctcaaaggtgctctccttggagagggctccccgtatactcaccctaaaatccctcatcctaccctcctgccatctagaatccgctctgataccatcaactggatactaatagtgtagcagttttacagatggagaaaaagaggcccagagaaatcaagtgacttttccaaggtcacgcatcgggaaagtggacagtctcatttctcctggactcgggctgctgggctaagtgtgtgtcctgaaccaagtcgctctcttgcctgcggtaaaagaccctccagggccagtgtctcccttggcacctggggattcgtttatctggcaaggttttaggagtgggagctgcttcctctcaatctgttactaccctctactgaatactgcttgtataaatacacaagtgcttggctctttgtgcagtgcgcaacctgcacagctgaacatggcagccctgcatgacccttgccaactccctgccttccctgggcctcagcttctccgtctggtccaacatcaatgggactcagttcccaaggcccttcctggccctgaccctctctgtgggccttggtttccccacacagtaagtgggtggagcagggaggggatcttaccgagcagaagccccgtctgtggctgtccccactgcgggtgcagagcatggtaagtgtcaggtggcccttccaggagctgttgcagacgtccgggtccagcactcggaccttggcctccatcagtccaggcggcagctcctcaaagtcagacacgaagccccagccagccacccggcaccgtgtccccgctgtggggggcctggcccttctccctggcggcctcagcagccccactgcagggcccaggacagcagagccgttcagctgcagggagagcatgagttcaggccactgggctccctccccacccccgctcctgcctcagtttatccatgggacccctggtcctgcccttgtgaagcaaaatcaatggcggccaccatgaggccgggtcaggaggccccgttccttctgccaacacaggcccctacccctcaggcctccagggtcaccgtcagctgcccaaagggtctttctgttctgttcttttcttttttttgagatggagtctcgctctgtcgcccaggctggagtgcagtggcacaatcttggctcactgcaacctccacctgccaggttcaaccgatttctcctgcctcagcctcccaagcagctgggattacaggcgtgcaccaccacacctggctaattttggtattttagtagagacggggtttcaccctgttggccaggctgttctcaaactcctgacctcaggtgatccacccacctcagcctcccaaagtgctgggattacagagtgagccgccgcgcccagcctcaaagagtctttcaaactccatctccttccttactctaagccctcccacggctcccgattgccctcaagacaaaacctctttgctcaccagccagggcctctgagggctctccagcctcagcctcccctttggccaggcaggatgaatttacagctactccctgggcctgccacacacctcccctcacaccagacccccagcctgaaacacttttcctattcagccatctcagcatggatgccacctcttccaggaagtcttcccagactcccaggctggcacgtgagtcttctctgggctccctgcagcctgttgaggccggtttacccagtgaagactgagtgacaccccgggctctgtgtggcccagcaccgggcctctggccctggccctggcaattggcacacagctgatgctcagttaatgggcctgggaaggacggctccaatccctgtctctggttctctgatttgtgcgtcttgggttcattcctgacattcttgatgtctcgctcagcctcagtttccccatctgtgcgatggcctctgggtgaaccagcgctggttccaggcttcagggtttcacagatgagaaaaattcacccaaaagctttggctactggcacttgctcctcctccttttttttttgtttttttcagagtcttgctctgttgtccaggctggaatgcagtggcgcaatctcggctcacggcaacctccgcctcccgggttcaagcgattctcctgcctcagcctctggaatttaattttgggatgctgggtagaagcgtcagggaaggggtcgtccctcgagcaggagggggccaggcgggtctgcatggatgcaccacgtgtgggaggagcagcttcccacccggaggactccacccagggacttttttttttttttcagatggagtctcactctgtcacccaggctggagtgcagtggcacgatctcggctcacggcaacctctgcctcccaggttcaagtgattctcctgcctcagcctcccgagtagctgggatgactggcacccaccaccaggctcagctaatttttttatttttagtagagatggggtttcaccacgttggccagtctggtttcaaactcctgacctcaaatgatctacccgcctcggcctcccaaagtgctggggttacaggtgtgagccaccacgcccggccccacacagggactttaagcgtctcctccacacagggcaggggcccgagaggcacattcattccatttcagcataaactttgagcgcctgctgtgtgccataaatggccataaaggtgataaaaaatccctgcccgttaggttcagaggaagcgggaatgaggaagcgggtggtccaggggttagcaggtgacaagcaggtgacgacggggccggaagggtggtccaggggttagcaggtgacgacggtgctagaagggtggtccaggggttagcaggtgacgacggggctggaagggtggtccacaggttagcaggtgacgacggggtggtccaggggttagcaggagatgacggggccggaagggtggtccaggggttagcaggtgatgacggggctggaacagggttgcagggagggggtatgtggtccagggcggcctcctgggaaggtaacatttgagcaaagacttgacaggcgtgaggggaaaggctcgcggtgtctggggaactggtgcactgggtacagctggtgcagagctcggagcggagactgtgctggggatgggatggcccatccgggaggtctgctggcctcgagtcagaaaggtgacaggcatggattagcagggcctgtgggcaccaggaggatttgtcctgcaggaggtgggagccactggggggtccagggcacaggaggaatgggacctgacgtccaactgtctttaaaacctaagtcaggccaggcgcagcagctcaggtttgtaatcccagcactttgcggggctgaggcaggaggattgcctgagtccaggaggtcaagaccagcctgggcaacatggtgaaaccccgtctctactaaaaatataaaaattcgcctggcgcagtggtacacgcccgtgatcccgacactttgggagaccaaggtgggcggatcacttgaggaccggagttaagaccagcctggccaacatggtgaaatcccatctctactaaaaatacaaaaattagccaggtgtggtggtgggtgcctgtgatcccagctactcgggaggccgaggcaggagaatcgcttgaacccgggagatggaggttgcagtgagccctgactgtgccactttactccagcccaggtgccaaagtgagactccgtctcaaaaaataggccaggattgggaggcagaggtgggcggatcacgaggtcaagagatcgagaccatcctggcaaacatggtgaaaccccatctctactaaaaatacaaaaattagccgggcgtggtggcgggcgcctgtaatcccagctactcggggggctgaggcaggagaatcgcttgaacctgggaggcagaggctgcagtgagccgagatcgtgctactgcactccagcctggggacacagggagatactgtctgaaaaaaaaaaaaatagcccagggctgcttctcctggaaaacactaaacggcggatgacgtcggtgcagtggggcggccctgggatggggaacggcgctggcttcccccgaggcttcggcactggcttccgggctggggccgcggagctcacagaggcaagacagaggataaggagtagacgcctgtcaccaagctgggccgcctggtcaaggacataaagatcatgtccctggaggagatctgtctcttctccctgcccatcaaggaatctgagatcattgaccttttcctgagggcctctctccaggacgaggttttggagattatgccggtgcagaagcagatccgcaccggccagcgcaccaggttcgaggcgtctgttcccaccggggactacaatggccacgtcggtctgggtgttgagtgctccaaggaggtagccactgccatcatcggggccgtcatcctggccaagctctccgttgtccccatgcacagaggctactgggggaacaagatcggcaagccctacaccgtccctggcaaggtgacaggccgctgcggctctgcgctggtgtgcctgatccccgtgtccggggcgctggcatcgtctgggcgcctgtgctcaagaagctgctcatgatggctggtatcggtgactgctacaccttagccaggggctgcactgccaccctgggccactttgccaaggccgcctctgatatcctctctaagacctacagctgcctgacccctgacctctgtattccccaagtctctctttcaggtattcactggccatcttgtgaagactcacaccagagtctccgtgcagacgcccggctccagctgtggttacaacatagggttttatacacgaaaaataaagtgaattaagcctggaaaaaaaaaatggccaggcacgatggctcacgcctgtaatcccaacactttgggaggctgaggtgggtggatcactgggtcaggagttcgagaccagcctggccaacatagtgaaaccccatctctactaaaaacacaaaaaactagccaggtctggtggcgagtgcctgtaatcccagctacttgggtggctgaggcaggagaatcacttgagcctgggaggcggaggttacagtgagccgagatggcgccattgcactccagcccccgtgacagttcgagactctgactcaaaaaaaaaaaaaaagaaaagaaaagaaaagtaggccgggctcggtggctcacgcttgtaatcccagccctttgggaggccgaggcaggtggatcatttgaagtcaggagcttgagaccagcctggccaacatggtgaaaccccgtctctactaaaatacaaaaattagatgggcttggtggcgcgcacctgtaatcccatgtacttgagaggctgaggcaggagaatcacttgaacccgggaggctgaggttgcagtgagccgagattgcgccattgccctccagcccgagcgacagagcgagagactgtctcaaaaactaaacatacgtcagatccacccccggggctcacccgcagcaggcagatgtcgttggcgtgggtcatggggtggtagtcggggtgtgtggtgagagcatcgatgccaaacacctgctgggtgggctccgcagtactcaggacgtgggcgcccagcaccaccaggccagtgcggaggtctctgcagggaggaggtggtgggtgagacgggggtgagggctgcccgtcctgggcctcggtccactcatctatgaaacggaggcccaggccgggcacggtggctcacgcctgtaatcccagcactttgggagggtgaggagggtggatcacctgaggtcgggagttcaagaccagcctgatcaacatggagaaaccccgtctctactaaaaatacaaaattagccaggtgtggtggcacatgcctgtcatcccagctactcgggaggctgaggcaggagaattgcttgagcctgggaggcggaggttgcagtgagctgagattgcaccattgcactccagcctgagcgacagaacaagactccgtctcaaaaaaacaaaaaaaaaacaattacttttgcatcaacttaatattcttttccttttttctttttttttttttttgagacagagtctcactctgtcccctaggctagagtgcaatcgaggcttactgcaacctctgcctcctgggttccagtgattctcctgcctcagccctccaagcagctaagactacaggcgtgcgccaccactcccagctaatttttgtattttcagtagagacagggtttcaccatgttggccaggctggtctcgaactcctgacctgaagtgatccacctgcctcggcctcccaaagtgctgggattacaggcgtgagccacggtgcccagcccccaacttaatattatgataataaattaataattatgtttattatttttcctacctccaatatagaattaactgcaatagttgtggtattaatttgaatcattattataaaaacatatttagaatgaagataatacttattatatttattataagttctatttcaattataatattaactacagtaatttcaatattctcctttttttatttctttaatttttttttttgagacggagtctcgctctgtcacccaggcaagattgcagtggtgcaatcttggctctctgcaagctccacctcccgggttcacgccattctcctgcctcagcctcctgaatagctgggactacaggcgcccgccaccatatccggctaattttttgtatttttttttagtagagacagggtttcaccgtgttagccaggacagtctcgatctcctgacctcgtgatccgcctgcctcggcctcccaaagtgccgggattacaggcgtgagccaccgcacccggccttttttttttttttttttttgagacaaggtctcactctgtcacccaggccgcagtggtgtgatcacagctcactgcagcctcgacctcccaggctcaagcgatcctcccacagcagcctttcaagtagctgggaccacagaagcacagctccggtgcggaggactctgcggggaggagggggtgggtgagatgggggtgacggctgcccgtctgggcctcagtccactcatctatgaaatggaggcccagtaatccatttaatgctcacgccggccccgtgataatattaggttggtgcaaaagtaattgcacgaaaaaaattaaatggcaaaaaccacaattaacttttttttttccgacagaatctcactctttcccctaggctggagtgcagtggtgccatctcggctcactgccacctccacctcctgggttcaagtgattctcctacctcagcctcccgagtagctggggatacgtacagccacttgctaccatgcccaactaattttcgtattttttttttgagacagagtctcgctctgtcccccaggctggagtgcagtggcgcgatctcggctcactgaaagcgccgcctcccgggttcacgccattctcctgcctcagcctcctgggtagctgggactacaggcgcctgccaccacatccggctaatttttttgtatttttagtagagatggggtttcactgtattagccaggatggtctcgatctcctgacctcgtgatcctcctgcctcggcctcccaaagtgctgggattacaggcatgagccaccgcacccagcctaattttcgtatttttagtagagacagagtttcaccatgttggccaggctggtctcatactcctgacctcaaacaatccaccgtgtcccaacgtgagggggactgcaggctggcgggggagctggggacactgcagcccaggaccaacctatcccgtgcctggtgggggctcctgcaggaggggacccacccaccctggccccaatatacattttaatagttattataacaatatgtttaaaacgaggcagggcatggcggctcacacctgcaatcccagcactttgggaggcagaggcgggtggatcatttgaagtcaggagttcgagaccagcctggccaacatggtgaaatccagtctctactaaaaatgcaaaaattagccaggtgtggtggtgggcgcctgtgatcccagctactcgggaagctgaggcaggagaatcgcttgagcccgggaggtggaggttgcagtgagccgagattgcaccgttgcactccagcctggggaaccgagactgcctcaaaaaaaaaaaagaacatagtgacagttacagtaacagaatatgtacttgttgcgcctgttgcttcttctgtgcttcttttgcctccctgccttatcctcctgttttccctttgttgccctttaaatccagcccctgctgagactccccctcctgcaggagccacggcgcccccagctcccccaccagcctggagtccccctcatgtcgggatacggtgtccagaaagaaggggcccgacaggtgagctcacctgtggctgaagcagtgggcggccgagaccacccagcgggctcgcagcaggaagcctccgcagtgatgttggcccccgaagcgcacggatgccatgtagggcctggagtggggggtcacctcgtggcccccgatgatctgggccccccaggagcctgctggagggacggcctgagtcagggacgaggcgggaggaacggatgacggggctggggtcagggcagggggagaagtagcggccaagacagagacagggggtgagattagagacggagagacccagagagctggagacagagcccagacaagccccccagatgcgctgggaggggctcccgagcccgggagatccagggctgggctgggcagagaccccggccggatttccatccatttccagcagaggcagccacgggggctcggcagatggagcaggtggagctctccccagggttctcccgggactgggggttcccgggtgtggcccccgtacggggacttggcgggggcctgggtggggatcccggggggctcctcaccggggggcttcacgggcagcatcagggcggtggccacagtcagcagaggacgtccccagcccctcaacccgagccccatggcagacgcaggctggcgtctccccgcagaggtcttcgggccgtggctcccaccctcagccaacggccggaaagggggagcctggctgtggcctgtggtcgggaggccccaccagcaacgcctggagcccaggcgggcgtttctgagaaatcgatggtctcaggtggtggctggtaataatcatgttgataataatcattgtcccctagtccggaaacagggagaggaggagacagctctggggctgcaagtgacctcgggaaggcaattgacccttctgtgcctcagtttacccagcctccacgtggcccagcatgtgtggggagctttccgaggaaccgaggtcacagcggcactcgagacccgcagctcgcctccggcccccaccccgcaaaccccagtcttcccatctccaaacccagggccgacctcagggctgtggggacagcgaggaaggccggtctcctgggaagctctgatgatttctgcctttattttattttatttttataggtggggttttgctatgttgcccaggctggtctcgaactcctgggctccagcgatcctccctcctcggccttccaaagtgctgagatcacagaagacagccactgcacctggcagatttctgcctttattcagcagttattgagtgcctagtgtataccagacctcatgctaggaggtgaggatgaggcagtgaccgcaccccagcctgtagcactgacgttctgtgggatccggagtccagtgggacatggctgtacatgggggtcttcaccttttttttcttttctttttttttttgagatggagtcttgctcttgttgcccaggctagagtggaatggcaccatctcggctcaccgcaacctctacctcccgggttcgagtgattctcgttcctcagcctcccgagtaactggaactacaggcgcccgccaccacagccggctaattttgtttctgtatttttagtagagacggggtttcaccatattagccaggatggtctcgatctcctgacctcatgatccgcccgcctcggcctcccaaagtgctgggattacaggcatgagccacggtgcccggcctttttttttttttttttttttttgagaaggaatcttgctcttgttgcccaggctagagtgcagtggcgcgatcttggctcaccgcaacctctgtctcctgagttcaagggattctccttcctcagcctcctgagtaactgggattacaggtgcccaccaccacgccccgctaaatttgtgtgtttagtagagacggagtttctccatgttggtcaggctggtctcgaactcccgacctcaggtgatccacctgcctcagcctcccaaagtgctgggatgacaggcctgagccaccgcgcccagcccggcaggtcttcacctttcagtgggagcgttcttagtggcaaagttcaggtcgtaaattgcagctcacacagccgggtgatggcgttcacggcagtggctagcagtggggtgctcgtcagcgcttaataatgaacaggctggggccgggtgcagtggctcacgcctataatcctagcactttgggaggccgaggcaggtggatcacctgaggtcaggagttcaagaccagcctggccaacatagtgaaaccccgtctctacttaaagtaccaaaattagtcaggcgtggtggcaggtgcctgtaatcccagctacttgggaggctgaggcaggagaatcgcttgaaccgggaggtggaggtggcagtgagccaagattgcaccattgcactccagcctgggtgacagagcgagacaccatctcaaaaaaaaaaaaaaaaaaaaagtcatcattgaacgctccagacctgtgttttaccaaatgtaaagtgttctcaataaagaatgaagtgaaatgaagcaacaggaaatgcgtggaaaggaaggtatgaaaaggccccacaacgaactcgggctctgcgagatgcgggcggcctctggaagctaaaaaacggcaggaaacgaattttctcctggagcctccgggaaaagccagccctaccgatgccctgacgttagcccagaagggcctgcaggggcttctgacctccagcactgccagagaataaattggtgccatttcgtttattattattattattatattttcttgagatggagtctcgctctttcgcctaggccagactgcagtggtgcgatctcggctcactgcaagctccgcctcctgggttcatgccattctccttcctcagcctcccaagtagctgggactacaggtgcccgccaccacgcccggctgatattttgtatttttagtagagatggggtttcaccacgttagccaggatggtctcaatctcctgacctcgtgatctgcctgcctcagcctttcaaagtgctgggattacaggtgtgagccaccgcgcccagcctcatttattatgtatatatttattttgagacagggagacagggtcttgctctgccgcccacgctggagtgcagcagtgcaatcaaagctcactgcagcctcgacctcctaggctcaagccatcctcccacctcagcctcccaagtagctgggaccacaggcacctgccaccaccaggcccggctcattatttcattttttgtggagacggggttttgccatgttgcccaggctggtcttgaactcctggcctcgagcaatcctccagcctcggcttcccggagtgctgggattacaggtgtgagccaccatgtctggcccaagttggtatcattttaaaccactacgtttctgggaattcgttacagcagctgcaggaaagattttgggaaatggaaagctgtttccagggcctggggacaggtgggaccccagctcagggtccgtgtacttggggaccatttcctgctctgctgtggtctactggaccgtctggcatcgctgtgaccgcatgggccgtgctccatcaatattgtttttttgtgtgtgggtgtttttttttttttttttagatggagtctcgatctgtcgccaggctggagtgcagtggcgtgatctcagctcactgcaacctcagtgtcccgggttcaagcgattctcctgcctcagcctccccagtagctgggactacaggcgtctgcccccacgcccggccaattttttgtatttttagtggagatggggtttcaccatgttggccaggctggtcttgaactcctgacctcgtgatccgcccgccttggcctccgaaaatgctgggattacaggcatgagccactgcgcccggccctgtttttatcttttagagacagggtctccttctgtcgcccaggctggagtgcagtggtttgatctcggctcactgcatcctctgcctcctgagttcaagcgatcctactgccttagcctcccaagtaggtgggattacaggtgcctgccaccacgcccggctaatttttgtgtttttttgttttgttttgttttatttgtttggtagagatgggttttgccatattgcccaggctggtctcaaactcctgagctcaagtgatcggcctgcctcggcctcccaaagtgctgggattacaggcgtgagccatcgcacccggctgtccgtcaatattgtcaaacgactggacagcaggcactctggtctccacggtcgtcgcgtcagcacgagtgggtcccctggacttgctcctacctcccctgctgccctccgtcgcggagcactgaggcagagacctggaaaacgtccccagctccacgggcgttagaaggagaattgcccgaagctgcaggcgtgtggaactttgttccctcacgatgctgtccctgtcccggtcgctgatggggacacagtagggagagggtaagcgccttagccctgccacacagtgaggagccagggggccggggctgctgcctcagaggagctcccactgcctctcgggaccgattctatccagagctgggccatttccttcccttttggtgaacagttgtgaaataaacaaccgtcctccagcgtctcagaaaaccgagctcctggcagccctgaggagggggctgagtgggggtcactgttcccacttcccaaactgaggcccagagaggggagccgatttgtctggggccacacagcacagggtcttgacccatgagccgctggactgcgattctcctggagggtctctccatggcagatctgagcggctcttcaggagctcagacaccagccactgcagggagtcaacagcaatggtgacaacagcttcctttattgtatttaattttacatttttattttatttattttgtttttttgagacggagtctcgctctgtcacccaggctgcagtgcagtggcaccatctcagctcactgcaagctctgcctcccgggttcaagtgattctcctgtctcagcctcccgagtagctgggattacaggcgcccaccaccacgcccagctaattttttgtatttttagtagagatggggtttcaccatgttggccaggctggtcttgaacttctgatggcaggtgatccacccgcctgggcctcccaaagtgatgggatgacaggcgtgagccaccgcgcccggcccctcccctgcgaaaaattgtttttcaagacgagatgttgcctggtggctgagactgcaatcacagctcactgcagcctctgcctcctggctccgccttccctgtagctgggaccacaggctcacaaaaccaccagggtaattaaaaaaaaaaaaaaagctagacacggtggctcacgcctgtcatcccagcactttgggaggctgaggcggatggatcacgaggtcaggagatcgagaccatcctggctaacacggtgaaaccccatctctactaaaaatacaaaaaattagccgggcacggtggcgggcgtctgtagtcccagctactcgggaggctgaggcaggagaatggcgagaacccgggaggcggagcttgcagtgagccgagatcgcgccactgcactccagcctgggcgacagagtgagactccgtctcaagaaaaaaaaaaaaagtttttttgtagagatggggtctcactatgccgcccaggctggcctcaaactgacctcgactgatcctcccaccttggcttcccaaagtgctggtgtaataggcatgagccactgagcctggcctcactttatttttatttttttgagacagatgctttgtcacccaggctggagtacagtggtgtgatctctgcttactgcaacctctgcctcccaggttgaagcgattctcctacctcagcctcccaagtaggtgggactacaggtgtgtgccaccacacctggctaatttgttttgtatttttagtacggacaggatttcactgtgttagccaggatcgtctcgatctcctgaccttgtgatctacctgcctcggcctcccaaagtgctgggattacaggcatgagcttctgtgcccagcctcactttattttttaaccccaataaatgtatatccacaggacattgcttcttcttttttttttttttttttgttgttgttgttgagagggagtctcgctctgtcacccacgctggagagcagtggcgcgatcttggctctcagcaaccttttcctcctgagttcaagagattctcctacctcagtctcccaggtagctgggattacaggcatgcgccaccacgcccagctaattttttttttttttttgagatggagtttcgctcttgttgcccaggctggagtgcagtggtatgatctcagctcactgcaaactctgcctctcgggttcaagcgattctcctgcctcagcctcctgagtggctggaattacaggcgcccaccaccacccccagctaattttgtatttttagtagagatggggtttcgccatgttggtcaggctggtcttgaactcccaacctcaggtgatctgcctgccttggcctctcaaagtgctaggattacaggcgttgccaacgcgcctgatctttttttgtatttttagcagagacaggttttgccctgttagccaggctgctctcgaactcctgacctcagaggatccacccgcctcagcctcccagaatgttaggattacaggcgtgagtccccgtgcccggacctgcttcctatttcttgaaatggaagatagctgccttaagaatacacattgcactggctggacgcagtggcttgcgcctgtaatcccagcactttgggagactgaggcaggcggatcccctgaggtcaagagttccagaccagcctggctaacatggcaaaaccccatctctactaaaaatacaaaacttagctgggtgcggtggtgtgtgcctgtaatcccagctactcgggaggctgaggcaggaggatcacttgaacctgggaggaggaggttacagtgagccaagattgcaccgttgcactccagcctgggcgacagagtgagactccatctcaaaaaaaaaaaaaaaaaaaaaaagaatacacatagcacaacccaacactacctgccttccagccagactggagagggctggcttggccgctactgggggtccctgagctgtccaaaggccctgctccccggagctctctggcctcagttttcccatctagggaatgggttgccctggggcaatgccgagagtgctgatgagaattcagcaaggttggctgggcacagtggctcacgcctgtaatcccaggactttgggaagttgaggcaggcgggtcacctggggtcaggagttcgagaccagcctggccaacatggtgaaaccccgtctctactaaaaatgcaaaaattagctgggggtggtggcgggcacctgtaattccagctacccggaaggctgaggcaggagaactgtttgaacccaggagatgcaggttgcagtgagctgagatcgcgccactgcactccagcctgggtgacaagaacgagactccgttggaaaaaaaaaaaaacagcaaggtactggatgcggcatgctggtggggactggggccctggcgccccttgtaaagcgcctgtttgcccatccgtaagctggatcctgccccgtccttcccatggaagccatcacagtcagagaagagggtagaagacaggaaaccatccattcattcactcaactcattccgtgagcatttattgagcacctactgtgtacagacagtgttgtgggccttggggactcagcagtgaagaagacaggcaagttcctgcccttgtggggctgacattcagcagagaggcaggaaggaaacgctgaacacaacatgtaaatgacattgtctgtcagaagaatttagtgggaaagagagtgtggacagacaagaggaatagcaaacgccaggcacggtggctcacgcctgtaatcccagcactttgggaggtcgaggcaggtgaatcacctaaggtcaggagctccagaccagtctggccaacacggtgaaacctcgtctctactaaaaatacaaaaattagccaggcatgatggtgggcacctgtaatcccagctactcaggaggctaaggtggaaggatggcttgaacccaggaggtggaggttgcagtgagctgaggttgcgccattgccctccagcctgggcaacagagcaagactctgtctcaaaaaaaaaaaattagccacgtgtggtggtgcacacctgtagtcccagatactcaggaggctgaggtgggaggattacctgatgggggaggtcgaggctgcagtgagccaagatcacatcactgcactccagcctgggtggcagagtgagaccctatcttattcaaaaaaataaaaacaacaagggtaccgagggcacccagtgacaatggggaagctggggaagttctcccagaggaacacacaaggcgtctaacagcaggtgtctggatggctgaagcccaagctggttgtggggcaaggagaggtgagcagggaagagacaggattgtctgggctcagctttgccttgtggggctgcagggcactggggaaccatagatggtgtttgagctggggcaggccagggcatatttctctggtgaaagagtggagtagggagaggaggtggggagacccggaggcgacatggctcagggttggggtgggggccataaggcctcagctaaagtcatggctggggagaggcgaggggggtctctgactcagggacaggggaggagtgaggttttgggacccacctatagcttccggtcgtccaaggctccagagggtggccagatctgcaaggagtggtggggcgtgctgggcggagccccggggtagagctctacggaagtaggaagggcaggggcgccctcagggaaacctcactcctcccctgtccctgagtccaggaaggggtcaggccaacgtcgctctggaagcctggaggcggggccgaggtgcaggggcggggccgacattgcctgggaggcggggctgaggtgcaggggcggggcctacattgcctgggaggcggggctgaggttcaggggcggggccgacattgcctgggaggcgaggccgaggcacagggggcggggccaatgtgcaggggcggggccgacattgcctgggatgcagggaggtggggccgatgtcgggggcggggccatggtgcagggggcggggtcggggcggggccgagatggcctaggctgctgggaggcgggactagggtgcagggtgcgaggctagcggggtgatgcgggggccgagattgcccaggaggcgggtccgaggttcagggggcggggctagggcgcagggggcggggccgacattgcttcggaagctgggagtggggaccgaggtgcaggaggcagagcctcagtgcagtgactgctccccacaggacgcggatgggcgctgcagtgcctgtgggtgggtgagcgcagtgaggcggtggaagtgagggtgtgaagggcaactcgaggcagcttctctccggtccactacacaccccaccttgtcccacctccacacctttgccaggccgttccggccacctggaacgtctccctccaccgtttgcccggcccatttccccggttcaagtggcatcacctccaggcctgtgtgtgctggagtcgggaggtgtgggcggcgcgagtttttcgtgcagggccttgagagtggcaggaggactttagcttttgctcggagggaggtgtgagtcctggaggtttagagctggggcggtgggagaaatgatcccagcagtcccttaccctccccacggcctcctcacttcctcctatttttacacaaaatgcctccaccacccttcaaaccctgaatcttttattttattttatttttgagatagggtctggctctgtcacccaggctggagtgcagtggtgtcttcacagctcaccgtagcctcgatctcctgggtccaactgatcctcctacctcagcctgtgagtaactggaactacagatgcatgatacctcacctagctaattttttaaaaaaaaatttgtaggctgtgtgcggtggctcacacctgtaatcccagcactttgggaggccgaggcaggcggatcaagaggtcaggagatcgagaccatcctggctaacacggtgaaaccccatctctactaaaaatacaaaaaataagccgggcgtggtgtcaggagcctgtagtcccagctactcgggaggctgagacaggagaatggcgtgaacctgggaggtggaaattgcagtgagccgagatcaccccactgcactccagcctgggcgacagagtgagactctgtctcaaaaagaaaaattacatttaaaaatgtatatatggctaatgactgctgtaccgaacaaaccagtccccaaaagcaaatgaaataacagctgccaccaagtaccacggtcacacctaaaaaccaattaacacctcgacagctcctcacgcaggttccgtttactcgggagtaggagccggccacccgatgcagggtcactatgaccccccaagcccgtgcctcgccctgtctcttcttcctccttataattaaaatcttgaaggaccccgatggcagcctgtcccaccgccctgcctgggtctggcccctgcagcttgtgatgcttctcagacccattcccagccctccggggagtcacagaggggtgagatcagacagaggtttgaatccgggggtggcctttccttggatggagcagtatttaaaaaaaaaattgggccaggtgcggtggctcatgcctgtaatcccagcactttgggaggcccagctactcgggaggctgaggcaggagaatggcatgaacccgggaggcagagcttgcagtgagccgagatcgcaccattgcactccagcctgggtgacagcgagactccgtctcaaaaaaaaaaaaaaatttgtagagatggggtctttctgtgttgcccagactggtctcaaactcctgggctcaagtgatcctcccttctcagcctcccaaagtgctgggattacaggtgtgagccactgtgtctggccctgaatcatttattttattttgagccaggttctggctctgttgcccaggctggagtgcagtggcatgatcacggctcactgtagcctcaacctcccaggctcatgcgatcctcccaccttagcctcccaagtaactgggaccacaggcacacaccaccgtgcccagctaatttttattttttattttttattttttttgagatggagtttcgctcttgttgcccaggctggagtgcaattgtgcgatctcggcccactgcaacctccgccttccaggttcaagtgattctcctgcctcagcctctggagtagctgggattacaggcatgcaccaccacgcccgcctaattttgtatttttagtagagacggggtttctccatgttgctcaggctgatctcgaactccagagctcaggtgatctgcccacctcagcctcccaaagtgctgggattacaggcgtgagtcactgtgcccggcccaatttttaattttttgtagaaatggaagtctcactaggtagcccagggtcttcacctcctggattcaagtgatcctcctgcttcagtctcctgaagtgttgggattacatgtaacagtcacttcattcaccctgaatcatttatgtaggggacaaaaatcaccgtctctccaaggacagaacttcttttttgttttgttttgttttgttttgttgagatggagtcttgttctgtcacccaggctggagtgcagtggcgcgatctctgctcactgcaacttctgcctcccgggttccagccattctcctgcctcagcctccccagtagctgggattacaggcgcgcaccaccatgcccagctaagttttgtatttttagtagagaaggagtttcactggccgagcgtggtggctcacacctgtaatcccagctactagggaggctgaggcaggagaattgcttgaacctggtagacggaggttgcagtgagccgagatcgcgccattgcactccagcctgggcaacaagagcgaaactccgtccaccccagccaaaaaaagaagtggttttgccatgttggccaggctggtctctaacttttgacctcatgatccaccagcctcagcctcccaaagtgctgggattacaggcgtgagccaccgcgcccggcctggtctcaaacttttgacctcgtgatccaccagcctcagcctcccaaagtgctgggattataggcgtgagccacggcgcctggccgcaaaaatggaacttctgcatcacaggtgactaacggtgccaggcacacagtaggtgttcaataaatcactttggactaaaagaacacagaggccaaggggaagtgaagaaacgactcacaggtcagttttattgggtgcctagtgcaggggtcagtacactacggccctcggatcagctctggccctctgcctgtttttgtaaataaagttttattgggtgcctagtgcaggggtcagtacactacggccctgggataagctctggcccactgcctgtttttgtaaataaagttttatgggcacagagccatgcccatggttttacatattgtctctggctactttcactctgcgatggcagagcagagtcattgccgcagagactgtggcctgcaatgctgaaaatatttactctctggccctttacagaaaaagtttgccaaaccctgagctagtgtgtgctgggccctgtgccaagccctttgtgtgtgctcactcagttaaccctcccacagccttaagggtgggggcaggggggtgggggggaataaggctccgagaggttgagaaacagacccagggtcacacagcttggagatgggtgagctgggaatcagacagacccgggacccctgatattctttaggatcttagctttgttaacctttgctaatttatcttattgtcttaaatgctaaaatgaatacacattcattgtaaaaagggaggaataaagaaaaggtgttgacggccttcttcagcctggggtacatcctgccgtatctttctccacagctcatccggggctactttcctttaaatctacagccattcagcaaacatcggcagaggagaaccgttttataagaaaactaagaagtttggaagaatctttccttcctgcccaccctggacccccatgagtaggtgtgctggggctggtctgcagtgttctcacgggaaaccaggaagctgggcccaaggcctacatgttggggaagacaggtcctgcctgtctcctgctgtggctccccagtgctctgaggacaaagcctgagctctccctgattctccaccgtccctctcactcactctggtcgtctggtcgctgggcctttagtgagtgtgccatgggggccctggggccgattaaattccagccccggggaccaggctcagctcccagccagggcacagacagatcagcacctgcggttgtctccaccccaacccccggcctttgcaggcacagcgccctccaccagatactccggcaaaggaggcctggggaccctgcgagcggggccgggggtgcagggagctgtcagctcctcgcagcggcctccccaggacccccctatcccctcgctcgccctgaaatgtgtgtccctctcggcgtctgggctctcgagaaaggcctttgcttgtctgacttcgcgagggtcccggctctggcccaggagctggggaggggcgggacttggtgacagccgggtcccagcaccgcgcccagacctaggcccttctcaggggtgccccggggcggggcgcgcggggcggggggcggcggcggcgcagccggcaggaggcgcagcgcccgctcgcagcgcggggaggtgggaggggagcggggcggggagcggggcgggcgggagggagaggggagcgcgccggagacgcgcgcgcccagcccaccccccgcgcccgccgccgcccggacaataaacagcagctttgcgcggggcgatgcccgagccggtgccgccgcccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggagtgagtaggcgcgctcgggccgcggggctgggggcccggagctccgggagccggggaggggggaggccccctctctcgcgccccattgggggcgtcgctgcccccgcgaggagcaggaggcggcgcggggctgctggggccgcagcgcagccgggaagagactcgggctgggccgcgcctgccgggaggcctccccgctcccggaccccggctgcccacccaccggcgcgtggggacccgggcagcggcggctcgggccagtccaggacgcggggagggggaggctcgcgtctccgcccgcgccccgcccgcgtctccagggcgagcctcggctctcggccacctgtgggtggccccggggagatggagcgacccctccccagattgcaccggtccggcctcgcgctcacgcacccttcccccgccccagtctgagcgcacggctcctggcgccctggacgcgcgcgcgggccggtgccccccacccccgcccttcccaagggcctccaggggtgtcctgagccccccgccactgcgcaggtcccgagttaccgctggagggagaggggctgccctcggcttcccgggtctctggggtgtgtgagaagggagaggaaccggcgttttccagcggggcgcctgggtgggataccctctcggggaagtgtctcggagctggggctccactggtgtagctacaggagtgggctggccctgggctgggatccctggacccccgcatggctgcgcctgtgtgtgtggggggggggtggccagtggaggcaccgagcgagggcgcgtggtcatttcggacaccggtcccctcctcccggtgctcgggtgcccctctgcccctcactcccacaggtgggcactgcacgggcaggggtcaggaggctcctcctggggtcacccacctgcccacttcaggacaggggagccagctgccctgctgaggcccgggtccccaccccagcccgaggaccgaagaccggatctggaggccgcctgtggccccctgcccttcccactgggcgtgttttctaagccgccaactttccccggggattcacccgtgacccgccacgcccgcggctgggtgggggccgctgcctccctccctccctgggaaagcgagacacccagtgtcctctgcttttgaaaacccagacaaaggcctgacccctctccccgtcaccccgccccgggagctcagccaggggctcaggggagccagggcccagacttgcctgctccacacccccaccccccagccttgtttatctgccctgctcgccaggccccggaggagcctctgggcctctgacagccaggcctgggcagggtgtggctgtggggagggggctgcctaggaggacgacggagatctccctcccagaggaggggtgtcagcgaacactccgggtcgggcccattgtttccttcctgccaccccttcctttcccacgggggatactgaggcccagagaggagctgctgccccccccccaccccccctccatcacacagcacctggggccggggggcctcggtgcctcctgctctgctccacggtttctccgtcctgggtcagagggtggcccacaggtcccccattgggtcatcattgcttttggggatgcagacatgggacaggcacccagtgttaaccggctgctgtgagccgccattcgaggacgactctctccccggttcccgggctgacaatgggtggggacaggcccatctggtgccgcccggccttggacacctgccccctcgttcttctccccggcgggcttcaggcacgaaggccccgtccgctagaacgtgatcgcttgcctcctcccgtttccacagattttccagtcgaagacacgggagctggctgtggtttgtggtggtgcccgtctcgctggaaagtttcacaaatgaatttaagaatttaaagaattttaaatgtcattcaagaacaggttattttttgttaatgtgaggatttaaggagaactagcgggttgctaaccacagggccgatgctgccaaggtgaggagaacgtccaggaaggagctggggagaatctctgcttcggagagaatctctgtgctctgggagggtttgtgtggcccctgcgtgacacatggtctggctggtaaaataaagatattttggcctggagcagccattctccagcacccacagccctgtcctgggtacaggcaaggctcaaacccccgggatagggaggagaacagacttgggcctggacagatggtcaagaccggcccagactcctccctgctcgcagacctggaaattttcaataggaaagtctccgttgggtgctaactgggtccttaacgctccttcacacttgctaatccccctttttaatgagaggcagagcctgttaaaaggcaacagtacctagtgataattgaatttaataacaagcttttacttccgttgtatctgtttcttcctccatgtttccgctgtcttgtttgtggcggtggcttctggtttgcccagtgttgatcacaatataatgtttctttctaaaacaaggcgatttgatttacactggagtggttttgaaggcaaggaatagacagatactgtccaggaggtggcggaacatgggaaggtggtttctttcttttttccatgttgcccaggccagtctcgaactcctgggctcaagcgacttccctgcctcagcctcccaagtagctgggacgacagcattgcatgggaaggtggtttgagaagtgcaggcgtaatttattcactcggcaaccattaagtgggtacctgccttttccacggccctgttttgagtgctctgtatgtgtgtgaattcctctgatgcttttttttttcttttggagacagagtatctctctgttgtccacactggagtgcagtgctgcgatctccactcactgcaacctccgcctcccgggttcaagcaattctcctacctcagcctcctgagtagctatgactacaggtgcccgccaccacgcccggctaatttttgtatttttagtagcgacagggtttcaccaggttgcccaggctggtcttgaactcctgacctcaggtgatccgcctgcctcggcctccccaaagtgttgggatgaaaggcgtgagccacgtgcctggctgacacttgccttttccatggccctgttccgaatgctttatgtgtgagaactcccttgacccttgatccttctttttttttttgagacagagtcttgctccatcacccaggcagtgcagtggtgtgatcccggctcactgcaacctctgcctcctgggttcaagcggttctcctgcctcagcctcccgagtagctgggactgcaggcgcccaccatcacgcccggctaattttttgtgtttttggtagagacagggtttcacagtgttagccaggatggtctcaatctcctgaccttgtgatccacctgccttggcctcccaaagtgctgggattacaggtgtgagccgccatgcctggtttttttttattggagacagagtctctctctgtcacccagactggagtgcagtggcgcgatctcggctcactgcaacctctgcctcctgggttcaagcgattctcctgcctcagcctcccgagtagctgggattacaggtgcctgccaccacgcccagctaatttttgtatttttagtagagacaaggtttcgccatgttgggcaggctggtctcaaactcctgacctcaggtgatccgcccagctgggcctcccaaaatgctggcattacaggtgtgaggcaccgtgcacggcccactcccttgatccttacagaagccctgcgagagagggaaactgaggtacagggtggtccagtggcacatgtaaggacacacagctgcagaggcatgggtggggggtttgctgctgggtgggccgagcatgctctctctaagccgccggggacaggggagggtttttggtacctgtgtctgggggttgtggtcttgtggggcgtggtggtctggatatcagacatcctggtgtcggctttcaatcctggtgtgtttattgagaaacacagacggtggccttgtcggtggtcttggctcctggggcatctgccctgcctctgtgcccatccacgccgttctgtgatttgggagaggagtgtggagagggggtcctgactccccgtcacaccttagcatgtcagtctcctccgggcctcactgttctcatctggcgagtggggatgtgactgccatcattaggggagataggggtagaggaagggcaggtgctttatgggcctggaccctctgagcaccacccagtgggggcatctctgcctctgcccattagccaggttcatccttaagggcctcagattttgaccctaggaaattggcttatgttctttttgtttgtttgtttgagacacagtctcgctgtcacccaggctggagcacagcggtgtgatctcggcttatagcaacctctgcctcctgggttcacgcgattctcatgcctcagcctcccaagccgctgggactacaggcatgcgccactgcgcctggctaattttttgtatatttttagtagagacggggtttcaccatgttggccaggctggtctcgaactcctggcctcaagtgatccgcctgcctcagcttcccaaagtgctgggattacaagaatgagccaccatgcccagcctatgttctttttttctttctttctttcttttttttttttttgagacagagtctcgctctgtcacccaggctggagtgcagtggggtgatctcggctcactgcaacctctgcctcctgggttcaagccattcccctgtctcagcctcccgagtagctgggactacaggtacccgccaccacacccagctaatttttttgtattttcagtagagatgcggtttcactgtgttagccaggatggtcttgatctcctgaccttgtgatctaccctcctcggcctcccaaagtgctgggattacaggcgtgagccaccgcgcccggcttgttgtatattttttagtagagacagagtttcaccatgttggccaggctggtcttgaacttctggcctaaagtgatccgcccacctcggcttcccaaagtgctgggattacacgcatgagccaccgcgcccagcctacgttctttttttctttcttttttttttttttttttcagatggagtctctctctgtcgcccaggctggagtgcagtggcgagatctcggctcactgcaagctctgcctcccaggttcatgccattctcctgcctcagcctcccgagtagctgggactacaggcgcccgccaccacgcccggctaattttttgtatttttagtagagatggggtttcaccatgttaaccaggatggtctcgatctcctgacctcgtgatccgcccacctcggcctcccaaagtgctgggattacaggcgtgagccaccgcgcccagccttcttttttttagactgggtcttactgtgttgctcaggctggagtgcagaggtgtgatcatagctcactgcagcctccacgccccgggctcacgggatcctccacccagcctcttgagtagctgggactacaggtgccaccaccacaccctgctaattattatgttttgttttgtttttgtagagacggggtctccctgtgttgcccaggccggtctcaaactcctgggctcaagcatcctcccacctcagcctcccaaagcgctgggagtacacacatgtgagccactgcacccagcctgatgttctttaaaagcatcatatgggccgggtgcagtggcttatgcctgtaatcccagttctttggaaggccgaggcaggaggatcacctcaggtcaggagttcgagaccagcctggccaacatagtgaaaccccatctctactaaaaatacaaaaattagccgggcgggcgtggtggcgggtgcctataatcccagctactcgggaggctgaggcaggagaatcgcttgaacctgggaggcggagctttcagtgagccgagattgcaccactgcactccagcctgggtgacagacagagcgagactccgtctcaaaaaaaaaaagcattatatcacctttttctgagtgtgggcccctgtttcctctcatcctttcttgatctaggaaacctgtcatttgtttattgaacaaataaatgctccctcctcaccatcctcgtgctgtgcgggatcagcagggtctggaaagctatgcagcatcttctctgaggtgtgagaaaggcttcctcatccagtccatcatgaaccttttctgagaaggatgtttcagggttcatccaggcaggcagaaggatgcaccttgtggaaggactggcatgtgcaaagggctagaggtgggaaagcattggaagaagagaatgctctttggtgtttgttcctgctaggccttgagtgccaggatggggagtcatggatagtgtgtgagcaggggaggagcagtggctgacctggtcatcaaaaaaggcgctggcagctgaggagtgagcccagggaggagcaagtcatggccaagccttgattgtggctgcaggggcagcatgcagagaaatggcagagccagagggggcaggaccccacgtctaggagggcaaacacaggattccagaactgcgtgtggtcagtgatgcccacagggacggggctccctggctggggagaagtagcctggtccctggatacatgagggggtggagggcgtcctctaggaggatggctgcgtggacgtcttggtgtctgaggagtgtaaaatcaggccagagtggctgtctcccgccccagggtttcaagcagaaattcagggacagtcagagccagtcaccaggacagagcctggactgggtgggaagagggaaggggagctaggccttgggatggggaagacttagattagggctgggcatggtggctcacgcctgtaatcccagcactttgggaggccgaggcgggcagatcacctgagttcaggagttcgagaccagcctggtcaacatggtgaaacccccgtctctaccaaaaatacaaaaattagccaggcatggtggcaggtgcctgtaatcccagctactcgggaggctgaggcaggagaatcgcttgaacccaggaggaggttgcagtgagccgagattgcgccactgccctccagcctgggtgacagagcgagactctttctctcaaaaaaaaaaaaaaagaaagtttagattaggaccagagtgaggccagctgagtgggaggcgctgcatggtcaacagactggtggtgggacagggccaggcctgggagcccctcctgggtgggcagaggctgtgggcaatggaggcagagatgcgggaccctgaaggccggggagggacagaggcccagggttcttcagtaacccctgtcagggagcgagaagctgatgtcctcatcagtttgtattcaaacgcttccagccatggaaagtctcagggcagggccagcaggggtttcagcactccatgggggttgggaaggaccccagcccctggcctggctcttgttgagaaggctggcattcccattacacatgcacgtatacacacacgtacacaggtatgtatacacacgtctgtatgtatatcattcttaacagcttcattaaaatacatttcacacgctacacagtctggctgcttaaagtgtacagctcaggcgtttttagtacactgacagggtgtactttttttttttttgagacagagtctctctgtcacataggctggagtgcagtgacgtaatcccggctcactgcaacctccgcctcccgggttcaagtggttctcctgcctcagcctcctgagcagcggagattacaggcacgtgccaccacgcccggctaatttttgtgtttttagtagagacggggtttcaccatattgaccaggatggtctcaatctcttgaccttgtgatccacctgccttggcctcccaaagtgctgggattacaggtgtgagccaccgcgcccagcagagttgtgtatctttcaccacaattgtagaacattttcatcacccccaaaacaagccctgtccccattaggcatcccctcccgtccccctccccccagccctcggggagccagtccccttcctgtctctggatcggcaggtcctggacatttcgtagacatgggatcacacgctgcgtggccttctgtgtctggcgtctctcactgagcgtgatgtcctcaaggtgcatccgcgccgtggcctgggtcagagcctcgctcctgttcacggctgagtcatgtcccagtgcgtggacggccacattgcgtttacccacacatctgtggatggacacccgggttggtttatctgtgaatctgtagttaccccccgagatggttggagcttgtgctctgttcacactgaggagtccgggtcctactttacataagtgtaagtcgtgacagtgagtttctttaaaaagaagaggcagtgatcagatgacaggtggccctgggagtggcgggagtgtgagaagagggggccgggattggggggacctctgggtgggggcttcctctgaagatggaaagaccctaatcgactccctggggcagcaagcatttattgagcacctgctgtatgcctggtgccagggacatggcagggacaaaaatgacacagttgctgtcctagtgggaagacaagatcacgcctgtaatcccagcactttgggaggctgaggcgggcgaaccacctgaggtcaggagttcgagaccagcctggccaacatggtgaaaccccgtctctactaaaaatacgaaaattagccgggcgtggtggcatgtgcctgtaatcccagctactcaggaggctgaggcaggagaatcacttgaacccaggaggcggaggttgcagcgagccgagatcgcgccaccgcactccagcctgggcaacagagggagactccatctcaaaaaaaaagaaaagaaaaagataagtaaagtgatccgggtggtgacagctgcaggggtgcctggggctgaaaattaggacagaagaggcctaaatgaggaggtgacgtctgcagaaaggccttgggcctgaggcccggggaggtctgggtgaccgtgcaccaggcagcaatgcagccagcacaatggccctgcagtgggagctctgtgggacgtctcaggagtgtggctggagtgcagtcgcgtggggagggaccatggggcctctgcagcagggtttgccctgagaccctgctgaaagccagggaaggccccgttcacgcctcactgccccgtcttcccctgagggcccgggcagggtcccttcccaccccaggttaataggcaacaggtttgcttctctgcatctgtggcctgctttgacctccgtcttctcctctcccccggggtgatgcctctctgccgtaacccgtttagggttctcggtgccccagagactgggatggccctgggggcctccgtgctgcatcctgggagggctgggaggaggttccttcctggaaggctgcctggaggaggtggctgtgcttgagctgatcttggcggtggagaagggaaaggggaagctgggagctgatgaagggtgaggggctgacattggggcttggactccggggcttggagcagggcagggcggtggaggaagcagggccgggggtgccagcgctcaggggagacacaggctctgaggaccgaggatcaccgggactgggaagcagctggggtccagactccccgaactccatcccctgctgcccccgcaccccacacctcgcagccccgcgtgactcccccaccccccacaatggccaaggtcaccgtcagctctttcctttcaattagcagcaggaatgttcccggcgctgggctcggcgcctgcccgggcagggaccccctcgttctggctggagctgcccgggcgtgggttctggaaggacgagtgcgacgcccccatcccacacacgcccctcccgcctcggacagggcccgccctgctcgctgggtgaccttggccgttgcgtaacctctctgggcccttccaacaccaacgccccgcaccgcggaggcctctgcggggctcccgtcgggtttgggcctcatgaactcatctcctggagcaggactatctcacgcgctccagacgacgccctcgccgggccccgagccgcccacaccgccacacgccgtaaaaagcatcgcggggacgggaggcctgtgcgcgccggggtgggcgtcgggcggggggcgtggcgctccaggggctctgcgcggctgccgggagccagggaggctcggagacccagcacctgccccgggacccccagcacctgccctgggacccccagcagcaccaggaccgccgccgccctgagcttttccacgcctttgcccgggactcagctcctccgcccagcatgtaagaccttttgtgatccgacctccgcttccttccgtgacccctgcgccggggtcctggtcccagcctcgccgatcacacgggaatgagactcccccgcgcctggcgggccccgcccgcaggaggatgaacgccgggagaaggccgccctgcccggcctcagtttccccgtcggtgaaatggggctgacccggccgcaggagggagcgagcgctgggggaggcgttctcggtttgtggccgttttgatccgtgcgtcgtggtcatatttcgcttaatttttccaatctgtgacgtggagcgttctgtcggcctgaccttggctacccggcgtcgggggcgggtccacacccctcccggatggaagccccttcctgggcgggcgccccccggacgcccagacggggacccccctcccctcccccagccgcagcgcgggggagaaattcccgacccctcccgcccgtctaggccgccccaggcccgaagcctcggccccccccaatccccccaagcacaggccgggggcgggagatgctgcgccggccccacccccgcgcgccgggcctcggcgttgccatggggacggcgcggttgccacggcgaccgcctcccgcgggcccctccatccatcaccggggcggcggcgcccgggtctggggaggggcgaggggggcgcatcctgcgtgtcctggggaaaggcgagggggcgtccaggcccggggaggggcgaggggggcgccgggtctggggaggggcgaggggggcgccgggtctggggaggggcaaggggggcgcatcctgcgtgtcctggggaaaggcgagggggcgcccgggcctggggagaggtgaggggggcgccgggtctggggaggggcgagaggggcgcccgggcctggggagagtgaagggggcgccgggtctggggaggggcgaggggggcgccgggtctggggaggggcgaggggggcgcccgtgactgcgggggccaggggggcgcgtcctggggaggggcctgcgccctggggctgcttcccgcgcgttccctgcccgcccgcctgacattcccccgccctggccggccgggcagggacaggctgccccagacactaccgccttgtctccagcctgggaggcggccacacagccacactctgtccccgggtccggtctgagcggccacctgcctgccgggtggggacctgggcagtcggcgaccagcctgatcctggggcccaggagttccgccgttttgtggacctcccgccccagctctgctccctccggggtggccccgagcccacttagagctggaaaccaggactgtggggtggcccggggctgggcggttgttgttccaatctggctgtgcccagggccacgctgtgccctccctggacgtggcttccagccatgggaagaaggtgccgggcagggggaaccgtgtgtgagaggccctggggtaggaggcttggtgcatagccagggggccctgcaggagtagaccaacgggggaagtgaaggggccgacctgagggttcctctaagggctgatgggagccagggagcctctagagctggagagggacagggtctgattaattattattattattattgttattttgagatagggtttcactctgtcccccaggctagagtgcggtggcacgatctcggctcactgcaacctccacctcccgggttcaagtgatcctcctgcctcagcctcccgagtagctgggattacaggcgcctggcaccacccccagctaatttttgtatttttagtagagactgggttttgccttgttggccaggatggtctcaaactcctaacctcaagtgacctgcccaccttggcctcccgaagtgctaggattacaggcatgagccaccgtgcctggccttctttttttaattttaaaaaaattttttgtttgtttgttttgttttttgagacagagtttctctcttgttgcccaggctggagtgcaatggtatgatctcggctcaccgtgacttctgcctcccaggttcaagtgattctcctgcctcagcctcctgagtagctgggattacaggcatgtgccaccatgcccggctaatttttgtatttttagtagagatggggtttctccatgttagtcaggctggtctcaaactcctgacctcaggtgatccacccgccttggcctcccaaagtgctgggattccaggcgtgagccactgcacctggcccatttttaaaaattttcatttttttaatatatattttttgagacggagtctcgctctgtcgcccaggctggagtgcagtggcgcaatctcggctcactgcaagctccgccttccgggttcacgccattctcctgcctcagcctcccgagtagctgggactacaggcacccgccaccacgccgggctaattttttgtgtttttagtagagacggggtttcaccgtgttagccaggatggtctcgatctcctgacctcgtgatccgcccgcctcggcctcccaaagtgctgggattacaggcgtgagccagcgcacccggccttaaatttttatttttgagacaaagtcttgctctgtcacctaggctggagacagtggcacaatcacggctcgacccagcctcaacctcctggattcaagtgatcctcccacctcagcctcccaagtagctgggaccacagggacataccaccacacctggctttttatttatttagttagttagttatttttgtagagacaggctcttgctatgttgcccaggctggtctcgaactcctgggctcaagcgatccactggccttcacctcccaaaatgctggaattacaggcttgagccaccacacctggcctagggtctgattctctttttgagaagctgcctctggctggcgggtggagagggagctgtgagggggcagggagttggcagggaacactagaggcctgggctagggtggggaacttggggtaggcaggaagcgagggcccgggcctcaagggaacgcacagtggatggttcactgcctgcatcacccgttgctggggctgaccgagaactccagctgagctggctattcaggaagggcccccaagccagaaagctggatcaagcctttcctgaaccccacccggtgaaggcagctgaacccagcctccctgaggagggagaagggaaagccacagagggcgcagctggtgttcccgggcccctgggaggcaccgggaagggtaggtgtcacctgccaggaagggaggagccggtggggtcacctctggggcatgggagctggacaacttcacaggcctcagcagggccaggaaaccaaacccgagtggggtgggcaggcggggcgcctcgggctccagggaggtcttgacccggagcagcctcccaggcggggctgggggtgagccagtgcactgtgcagtttcattttctctgctgaactgggggaggggatgggggcacaagggggacgtcataggaggccttagagctgcaggcatctgtgcctccgtgtttgcgtggatggggaaactgaggcccagagaggcacgagggctctttggaggcagggctggctctgggccctgacaccaggctgagagggctgggggtggcagcagacacgaagggcaggctgtaatttcagtctctgggaagataagatgttgggggtcgggggaacctgtctcccacccctcacccctggttcccgccaggccctgcccgtcagcctgggcctccccctgttgatgccgcccagagcttgggacacccaccgccaacccctaccgtcctctccctgcctcgctgcaacagccttggaagcctgagggtcgctgggaaggtcaaggccaagctcagccccagtctagggctcggtgctccttgcgtttttctttttgttgttttgttttgttttgtttttgacggagtctcgctttgttgccctggctggagtgcagcgcgtgatctctgctcactgcaacctccgcctcctgggttcaatcaattctcctgcctcagctcctcaagtagctggttttacaggtgcctgccatcacgctcggctaatttttgtattttttggtagagacggggttttaccgtctctgttggccaggctggtctcgaacttccgacctcaggtaatccgctcgcatcggcctcccagagcgctgggattacaggcgtgagccaccgcgcccggcctgctttttgcattttactaagcacctactacgtgcagctttctgagggcccacagaccagggaggggaggggagggtttgggtggcaaagctcttcttctagcaggtgggaggggaagcgagaaagcagtggggtgggggtgccctgaactccgtgtgaaccacggggctgcagacagatgaggagaggggctctgcaccagcttctggagctgcagggcgaggttgctgtggggaggtcagagaaccacagaattcctcggttctttcctgggcgagtgagcgtgtggtgggtgcctggtgggggtggcgagggcttcggtttctggacctccttcccacaccacaaagggccctgtatctttgaagcctgaagcccggtcccttcaggcgtatccggcaacagtggtattcattcattcatttattgtttgtttgtttgtttgaggtggagtcttgctctgttgcccaggctggagtgcagtggcgcgatctcggctcatgcaacctctgcctcctgggttcaagccattctcctgtctcggcctccaagtagctgggattacaggtgccgaccaccacgcctggctaatttttgtatttttagtagagacgggggtttcaccatgttgggcaggctggtctagaactcctgacctcaggtgatcctcccacctcagcctcccaaagtgctgggattacaagcgtgagccactgcgcccggccattcattcatttttgagacagagcctcatgctgctgcccaggctggagtagggtggtggggtcatggctcactgccccctggacctcccaggctcaagcagtcctcccaccttagcctcccgagtagctgggactacaggcgcacaccaccacaccttgataatattttttatttttatttttggtagagatggggtcttactagattgcctaggctggtctcgaactcctgggctggagtaatcctcccacctcggcctcccaaagtgctaaaattacaggcgtgagcagctgtggttttgcttttgttttgttttgcgacagggtctcactctgttgcccacgctggagggcagtggcgcgatctcggctcactgcagcctcgacctcccgggttcaagtgattctcccacctcagccttctgagtagttgggagcaattctcgtgcctcagcctccacgcccagctaatttttgtatttcttggtggagacaaggttttgccatgttggccaggctggtctcgaactcctgacctcaagtgatccgcctgcctcagctgccccctgatatttgttaagcgcctaccacataccagccctgggaggtgaggctacagctgcactgggtgggctgttttcaaaagacaatgattgggccgggcgcggtggctcacgcctgtaatcccagcactttgggaggccaaggcgggcggatcacctgaggtcaggagttcgagaccagcctggccaacatggtgaaacccctgtctctactaaaagatacaaaaattagccgggcgtggtggcaggcacctgtcatcccagctactcaggaagctgaggcaggagaatcgcttgaacccaggaggcggaggctgcagtgagctgagatcctgccactgcactccagcctgggagacagcaagactccatctgaaaaaacaaacaaaaccacaatgattggataagagcgagtctggggttgaatccggacttggatcctttgctgtgcgtccttgggaggctcgtctccctgtctgggcttttgcaagcccaggcttgggaggtggggctggtgggtctttcatcctctgtttgcccctcctggggctgcagagtaggtcttggtgggcaggagggtgcagagaggactgtcctgatctgtcttatggtctgggccaggaggtgatacacttccttcttcccgaaacacccttctctggcctttgatgcctggtgaactcctatgtatccttggtggccctgcctcaatgtccccttctccccaaacccttcctggtcgctaggcagagcctcgtcccctcctgtcctggcttccttggccgctgagggggcagggagggccccactttacagaaggggaaactggggttcagagatgaaatcccttgccctggttacccctaggggaagaggcagagctgggatttgaaccgcgtctgacggacagcagggctcagtgaaccagagcttgaccttatctccctcccgcagggtcctggcggcagagaccacgtcccagcaggagcggctgcaggccatcgcagtgagtttccgccgccccgcagacggtgtggtcagggtggggaagtggggggacctggggtctcgggccctggacctgtcctaggacctggaaccagggcatggtgggtggtgagttatttgcttgggaaacttggatcctgctgacccgcagagaatggaagtggagaccccctgagtcggcagctcctggacccccggcctcgctctgcctgatgggtcggtggggaaactgaggctggcattccctggaaccctgccctcgtcctgcaggaaaataaactttggtgatgggagcacagatgtgctttggtgccatcttggtggcctctggcccaagaaggccctcttggtgtccgcagacccctctctgtgacccgaccctcctgtgacgtggcccgattcctgggttcaagtgactctcctgcctcagcctctcgagtagctgggattatgagtgaccgccacgacgctgggctaattgttgtatttttagtagagatggggtttcaccatgttggccaggctggtcttgaactcctgaactcaagtgatcctcccgccttggcctcccaaagtgctgggattacaggcgtgagccaccgtgcccggccagtcattgattttcgagacagggtcttgcgctgctgtcccgggctggagtacagtggtgcgatccgctgtcacctggaagccagtgggccacgaggatccccggacagaggaagcaggatcgggctgggcagagccttgtgtgggggtgggggggtctccgggacccccacgcccatccctgaccccacccggccctccccacaggagaagcggaagcggcaggcggagatcgagaacaagcgccggcagctggaggacgagcggaggcagctgcagcacctgaaggtacgagcggggcagggacccagggtcagggagtgcaggcggctgtgaggcggaggccccggactcctgcccaaccctgaccctgaccccaatcccaacctgaccctgaccctgcctccagccctgaccctgaccccgaccctgaccccgaccccgaccccgaccctgaccccaacctgaccccgaccctgaccccaacctgaccctgaccccgaccctgaccctgatctcagtcctgactctgaccctgacctgaccccaacctcaatcctgaccctgaccttgactctgacccagaccctgacccccaacctcgattgtgattctgacctcagcactgatcccaaccataaccctgaccccaaccttggtcctgcctcaaccccgaccctgatcctgaccctgacctcagtcttaagtcttaaccctggccctggtcctgcccacgactctgacctggatccctgctgctcagtccaaggcactgcgggagcgctggctgctggaggggacgccgtcctcggcctcagagggggatgaggacctgaggaggcagatgcaggacgacgagcagaagacacggctgctggaggactcggtgtccaggtgggggctgcagcgtgggtgccaccgggctgggtggggcctcgggggccgctggctcccgggagggtgtgggctgggaagagtcgtcagtgtgctttgagggagatgcgtggaccgggcaggccaggacccaacatgctttgagggggacgcaggacgggacagatcaggttggggcatccacctgggtctggggcagcttgctgggggcagaggctggctgcgtggcctcaggcagggagatacccctttcccttcccaccgccctcgtttgagccagcgagggacgtggcgtcgagctcctgggtccctggagctggccagcgggggacgtgacgtcgagctcgtgggtccctggagctgggtgttgccggcattggcctccctgggggcttcctggcgccagcccagctggcgggcaagcgctcccatggttcgaacgggatggatgcagagcagctgggcccgcaggaagctcgggcgggggcaggaaggggacaggatggggaaagtggcaatccctgtgggggctgggaccaaaggcctggagtttccggcgggcgggaggcccaggctgtgctcgggggcagcagggtcagggtggagggaagtgacgaccaagattccaaacgtctgccctggccagggaaggtgcccagaggcgggaggccggccggatcacacggacctcgcaggcccttcccagacgctgggttctgaccccgtgggggcccctccctgcccagttctgcccatttgctttgaagaaagcacgttgggggtgttcgggatggacttccctcctgggcagggcgtgtaaaggcatggacaggccgggtgcggtggttcacacccctgatcccagcactttgggaagccgaggcaggaggatcacttgagatcagaggttcgagaccaacctgaccaacatcgtgaaaccccatctttactaaaaatacaaaaattagcctggtgtggtggtgcccagcctgtaatcccagctactccggaggctgaggcagaagaaggccaggcgcggtggctcaagcctgtaatcctggcactttgggagaccgaggtgggtgaatcacgaggtcaggagatcgagaccatcctggctaacacagtgaaaccccgtctctactaaaaatacaaaaaaattagccaggcgtggtggcgggcacctgtagtcccagctactcatgagactgaggcaggagaatggcgtgaacccgggaggcggagcttgcagtgagccaagatctcaccgctgcactctggcctgggcaacagagtgagactgggtctcaaaaaataaataaataaataaaaataaaggcatggacatgctgggcgtgggtggggctcacacctgtaatgccagcactttgggaggccgaggcaggaggatcacctgaggtcagagatttgagaccagcctggccaagatggcgaaacccagtctctactaaaaatgcaaaaattaggtggattagtggcgggcgcctgtaatcccagctactggggaggctgaggcaggagaattgcttgaacccaggaggcggaggtttcagtgagccgagatcaagccactgcactccagcctgggggacagagcgagaatctgtctaaaaaaggaaggtatggacagggtggggcagttctggtgggtttggggccttggaatgagccgagtgttacccactccctgggcctcagtttcctcacctgtgaaccagggaggcaaaaatcccacggtgcgtctttttttttttttttttttttttttgagaaggagtctcgctctgtcgcccaggctggagtgcggtggcgcgatctcagctcactgcaagctccgcctcccgggttcacgccattctcctgcctcagccttctgagtagctgggattacaggtgcccgccacgcctggctaattttgcatttttagtagagacggggtttcaccatgttggttaggctggtctcgaactcccaacctcagctgatccgcccgcctctgccttccaaagtgctgggattacaggtgtgagccactgcgcctggccccactgtgcatcttaattccagcaaacattaagcaccagctgtgtccctgggctggacgggatgttcagaccgaggtggggctgagacgggcctggccctgtctgcagagaggtggatggtcagacacctgggcgaaggcagtgggagttactggccgtgggggctgggcacactggtgttcttttcacgcggccctagtgggcacaggctcaggcccctcgatggagggtgaagacctggcttgaggcctagtttgctttcagaggcttcagcttcacccctccccagggcagcctgcttctcaggtgctgaaactgagctgctctgggtctccactacccaccttctgcctgctcaggggctctgcccaggcacctcctgcaggaagccctccaggctgactgtgggctcccagacacctcctgcaggaagccctccaggcggctgtgggctggacccctcttctggttggaggggacacaagtctggctctgtgtccaacctgtcagcctgggcccaccttgttagacttacgcactcagccctcgtctgtcctgtcctcaggctgaggctgagctgccgtgaatgtcgcccgcccttgccagaccccggggctgggatttcatatcccggttttgttttcctggatctgcttgtcccgttatctcttctaatacttggaaagtgacatggtttttccagtttccctggtgagataaagtttcctgttaaaatgtgcaaatttgagcgggaaaggagagttcatttgatacagacagtgacataaacagcgcaggccaggggtcaggggacacagggagtcagccctggtttggatcccgcctctgctacctgctggccatgtggcttttgcactccgtgcctcagtttcccccatcatgaaagagcacgatgcctcttggggctgcctgggagccttaaattcagagagctaggccgagtgcggtgggtcacgcctggaatcccagcactttgggaggatgaggcgggcagatcacctgaggtcgggagttcaagaccagcctggccaacatggtgaaaccctgtctctgctaaaaatacaaaaaattagctgggtgtggtggtgcacgcctgtaatcccagctactcgagaccctgaggcaggaggatcacttgaacccgggaggtggaggttgcagcgagccaagatcacgccattgcactccagcctgggcaacaagagcgagaatctgtctcaaaaaaaagacactggggagctgtcgtacagaaggtgcccagagccccaccggggatgcaggagtcaccctcacaggcacaccctctccccaggttggagaaggaaattgaggtgctggagcgtggagactccgccccagccactgccaaggagaacgcggcggccccgagcccagtccgggccccagccccgagtccagccaaggaggagcgcaagacagaggtggtgatgaattcacagcaggtaagggggtgactggggggagcggatccccaggcacccactcccgctggccccagagcgaggccccagcccttccatgtcagcgtagctgaggggacaggcacagactagagccaggcacttgatttccagctcaccggagccacttcccagctgtgtgagccgggacacgtggtttcgccttgctgggcctcggtttccccatctgtaagatgggggagtaatcagagcagccaccgctgggggcatcagaaggactcagggaagcaggagacccacctgggggcatcagaagggctcagggaagcaggagacccacctgggggcatcagaagggctcagggaagcaggagacccgcctgggggcgtcagaagggctcagggagcagcaggagacccggtgctggtgggtgtggtcatagtgtttttttgcttttgttgttttttgagactcgttctgttgcccaggctggagtgtagtggtacagtctgcaacctccacctcccaggttcaagcaattctcctgcctcagcctcccaagtagctgggactacaggcgcctgccaccatacccggctaatttttttgtatttttagtagagatgaggtttccccatgttggccaggctggtcccaaactcctgacctcaggtgatccacccaacctcggcctcccaaattgctgggattacacgcatgagtcaccttacttggcctggttattttgtttctgtgtttgtttttgacacagggtctcactctgtcacccaggccagccagagtgcagtggcacaatcacagctcactgcagcctcgacttccccagctccagcgatcctcctgcctccgcctcccgagtagctgggaccacaggcacgcaccaccacgcccggctaatttctgtatttttggtagaaacggggtctctgctgtccaggctggggttttcatggtttctatcgatcacctgcatctgtttcatgtggccaaggctcctgaaagcccttcctgtgggaacagtatccccgtgtgatggaagtaaaaatcgcagcccacagaggcagagaggctggctcaaggccacacagctgagtggtccttagtggagtcggctgttaattctggcatctgccatctaagccagacgatgttaaaaccagacccttggccgggcttagtggctcacgcctgtaatcgcagcactttgggaggccgaggcaggcacatcatttgaggtcaggagttcaagaccagcctgaccaacatgataaaaccccatatctactaaaaatacaaaaattaaccagatgtcgtggccggcacctgtaatctcagctgctcgggaggctgaggctgagaatcacttgtacccagggggcagaggttgcagtgagctgagatcacgccactacactccagcctgggagacagagcaagattctttctaaaaaaaaaaacctggttctgggcacagtcctggacctcactgagctcacgtcaggtgggaagatggcgtgtattggggaccacccagggagggtggtcaggccgaagaggtgggaagcccagggcgctgtggaatccccaaggaagtgcctcattcgtgggagggctgggcaggcgacctggaggatgtgggtttcgtgggagggctgggcaggcgacctggaggacgtggggtggtttttttgtgtttttttttttgagacagagtttcactcttgttacccaggctggagtgcaatggcacgatttcagcaacctctacctcctgggttcaagtgattctcctgccttagcctcctaagtatctgggattgcaggcgcccgccaccacgcccagctaattttgtatttttagtagagacagggtttggccatgttggtcaggctggtctcgaactcctgacctcaggtgatccgcccgcctcggcctcccaaagtgctgggattagaggcatgagccaccgtgcccagccaaggaagtgggttttgaaggttgaataggagttctccaggtgcttttccctgaaggttgtttgagcatggactagtgctgtcatgggagactcagcaatacacatgcacggcccctgccttcctgacgggcacacccagtgacgtgatgagggaagagtgcactgagggagcatcagacaccacagccctgagacaggagtgtgtcccagaaacagcaagaagaccagggatgccagggcacagttcagggagaggggcctgtgtgcagggtctgaccatgcagggcagaacgggttcagacaggcgacactagaccctgagcctcgcacagtggctcccaggaggccaagggaggaggatcgcttgagagcaggagtggacgagactggagggggcacggaggagccggctggattcagggtggcctgcgggagccgctgatgcgggggtatgtggggagggagggaagaaatgagatggagcggacgtggtggctcagcctgtaatcccggcactttgggaggccgaggtgggtggatcacctgaggtcaggggatcgaaaccagcctggccaacatggagaaaccccgtctctactaaaaatacaaaattagccaggtgcgatgacgcaggcctgtaaccccagctactggggaggctgaggcacgagaatcgcttgaacccaggaggcggaagttgcagtgagccaagattgccccattgcactccggcctgggcgacaagagcgaaactccatctcaataaaaagaaaaaagaaagatgacctctgtgtttctggccagagtcccaagaggataggatgagaagcgggtgcgtatgacgtcacccactgtgccatgccctccccaggctcctgaccccatggctccccttcctcttcccggggatgctgacgcccctgacccttctctcttctttcttgcagacgccggtgggcacgcccaaaggtaggacctctggaaggaactcgtggggcctcggcgcactctggtggccagagaggggatggcagggcggggagtgaagctacaaagttgctcggtgcctcacgcctgtgatcccagcactttgggaggccgaggcgggtagatctcctgaggtcaggagttcgagaccagcctgaccaacatggcgaaactcagtgtctactgaaaaaatgcaaagacaattagccgggtgtggtggctcatgcctgtaatcccagcactttgggaggctgaggcaggaggatcgatcgcttgagcccaggagttcaagagcatgctgggcaacacagggagaccctgtctctgccaaacataaaaaaattagccgccggccaggcccagtggctcagacctgtaaccccagcgctctgggaggctgagacaggtggatcccttgaggtcaggagttcaagaccagcctggccaacatagtgaaaccccgtctctactaaaaatacaaaaattagccgtgtgtgctgcacgcctgtagtcccagctgctcgggaggctgaggtgggaggatcacttgagcccaggaggttgagctgtgatcgcaccactgcaccccagcctgggcgacagagcgagaccctgtctgtaaactgcatttcacggaacgtgtccgcttctgtatcgatagcgggacagccaccagccgggattgacgctggcgtctgaagtgcttctggcctggtttgttgtgtgttaattattcataaggagagtgtcttcttgtcttactgtagaattaaaaattaatcattaaaaaaatccagacaggcctctcagggattttgtgaaaatcactgggctgaggatgaggaatgaactgtgaggctgcctgtgggattttctaggggttgcggtgggggtccaggtgcctgtgtctgtgcggggcctgtgtctgggggcccaggtgcctgtgtcctggtgtctgggtggggtctgtgtgtctgggggcccaggtgcctgtgtcctggtgtctgggtggggtctgtgtgtctgggggcccaggtgcctgtgtttgggtgtctcggtggggtctgtgtgtctgggggcccaggtgcttgtctggatgtctgggggcccacaggtgcctgtgtccgggtgtctgggtgggatctgtgtgtctgagggcccaggtgcctgtctggatgtctgggggcccaggttcctgtgtccgggtgtctggatgggatccgtgtgtctgagggcccaggtgcctgtctggatgtctgggggcccaggtgcctgtgtccgggtgtctgggtgggatctgtgtgtctgagggcccaggtgcctgtctgggtgtctgggggcccaggttcctgtgtctgggtgtctgggtgggatccgtgtgtctgagggcccaggtgcctgtctgggtgtctgggggcccaggtgcctgtgtccgggtgtctgggtgggatccgtgtgtctgagggcccaggtgcctgtctgggtgtctgggggcccaggttcctgtgtctgggtgtctgggtgggatccgtgtgtctgagggcccaggtgcctgtctgggtgtctgggggcccaggtgcctgtgtccgggtgtctgggtgggatctgtgtgtctgagggcccaggtgcctgtctgggtgtctgggggcccaggttcctgtgtctgggtggggtctgggtgtcaaaggcccaggtgcatgtgggagtccggatgcacttctgtgaaggggcgttgggctgtctggggggtccatgtgacctctcctctgaccctcatctctctctccgcttccacctcccgtgcagacaagcgagtctccaacacgcccctgaggacggttgacggctcccccatgatgaaggcaggtgggttggcccccaggctctgggccccagatccagccgctgtcagggaccaagtctcggtccggggggccgggtggggcgggggcgacaccgacctgctctccgcagcgtctgacggggccgtggttatgggggtggcagctggaccgaggccgaggctccgagcctggggtgggggccccctctgctttgttgccctggtcccacgccggcccacgcttccccgagaagacgggccccacgcatggcggctctaaccgacgcgacctcacggctttcattccaccctaatctcacggctccctcctggggcccgctgggggtggcgctcacgcctgaacatgctcgctgcaaatcttacctgctccagtcctcgggcagtaggactggctgccccgggagaaagtgggtgccccgtccctggaggcaaccaagccaggtccccagcaccgctgcgcttccgagaagcaggggaaggtgggggttgacgctgagtgccacacggtgctcaagtcaggctcgaacccctggtctgccgccttgaatttctccgcctgccagaggggtgggacctcagtacgccatcctggggcccggcacaggacaggagcccaataatgagaaatcgtcgcagtgggcaaaaccactgctatgtgagtgagctggaacagcacagaaagaaggcagagggccgggcgtggtggctcacacctgtaacccaccccagcactttgggaggccgaggcgggcagatcgcctgaggtcaggagttcgaaaccagcctggccaacatggcgaaaccccatctctactaaaatacaaaaattagccgggcatggtggtgcacgcctgtaatcccagctactcgggacgctgaggcaggagaatcgcttgaacctgggaggcggagtttgtagtgagccaaggtcgtgccactgcactccagcctgggcgacaagagcaagactccgtctcagaaaaggcagcaaggcagggaggtgaagaaggactctggggtggctgcccaggacgggacagggctggaaggaaggagagccacccggaggcccaggtctccagcacggtccagggtgggggttgccccaggatgcagcagacagaggcatttgtcagagcaggtggtgcctgtgggcctctgtgccagtgagaccagccctggcagacaccgaggcccaggtcccccgctgatccccgtggccactgactttgtgcagtgcacaacctgctcaacagtgtgggcagctctggactagctgtctggggtggagggctgaggctgtgcagagctatagagttgaaaaacagtcgtcccttcacccagaatgcctttcaagcgcctgctgcatgccaggcattgggggagagggtattctaatgagggccacaacctctactacggtagaaaagtgaggccaaggacgttgagctggaggaaggagaatttgaaccagagggctcaggggaggggagcgttcaacgtaagaggtgacgtctgagcaaagacccagaggtgctgagggagcaaggcacgcagctatctggaggaaggtgtccaaggcacgcagctatctggggaaaggtgttccaggcagagggcacggccagtgcaaaggccccggggcaggactgcgcctggggtgttggaggaacggccaggagatccgtgtggctggagcagcgtgaggagggggagagggcggaggagagatgatggagagattgttgagggccctgtggcaggggcgggaggggacgtgggcttttcccgggagggaggcaggaaccatggggggctgcaggcaaagccgggactgccccgactccgtgctcacccacgccctctggtgactgcagggagaacagaccgtggacggtgccaggtggaggggacagggctgctgggggaggaggctgggatgggccgtggaggggcgagcagtgggcggttccttatgttctgaaggtggagcccccagggtttgaggagaaacgaggtgtcagggaggactggccaggcacggtggctcacgcctgtaatcccagcacctttggaggccaaggcgggcagatcatttgaggtcaggagttcaagaccagcctgagcaacatggtgaaaccccgtctctactaaaaaatagaaaaattagccaggcgtggtggctcacccctgtaatcccagcactttgggaggccgaggggggcagatcatgaggtcaggagatcgagaccatcttggctaacacggtgaaaccctgtctctagtaaaaatacaaaaaattagctgggcatggtggcaggtgcctgtaatcccagctgctcgggagccttaggcaggagaatcggttgaacctgggaggcagagattgcagtgatctgagatcacgccactgcactccagcctgggcaacaagagcaaaactttgtctcaaaaaaaaaaagagggaggactgagctgcccccaacgggtgggaagagccagggtgggggcaggtgtagggggcagattgggagtagtgttatggacgtgtgagagtggggcccctgtggataggggctgagtccaggtcaaggtccaggtggggatgggtgtgcgggagattagagccgagtgcctgggcgaggtccccggcgcagagcagagtccagggccgcagccgggcctaagcgtcgaggttgggtgggaggagggaaacgaggtggctatgggggccgaggggccaggcgatggcagggctgcccacgatggggaccgatggcccctcagaagtggtgaggacatgcagctatctggggggtgtgccaggcattgggaacagcctgtgcaaaggccctgaggctgggccgcacctggggtgcagtgtcatgggtcaggccagtcctggcagccctgttcagctcccgctgcggggcggggtctcagggaggtgcctggtgatccccagtgctcgtcatcttcaagcaggcctgggggtggcgggcagccaccagtcgctgttaggatgcaggctctgtgtggtttctgcaggaatgatttttacagagtggggcgaggtgctggctgtggagttagggccctgatgagtagcaagttcgactatctcaggagggttccttcattctgagtctaaatagatgacggcgtgtccaaccgttggctggaaggaggcgtcaagtcctgggagcttggatggtcggggcgggggctgtgggtctgcagactgagccccagtctccgccgtgaccccgggcaaggcaggatctctctgggattcacctgctcctctgagaaaccaggaatggtggggctcgagggctcacgtttataatcccagggctttgggaggctgaggtgggaggattgcttgagcccaggagtttgagaccagcctgggcaacatagtgagacccccatttccaaaaaagataaataaattagccgggtgtggtggcgcacacctgtggtcccagctacttgggaggctgaggtgggagaatggggtgagccaggaaggtcatgactgcagtgagctgtgatcgtgccgctccactccagcctggccaacagagggagaccctgtatctatttaaataataggctgggcgcggtggctcacgcctgtaatcccagcactttgggaggccaaggcaggtggatcacctgaggtcaggagtttgagaccagcctgaccaacatagagaaaccccgtctctactaaaaatacaaaaattagctgggcgtggtggcgggcgcctgtagtcccagctacgtggaaggctgaggcaggagaatcgctagaaccgggaggtgagtccagatcacaccactgtgctccagccggggcgacagagcaaggcggctccatctcaaaaaaattaaaaagatccgggaacaatgaaggctttccagatgggctgggctggaacctgagcttgacagacaatagtttggtggcgaaacagaggacacagtgcagagtacagggacgaggaccatctgggcggacagcaggatgggcctcaaatgccaaggagaggtgttcagactggtcgtctccaggcactggggagctatggagggatgtagagttggggagggccgcgtcgagaaggtgcccaggcatccccggctccgcctgccccatcgctgcttggctctgcgctgctggctcccccctccctggcttggccgcagcccggcgggggggtgcgggggcgggcaggccgtggtgtaaccccgtgactctcgtgccagccatgtactcggttgagatcactgtggagaaggacaaggtgacaggggagaccagggtgctgtccagcaccacgctgctccctcggcagccgctccctctgggcatcaaagtctacgaggacgagaccaaaggtacgagcaccccggcccctgccctccctccacctgggccagagccccgaacacgtgtgctcccagcgtgtgggtctggcgtctgccccggaatcaggaccccgattcgatgtgaagcagatgacgctgttcaggccagggcctcaccccctgtggcccacagctgggctcagaggtcgttcagccctgggctcactgcccaatcattcatccactccagaaagctgcctgaaagctgagccgggcaccaggtacccagctgggctctggagggaaatccggaggtagattcagcttctgtccttgccgggtggcaaaccgggcccttccatctggagctcctaaataattcgtttaaataattactgctagcccaagggctcacgcctttagtcccagcactttgggaggccgagggaggaggatcgcttgagcccagaagtttgagaccagcctgggcagcatagcaaggctccgtctctaccaaaaaaaaaaaaaaaaaaaaattaccctggcatggtggtgcgtgcctgtggtcccagctacttgggaggctgagatgggaggatcacttgggcccaggaggttgaggctgtagtgagccgtgatcgcaccactgcactccaacctgggcaacagagtgagaccctgtctcttaagaataaaaaataataataaagaattgctagcgtgacagaagccacagaaaatgcacatccagggggctgtgagaagtctcacagggtgaggatggggccgggggaggcttcccagaggaggcaagcaggggctcatcagagacacgcagtgcatgggaaccacacctggcagagccgcagcccctgcaaaggccctgaggtaggatggagtcagctgggctggagggctgaggggagttgggctgcaggagtgaggggagacgggctgcaggggtgaggggagacgggctgcaggggtgaggggagacgggctgcaggggtgaggggagacgggctgcaggggtgaggggagctgggctgcaggggtgaggggagacggggtgaggggagacgggctgcaggggtgaggggagacgggctgcaggggtgagggggaaccaggttggtcagggagttgaggagctgggctcacgcagggaggagaagggtgctttgcctggaggcagggggacaggcggggccgtgtcctgagggctttgggaagccttgggtgcgttgggtcctgacggtgctgaggtctaatttggttttaagggctcctcctagaggtcaagaggcaaacaggctgtgggagatgccagggaccccaggaggaggagggaagctccacactgaagccccactctctctctttctttttctttttatttatttactttctgaagaaagagtttcactctgtcgcccggcccgcagtgcagcgatgccatcacagctcactgcagcctccagctcctgggctcaggcgatcctcctgcctcggcctcccgaaatgctgagaccacaggcatgagtcactgcacccggcctctttttcttttatgagatataattcgcagaccataaaattccgccttaatgggaggctcatctgggcccgggacattgaggctgcaatgagctatgatggcacccctgcactccagcctgggccacagaccaagaccctgtctcaaaaacaagaaagaggagagaagccccatccccatcagctgtcacttcctgtcccctccccagtcagcgtcactccctatcccctccccagctctggcacccacgcatcccctcctgtctctctggattggcctgtcctggacatttcatagaaatgagatcacacggccgggtgcggtggctcacacctgtaatcccggcactttgggaggccgaggcgggtggatcacctgaggtcaggagttcgagaccagcctggccaacatggagaacccccgtctctgctaaaaatacaaaaattagctggacgtggtggcggacgcctgtaatcccagatactttggaggctgaagcaggagaatcacttgaacccaggaggcggaggttgcagtgagccgagatcgcgccactgctctccagcctgtgcgacaagagtgaaactctgtctcaaaaaaaaaaaaaagaaagaaaagagaataaatggggtcacacactgcacgtggccttctgtgtctggcgtctctcactgggcgtgacgtccccaaggtgcatcggcactgtggcctgggtcggagcctgactccttttcatggctgaatactattccacgggttgggtgggccatggtgggtttatcccttcttccatctgtagacagttgggctgtttctaccctttggctgcagtgagtagcatgctggggaatttgtgtgcaagtatttgttcacgcccctgctttcgaggcctttgggtgtacacgtaggagtgaactgctgggtcctgaggcgactgtgtggagctccgtgaggacctgctgttttccacggaggctgcaccgtcccgttcccacaggtcgtggatgagggcccagtttctccacgtcctcaccagcgctcgtagcccattctcgtggctgtcctggtggcgtgacgtggggtctccctgtggtttggattcccaaagccttctgttctcagaggcagcttggcctctgcggtgccccagatgctgtcagaggggtccccgcagcccagctctggagtggctttggggtgtggcgttggtggcatctcagctctagctctccccagctgtgtggccctgggaagtccccatgcctcgtcttccggatgaggtcctcacccccatcactccaccctcctcagcctcacctggtccctggggattccagacctgccaggctggacactggttgcttagcaacgggcaggtgatccgtttccatggcagccgagggctccaattcctgtcttggggcagcggccagtgggacacactgagttcagttccgcctgatccagacacaccccaccctctgggcctccagcccaaagtcattgagatgccttgaagcatggactcccctccctgggggcttagaaactgaaagtggagaacactttccttctggtctgtagccaggaacaggagccctgacccttggccgagaggaggcgagtccctgggaccccccttgcgtccctcccaactcccagcgtggcccaggcagccgtgtttctagaaggaatttgcagggctgtgagctagggctggtgttagatcatagcagggagccgtggggtgctgaaatccggtccttggagagtccaacacacctcaagaaatgtcaagtcagagacacacagataaggaaatttggaaagacttgagaaacacatttagcaagattgattatatgtataaaatgctacccagtggagaatacacattcttttcaaacacagaacattgtcagaaagtgaccaccgtggcccaggctgccaaggaggttttaggactgttaacagagtttgtatcttctgctctgtgttcctctcctccctgaaatttaaaaacaccctctaaataaattgtggcttcctgtggcaatcaatcaaactaggaattaaaaactatttacacttgaaaatgaataacattggccgggcatggtggctcacgcctgtaatcccagcactttgggaggctgaggcaggaggatcacgaggtcaggagatcgagaccagcctggctaacaaggtgaaaccccatctctactaaaaatacaaaaaattagccaggtgtggtggcaggcgcctgtaatcccagctagtcaggaggctgaggcaggagaatggcgtgaacccgggaagcagagcttgcagtgagccgagatggcaccactgcactccagcctgggcgacagagcgagactccatctcaaaaaaaaaaaaaaatagaaagtgaataacatcatctaactcgtaggacacagccaaagcagacctcagaggaaaatgcatagcctttagggaagctcctagaaaacaaaaataaatgaatgaaactttaactcaagttagaatgaatgaaaatttcaatttaagatcaatcaaatacacccatagatggaaaaaatcagaatccctgtaatggccaggcatggtggctcacacctgtaatcccagcactttgggaggccaaggcgggtggctcacctgaggtcaggagttcaagaccagcctggccaacgtggtgaaaccccatctctactaaaaatacaaaaatcagccgggcatggtggcgggtgcctgtaatcccagctactctggaggctgaggcaggagaattgcttgaacctaggaagtggaggttgcagtgagctgagactgcgccactgcactccaccctgggcgacagagggagtcaaaaaaaaaaagcagcaggcacggtggctcacgtgtgtaatcccagcaccttgggaggccaaagtgggtggatcacctaaggtctggagttcaagaccagactggccaacgtggtgaaaccccatctctactaaacgtacaaaaatcagcctggtgtggtggcaggtgcctgtaatcccagctactctagagactgaggcaggataattgcttgaacctggaaggtggaggttgcagtgaactgagatcgtgccattgcactccagcctgggcaacaagagcgaaactccatctcaaaaagtgaaagaatccctgtaacctccagttccccagggtgggtggtcctgtcttgtagaagagaaacaggccccgatgcggggaaggagcaggggtttggctctgtgaccttggcccagctgtgtcccttctttgaactttcatttttgctatctttacagcggaaatgaatccctacttttcagggtgatcacgtgggagctagttggctaaagaatatggaattacaggccaggtgcggtggctcacgcctgtcatcccagcactttgggaggctgaggtgggcagatgacttgaggtcaggagtttgagaccagcctggccaacatagtgaaaccccagctctattaaaaatacaaaaaattagccaagcatgttggtgcatgcctgtaatcccagctactcaggaggctgaggcaggagaattgcttgaactagggaggcggaggttgcggtgagccgagacagtaccactgcactccagcctgggcagctccatctcagaaaaaaaaaaaaaaaatcccaattcattcctttccactctttcttggttcctaataaatgtttttgtgcttataaattttcctcattgtcggctgggcctggtggctcacgcctgtgatcccagcactttaggaggccaagacgggcggatcacctgaggtcaggagttcgagaccagcctggccaacatggagaaaccccgtctctactaaaaatacaaaattagctgggcgtggtggcggattcctgtagtcccagctactcaggaggctgaggcaggagaatcgcttgaacccgggaggtggagcttgcagtgagctgagatcacgccattgcactccagcctgggcgacagagtgagactccgtctcaaaaaaaattttttttcctcattgtacggcattggctgcatccacagatgccaacagggggctttaattgtctgtcagttctgacggtgtaatctagttcgtgatttcctctttagcctggaggaggatacaagccttgccaaggtttccctcctgcctgagccaggtcactctctctgtccctcctgcctggagctgggtcattctctctgtctctccttgtacagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcagatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagccccagttcctggagttcttgcctttcaacctggcgaggaaggcgtggccaggccagggggtggggcctgccggcctttgagccattaaagggaggctgagcagggttgcggtgtgctggcttcacctgcctgcacccgctcaccctgagcgccttggggtggtgggaggcgctggaatccccactgtgcaggtaaggcctggctgtaaggggctgctgtgggggggcaggactggcttcccggggggccctcgggttctgcggccgccccgtcctgtcctttgttcctccctttgctgggctcacagcccctgggtgatgacagagggtcccctggacacccacaagctctgtagagaagccggcccctgggaaatacacaggaggcctggggaggaggtgtctgtagagaccagtgtcatgctcacgggaaggtgctgccccgccagccccactctctcacgctgtagtcttggagaagtcgctgcctcctctgggcctcagttttcccatctgtaaaataagccttcgtggccgggcacggtgtttcacacctgcaatcctagtactttgggaggccgaggtgggcggatcacaaggtcaagagatcgataccatcctggccaacatactgaaaccctgtctctactaaaaatacaaaaacttagccgggcgtggtggctcacgcctgtaatcctagctattcaggaggctgaggcaggagaatcgcttgaacctgggaggcggaggctgcagtgagctgagatcgtgccactgcactccaacctgggcgacagagcgagactctgtctcaaataaaataaaataggccttcggagccctgagtgggaggccagcctcagcctgggcgtgggacgtctccacagtgcccccagctcatgggcgatccagcctccaccctgctggggcctcagttttccccgatgaggtggtgagtgtggtggagagcactgctgagggaactcaggttccaattccagcctaaacccccgccattcctgaggcgcgattttaagctttccgtacctccgtttccctatctacaagccagggagaaaaggacgtgaagggggtggcgggaggcggcggtgggaggcgccgtgaggccgcgcaccctgagctttcacacacccagcagcgttaggtgccacgctgtcctttgggggccctttatccagatttgtccttaaacacccccatcttggccaggcgccgtggctcgcgcctgtaatcccagcactttgggaggctgaggcgggggcatcacctgaggtcaggagttcgagaccagcctggctaacgtggcaaaaccctgtctctactaaaaatacaaaaatagctgggcgtggtggctcatgccagtaatcccagctactagggaagctgaggcaggagaattgcttgaacaggggaggttgccgtgagccgagatcgtgccactgcactccagcctgggtgacaagagcgagactccgtctcaaaaaaaaaacacaaaaaaagcacccccctcctgagcagccctgctggattcgtagctgggggcctttttactcgaagaagagactgaggttcagaggggctccacaagcagcccctctggcgtaggtcaggacagagccccagcctggggaactgaagtccctgccccctcagctgtgttccctgccctcatagacggcgctaggcccagtggcccgacttccccacagatgctgggctccccacagtcccagcaaggcctctgcaccttgactaagaatccaggaggaccatgggcgcctgagggcctctgcgtccccatctctcggggtggcctgggtcttttgacggcctcgtgcggttcttttttttttttttttttttttttttttgagttggagttttgctcttgtcgcccaggctggagtgcagtggtgtgatctcggctcactgcaacctccaactcctgggttcaagtgattcttctgcctcagcctcccaagtagctgggattataatagcgtgccaccataccccgctaaattttgtatttttagtagagacggggtttcgccatgttggccaggctggtctcgaactcctggcctcaagtgatccgcccgcctcggcctcccaaagtgctgggattacaggtgtgagccaccaagtccggccccctcgtatgggtttttatgtggatggggcctagggaattcctcccagcagccctgagggagcccgggcgtgatgttcccccacgtcccggaggagaaaacagggctaagagaggtcaggtgggatcagaacccaggccacaccaaacccccccgagtctgccaaacctggtttatgcaagaagggggccatctaggggagttgccccaaggggtgggctgggccagaaggcacggacgggattgggactcagcccctccggccccccaggagacacaggccactgtgcacgctgagctgctgtgtggccctggacacctgctgaccctctctgagcggtgctgagaggcggtgggagggccaggcagccaagggaggtttcggctgagttctggctcctcggggccacctggaggccctgggggtggaggggcagccggcagcgggcacggtgcccgcccttgcccagcctggtatcctctttctccctcctcctcctctggactttgtttcctgatcccaggtggggctggggggagggggcacacctgcctcccctgggtggggcctctgttccctggcaacctggcgggcagggcggagctgggaggcctctgtgcccatcgaggagtcagagtggaggctgcagactgtggagccgggagccggcaggtgaggctgggggcgccccgggccgggccgggcggggatcctgtgtggggcggttggatccacatttggcgtgggagcgtcatgtgtctgtgggcggggtctgcttgcctggcggcacttgggatccagggaggccccctgccccaccccgtcaccctcggagcctccctgaggcacctttccctctgcccccgctaggtactctggggcctcaagggcacccactgggagagcagagaggcccttgtccctgaactctgctggggcttttgaaccccaaatcccagagccctccaagggaggggccgggttggcacccccatggtcagaggccagaggggcccctccatggttctgggaattccagaggcttctggagagatgcttatccgtcccaccaggcccctgactgggaggctctgggcagtaaacacccccgtggggctgggggctggtttggggacacggaggaggggtggctgagtacaggcggaaggagtctcaggccggggctggggacttggcctgggtcctcgggtgggggtgaggtggtagcctgggatcccgggcagccagcagggactcggcccagcgtctgccggtggagctccgcccaggagcccaaggagctgagatgactcaagggtgactgcaaccctgagggatgggaaaaaggaacggggccctcccttctgcatggcctccttgtctgagtctcggccccacaagggaacctttgcccctcacatagagccaactggctgatgaggaaggaggtgtggcaccagggtccataaacccagtttcattctggtatcaacagagttcagggtgaggctgggaggagcaacccagggggcttcctgtaggagggggtgatttggagcaaagtctgaaaactggcttcagacacttgctctgtcatcgctgtgtgacctcagatgagcaggttctcctctctgggtcccagctccctctctcgaaaaccggagtcgaaaacggttccaaggtgttgcaggaagagtctcaggacgccgaggtccttagccaccgccgggccttgcaggggccatcttccgtcctggggctcttcccccgagggcagcgccgctgcccaagaatgccggccatgagagccgccgtggatccaggggtttttttggccgacacagtgaaaccccatctctactaaaaatacaaaacttagccgggcgtggtggcgggcgcctgtagtcccagctacttgggaggctgaggcaggagaatggtgtgaatccgggaggcagaggttgcagtgaatggagatcgcgccactgcactccagcctgggcgacagagggagactctatctcaaaaaaaaaagcggggggcgggggtgggcactgaggcacaggcagcaggggagggggcccagtggccttgaacccaagagctggaccccaggccccacccgctggcttcagtgaatcactggggaggaatgagcagaggaggatgcgtgccttcatccccacccaaccccgaccccactgggagacccggcacctgctcgaggctgggcggacagctccctttctcccggagttgacgtctgatgtgggttataaatcccgctgtgtaaacgtctgtccactcactgggcaaacattcctacacccgccctccccggggagctccagggtgcagggcgtggacctgcccagcccttcagggccagaaggcacggtggagccggtctgcattccgcaatgagcccgacccccacgtctgagcagctgggatgagtggtgtttgcccagccagtatttattaggcgcctgctgtataccagactctgggctgcaggaagggtgctgacctgtggccacagcaggcgagagcgaggcctgggctgacggtttcgggtgggagaaggcaaggccttccgtgagctgggcaggcggcgtccacggaggaggaggcctcgggtcaggggagccatctgtgcgtcacgctttgggaggaagctcagctgtttgtgtgggatttattcaccaatgccgcctggttttcaatgtttcccctattttagtttctgacatttgatacgcgcggaagattgcatgacacattgcgtgtagtttcaacacggctccccacggtctctccactttatgctgtttgatgccactttccagttcagagaggggctaagtttttctttttttttctttttttctttttttttttttttgaggcggagtctagctctgtcaccaggctggagtgcaatggtgcgatctcagctccctgcaagctccacctcccgggttcacagcattctcctgcctcagcctcctgagtagctgggactacaggcgcccgccagcacacccggttaattttttttgtatttttagtagagatggggtttcaccattttagccaggatggtctcgatctcctgacctcgtgatccgccaaagtgctgggattacaggtgtgagccactgtgcctggccgaccctgtctgtttaaaaacaaaaaaaaatgctgctggttggtgtaaaggcagcagatctaaataatagccttggtggcccgggagcgacagtcctgctttgtgggggtttgtttttcttttgagacagggtctttctctgtcacccaggctggagtgcaatggcacaatctcagctcaccgcaacctccacctcacaggttcaagtgattctcccacctcagcctcccaagtagctgggattacaggcctgagcccctgtgcccagccgacagtgctttttttaggagtcaggagctcaagcttttgagatccctgtgtcttcaggtgaggcttcctttcctcaactatgaaagatgatgtctgctggacacggtggctcacgcctgtaatccctgcactttgggaggccgaggcaggcggatcacctgaagtcaggagttcaagaccagcctggccaacatggtgaaacccgtctctactaacaatacaaaaattagccgggtgtcctggctgggcgcggtggctcacgcctgtaatcccaacactttgggaggccgaggcgggaggatcacgaggtcaggagatcaagaccatcctggctaatatggtgaaaccccgtctctactaaaaatacaaaaaattagccaggcgtggtggcgggcgcccgtagtcccagctctagggaggctgaggcaggagaatggcgtgaacctgggaggcagagcttgcagggagccgagatcgcgccactgcactccagcctgggcgacagagtgagactccgcctcaaaaaaaagaaaaaattagccgggtgtgggggcgggtgcccgtagtcccagctactcaggaggctgaggcaggagaattgcttgaacccgggaggtggagattgcagtgagctgagatcacgctaccgcagtccagcctgtgcatcgcagcgagactctgtctcaaaacaaaagacaatacctaagacgggtgctgggtacaaggcctgacatgaaggaggtgttcagatgatggctctgggggaggggcaatctgggttacttcctggaggaggtgtccatgggcttcagcagaggaagccgtggagaagcagaaacaggcagcctcgagacagagagagctgcaggtagaggaggagggcgaggtttggggtggaggaagagggcctggtttggggtggaagaggagggtctggtttgggttggaggaagagggcctggtttgggtggaagaggagggtctggtttgggtggaagaggagggtctggtttggggtggaagaggagggcctggcttggggtggaggaagagggcctggtttggggtggaagaggagggcctggtttggggtggaagaggagggtctggtttggggtagaagaggagggcctggcttggggtggaggtgcccacagaaattggggtttcgtgctaaggccaggagcagggtgtgagaactgtgccctgcagatgccaggagccacagaagcgatgcgagcaggtgtgtgacctccgggaaggctcctggaactgagcccagcagcaacctggacccttgggagagggcgagagccggaaggcactgggtcagggtgtcacccgctcgctccacggccccacctgggcccagcgggacaaggtccacggtgttcctttgcccatcctggctttatggcgacaaggcccaggcggggatgttgtctcagatgggacgaggtgtccagctgggcagggcagggtggagaaccaggatgtgggagccgggaaactggagttgctgtcagtccttctctctgggcctcagtttctccatttgacatcccttagcaaggggccatctgtaattgtcagatggaaaaatcccacaccaggagtctcagagtgagctcagggtggaaaggctcagtgcacaggagacacagataaatatggtgcggccaaggaaggcttcagagatcaaggctgaggccaggcgcggtggctcacgcctgtaattccagcactttgggaggccgaggcgggcagatcacctgagctcaggagttcgagaccaacctggccaacatggtgagacctcgtctctactaaaaatacaaaaaattagccggacttgggaggttagcgcctgtaatcccagctactcaggaggctgaggcacgagaattgcttgaacctggaagcagaggttgcagtgagctgacattgtgccactgcactccaggctgggcaacagagcgagactccatctcaaaaaaaaaaaaatcaaggctgagctggactccacagggcaggtgtgtgtgtctgggagataaggtgggcagggcaccctgattttattgggctgcaaatgttagaaacatataatgcgagttgttggggtagtaaccgggacattcagagattcaggtatggttggaatcagggagcttaaaagttttcaggatgctttgctggtgttggggttgctgtcaagcaagctgtacccactgggggcatttacgtccccagcaattcactatctcattccatcagcctaacaagaccagcgggaagagggtcccatcttctgcattaattgtaaagtcccagggtctcatgtcattggctagactgggtcacatgctcatctctgaaccaattacagaggccagagggtgaaatgctctcactggctggactaggtcacttacccatctttgaaccaatcacagaggccagtgggtgggatgctctgattgatcaggatgagtcacttacccatccctgaaccaatcacagaggccagagaatgggctactctgactggccaggctgggccatttactcatccttgaaccaatcacagaggccagaaggtgggatgctctgattggccaggctgagttacttacctatcccttagccaatcacagagattagacaatgggctgctctgagtggctgtactgtgtcacgcacccctaaaccaatcacagaggttagagaatgggatgcactgattggctggactgtcacttacgcacccctaaaccaatcacagaggttagagaatgggctgctctgagtggctggactgtgtcacttacccatccctaaaccaatcacaaaggccatttgatggaccctttgccctttgggggactggaggctgttcctctccctaggtgctctgacttgatggccctcatttccttctcctccctcagtaagcccagaggtctccaccccacgggaggaaggctgaggccaagaccccggaagagatggaccgcgtgaccagataccccatcctgggcatccctcaggcacaccgtggcaccggcctggtgctggatggagacaccagctacacataccatctggtgtgcatgggccccgaggccagcggctggggccaggatgagccgcagacatggcccactgaccacagggcccagcagggcgtgcagaggcagggggtgtcctacagcgtgcatgcctacactggccagccgtccccacgggggctccactcggagaacagggaggatgagggttggcaggtttaccgcctgggcgccagggatgcccaccagggacgtccaacatgggcactccgcccagaggacggggaggacaaggagatgaagacctaccgcctggatgctggggacgctgaccccaggaggctgtgtgacctggagcgggagcgctgggccgtcatccagggccaggcagtcaggaagagcagcaccgtggccacgctccagggcactcctgaccacggagaccccaggacccccggcccacctcggtccacgcccctggaggagaacgtggttgacagggagcagattgacttcctggcagcgagacagcagttcctgagtctggagcaggcgaacaagggggcccctcatagctccccggccagggggacccctgcaggcacaaccccaggggccagccaggcccccaaggccttcaacaagccccacctggccaacgggcacgtggttcccatcaagccccaggtgaagggggtggtcagggaagagaacaaggtgcgtgctgtgcccacctgggccagtgtccaagttgtggatgaccctggctccttggcctcagtggagtccccggggacccccaaggagacgcccatcgagcgggagatccgtctggctcaggagcgtgaggcagacctgcgagagcagagggggcttcggcaggcaaccgaccaccaggagctggtggaaatccccaccaggccgctgctgaccaagctgagcctgatcacagccccacggcgggagagagggcgcccgtccctctacgtgcagcgggacatagtacaggagacacagcgtgaggaagaccaccggcgggagggcctgcacgtgggccgggcgtccacacccgactgggtctcggagggtccccagcccggactccggagagccctcagctcagattccatcctcagcccggccccagatgcccgtgcggccgacccagctccagaagtgaggaaggtgaaccgcatcccacctgatgcctaccagccgtacctgagccccgggaccccccagctagaattctcagccttcggagcattcggcaagcccagcagtctctccacagcggaggccaaggctgcgacttcaccaaaggccacgatgtccccgaggcatctctcagaatcctctggaaaacccctgagcacaaagcaagaggcatcgaagccccctcggggatgcccgcaagccaacaggggtgtcgtgcggtgggagtacttccgcctgcgtcctctgcggttcagggccccagacgagccccagcaggcccaagtcccccatgtctggggctgggaggtggctggggcccctgcactgaggctgcagaagtcccagtcatctgatctgctggaaagggagagggagagtgtcctgcgccgggagcaagaggtggcagaggagcggagaaatgctctcttcccagaggtcttctccccaacgccagatgagaactctgaccagaactccaggagctcctcccaggcatccggtgagaaggggctccagggagtggctgcttggctcagggtctcagaggttggagcaggggagggtggggaggtggagtttgaggctgtcaaagggctggggttggggagacattgcctcctgactgttcatcccctcagtcgctggtttgtctgcctgtctattaaaaatgtagattttggagagaaatgtcaactttaccttagggcttttgctttatggatttggatgccttgttgttaggcgcataaatgttcatatatgttttgtgtgttttgtttttgtttttgttttttgtttttcggttttcttttttgagacggagtctcgctctgtcgcccaggctggagtgcagtggcaggatctcaactcactgtaacctccacctcctgggttcaagcgattctcctgcctcagcctcctgagtagctgggattacaggtgcccaccaccactcccggctaatttttgtatttttagtagagacaggtttcatcatgttggccaggctggtcttgaactcctgacctcaggcgatccaccctgccttggcctcccaaagtgctgggattacaagcatgagccactgctcccggcctgttcatatatgtttatcctcttggacagttgcacctttttgacaatatgaaatattccttgtgtcacttttaatgttttttttttttttttttgagatggagtctcgctctgtcacccaggctggagtgcagtggcgcgatctcggctcactgcaagctccgcctcccgggttcacgccattctctcgcctcagcctcctgagtagctgggactacaggcgcctgcctccacgcctggctaatttttttgtatttttagtagagatggggtttcaccgtgttagccaggacggtctcgatctcctgacctcgtgatccacccacctcggcctcccaaagtgctgggattacaggcgtgagccaccgcgcccggccacttttaatgttcttcaccttgcatgtcggcccatctgtgcatccagtttctcctgactggctactttggtcaatctgtcagtttcccggatagtcatctgctctgtctgtccatacatctgtctccttagctgctggctagagactctgtctcccgagcagaggtctgacaaatgttctaatgttctgccctccctgctcccctacaggcatcacgggcagttactcggtgtctgagtctcccttcttcagccccatccacctacactcaaacgtggcgtggacagtggaagatccagtggacagtgctcctcccgggcagagaaagaaggagcaatgggtgagtctggaacccgtctctgcagaggccaggctgaggtcagacagcccctattagggccacaggaagttcaagcaggactcaagcctgacctgggttcaagcactacccccacccctggccgtgcctcagtctcctgcagatgtcaggtagaagatgataaacttggtgtccttgtatctctgggcttctgcttggagaggccatataagctggggtctttgtccccatcaggaggtcatctccaggatcaaagaccaaaggaccaactctgcttggaggaggaggacactggcaatttgtcatcgtcaccagcattagtttctttttttttttttttttttgagacggagtctcactctgtcgcccaggctggagtgcagtagcacgatctcggctcactgcaacctccacctcccgggttgaagtgattctcctgcctcagcctcctgagtagctgggattacaggcgtgcaccaccacgcccggctaatttttttgtatttttagtagagacgtggtttcaccatgttagccaggctggtctcaaaccgatctcaagtgacctgcccacttgggcctcccaaagtgctgggattataggcatgagccactgcacctggccacagatatttacttctaagaaagagagagagagagagagaaggcaggagggagggagggatggagggaaggaaggaacaaagcgaggaaggaagggagggagggagagggagagacggagggatgtgtctgtcacacgctggctcggggcttccaatgaaccacacctttagcaccctggtggtctcacatgcccagggttaggcagctcatgaacccaggcttgactccaggacctacaggccacagagctttgccttaggggttttactttatgaattttgatgccttgttgttagacatgtaattgttcatgtatgtttatcctcttggatgagagctccttttgtcagtatgaaatattcctcacgtcacttttaatgacacgaggaatatttagtgccatgaggaatattatgtccttttttttttttttttttttttgagatggagtctcgctctgtcacccaggctggagtgcagtggcacgatcttggctcactgcaacctctgcctcccgggttcaagcgattctcctgcctcggcctcccgtgtagctggaattacaggtacgtgccaccactcctggctaaagggaggctgctagggaggctccatccgggaggtggaggttgcagtgagccgagatcgcaccaccgcactccagcctgggtgatagagcaagactcagacccaatataaataaataaattaattaattaaattaaataaatcatgaatgttggacagaggctgcactgaggggaacagcatgaggaacagcaagggggatggctgtgagtctgggtgatcgtgggacacgtgttgagaacactcagggcaggggatgccttccactcttccccaaatggtgacagagagggctgtgtgggagctctggtcggactctgcaccgggcagggcagaaaggcctgggctgacttgtgttcctttcctgtagtacgctggcatcaacccctcggacggtatcaactcagaggtgagtatgctcctgggcacgaagactcaagtctttcccccccacatctgtgcccctgcacacaggggccaacggaagccccttcctccaggtgtggggatcgtattgggtgtcttctcaattggtagtgtctgctcagggtggattttgctgtgatctgcttgtgatgtctgccatgggcatggattaggagaagagggttcacatgccacctctccaccacgtggtgaaggtttgtgaggttagaccccaaacaaaggcaatgttgctttttttttgtttttgtttttgtttttgtttttgagacagagtctcgctctgtcgcccaggctggagtgcagtggtgcgatctcggctcactgcaagctccgcctcccgggttcacgccattctcctgcctcagcctcccgagtagctgggactacaggcgcccaccaccacgcccggctattttttttttttgtatttttagtagagacggggtttcaccgtgttagccaggatggtctcgatctcctgacctcgtgatccacccgcctcggcctcccaaagtgctgggattacaggcgcgagccaccgcgcccggccaaggcaatgtttttttgggaggatggagtctcgctctgttgcccaggctggagtggagtggcttgacctcggctcactgcaacttccgcctttcaggttcaagcgattctcctgcctcagcctcccaagttgctgggattacaggcacccaccaccatgcccagctaatttttgtatttttagcagagatggggtttcaccatgttggccaggatggtctcgaactcctgacctcaggtaatcctcccgcctccacctcccaaagtgctgggattacaggtgtgagccaccgcacccagccaaaggcactttctttgaggaaggtatgcatctgagactattcaagccaagccccctcagtcggtttatggcacacgtgtgtggccctcctttttatttttatttttttttatttttacttttttgagacaggctctcactctgtcacccaggctggagtgctatgatgtggtcccagctcactgcaaccttgacctcctgggctcaagcaatcctcccacctcagcctcccaagtaggaacataggaatgtgccactgcacccagatagtttatttttatttatttatttatttatttttgtacaggcagagtctcactaggttgcccaggctggtctcgaattcctgcattcaagggatcctcccacctcagcacaccaaatttctgggattataggcatgagccactatcgcctgacccctctttgagctgaatccgaaatgccaaatacattggacaggcacggtggctcacgcctgtaatctcagcactttgggaggccgaggcgggaggatcatgaggtcaggagatcgagaccatggtgaaaccccatctctactaaaaatacaaaaaattagccaggcgccgtagcgggcctctgtagtcccagctactcaggaggctgaggcaggagaatggtgtgaacctgggaggcagagcttgcagtgagccaagatcgcgccactgcagtccagcctgggcaacaaagtgagactccatctcaaaaacaaacaaaaaagccaaatacagacatttttcctgccctggagctcagcatgagttagcatattctttgatcatattactaggagtagagggtctgaaacagaggaggggatcctactttacccccgttctaggcctctctaatgaattggcagttggaggagacatcttgggggtgtggtaggacctggatcgggggaattcatgcctcctttttgcaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcctgccttggtccctgcctggtccggacaaagtcccctgggcctccactctctgtttcattttcttggcgacattaggttccaccccgctaggccgtgagcctgtggggctgtcaggttcccatgggggggttgccagcatctgcatgcagtaggtgcttagctgatgcttgttgagtgactgacaattgatcatggagaggcaccttcagcaacaccaggcccggggcccaacctcaccagcccggctcctccagccccgtctcaccacgtccatcgcagtacccagggtgcttattaagcatttgctgaatccctcaccactctggtctcagaggaggccggagggtcattaattcggctccgcatgtataccaggctcacatccagggaagccagatcctactggtcagaggcgtgggcgctggacccaagtcctggctctgctgcctgctgtgtggccttgggtgggggggggtcctctcactgccccatgcctcagtttccctctgacacacagggataacgataggaccaggctcccgggcagtaggagttaatttacgtaaagctctcggcacatggggaccattgacgttggattcagtgcctgatggcaggggcgtgtcctcagacaccccccaaagcaggcctcggcccccaggctcccccaaccctgctgggagcagcgggtgttaattacacctaggccagtgtctcctccttggctgctcagtgtccgctgcgctgcctcagggaaaaccgcgcagccacgccgggcccaggcaggcagatgtggaaccgaaatagctgggcagtgggggctgtggggaccctggggaggcgggggaagggggctgaggggctacatctgggcagagcagagactgagggaggagggagagcccctgtcttcagggagaccccagtctgatggaggaggcatctgccttcacagagatcccaggctgatggaggaggcccctgcccccagggagaccccagtctgacggaggaggcatctacccacagaggggccacagtctgacggaggaggcctctgccctcagggagaccctatctgatggaggaggcatctgccctcgggggaccccagtctgatggaggaggcaggttatgtgaccatagagggaggctcagtggccatagttggtgacttctttcatgtcggggcaattctattccaaccccaagaaccaaacgtggggcctgcgggaagggagggcctcacacacagtcctgggtgagtcccatcagtttctccactgtctgccaccccatcttcccccgatgccccatgttctgtccctctgtccctgtgctctgaggatgtgtgagcctccactggctactataacaaatcaccacccacctaatgacttaaaacagcagacatggttgggcgcagtggctcacgcctgtaatcccaacactttgggaggccgaggcgggcagatcacctgaggtcaggagttcgagaccagcttgaccaacatggtgaaagtccgtctctactaaaaatacaaaaaattagctgggcctggtggcaaatgccagtaatcccagctacttgggaggctgaggcaggagaatcacttgaactggggaggtggagattgcagtgagccaagatcgtgctattgcactccagcctgggtgacagagtgagactctgtctcaaaaaaaaaaggcaatctctccctgtctctctcaggctcaccttcctgcctcctctcgtgagggccctatgaggacactgggcctccatgtcacccaggatgttctcctgtctcacggtccattactcagtcccatctgcaggtgcttctgccacgagaggtgacacggccacaggtcccggggattaggaaagggatgtctttggggccattgttctgcccaccagaggatctcgacatcccccttctccgtgactcttcagtcacctctgctcagggccggccaggactgttgcacaggctgtgccctgcacaagccccctgccaagaccaaagggcaaggctctgtgtgcggccagggtccccgtcttcagtgtccctggccctggctgtggcctgttgccagacaccgcgtcaccaaggggtgcattattcccacatcatcccagttggacggtcacctcaccctgcccatcgtcctgccagcaagatggtcccacagcggcctcagttctcagaggctcggcagggtctcccctgaccccgtaatgcccctcactgcccctgggcgctgggttcaagaagaaccgcctgcttcgttgcaggaagtgatgtccacccccaactctggatcggaagccacgatctatcctccagacccaacaccaggtccccagccctttatctctcctgtctgtctgtccatttctggtgttcaggcctctctctccacgtctatctccctgtttctgtccctcctgacctctctctttttccatgatttttgctttcctccctccccgtctcatcctaaatttgtttttttgtattttgttttttttttgagacgaagtctcgctctgtcgcccaggctggagtgcagtgacgccatctcagctcactgcaagctccgcctcccgggttcaagggattctcccacctcagcctcccgagtagctgggattacaggtgcccgccaccacgcccggctaatttttgtatttttagtagagacggggtttctccatgttgggcaggctggtctcaaacccctgacctcaggtgatccgcccgcctcggcctcccaaattactgggattatgggcgtgagccaccacgcccggccctcatcctaaattcttaaaacctgctctcctctcagccatgattttctttgtcctgtgccataaagaattctcagaagcaggatgcagcttctgctgctcaagggtgagcccagccagtgggatctggtgtcgctgcccgcagacccctcagtcaagagcggggtggggggcagcaggagctacagtaacagcccggatggtcctgctcctgaaggcaccccaccctgctgtccagaggagagaccgaggctcagacatttgagccccacataacccagcctgccacacaccgcagactccaacagtgtagcccctgtaccccagaagtcacttcagcaaatcactcagggctccacctcacatctgtccccaagtccttggggacttgctcactcagcagaagaccaagagaagccagatgcagtggctcacacctgtaatcccaacactttgggaggctgaagcgggcggatcacctgaggtcaggagtttgagaccagcctggccaacatggtgaaaccccgtctctactaaaaatacaaaaaatagtcaggtgtggtggtgggcgcctgtaatcccagctacccgggaggccgaggcaggagaatcctttgaacccaggaggtggaggttgcactgagccaagattgtgccactgcactccggcctgggcgacagaacaaggctccgtcctaaagaattaattaattaatttaaaaataaaaagaaaatgtgcactttcatcttgtattattctgtccttttgtttgtttgagataaagtttcgctccatttgcccaggctggagtgcgtgatctcggctcaccgaaacctctgcctcctgaattccagtgattctcctgcctcagcctctcgagtagctgggattacaggcccacgcccccaccatacccagctaattttgtacttttagtagagacagggtttctccatattggccaggctggtctcgaactcctgactccaggtgatccacttgcctcagcctcccaaagtgctgggattacaggcgtgagccacctcgcccggcctattctgtcctgtttttttaagatttagtttgccgggcacagtcactcacacctgtaatcccaccattttgggaggccgaggcgggcggatcacaaggtcaggagatcgagaccagcctggccaatgtggtgaaaccctgtctctactaaaaatacaaaaattagccgggcgcagtggtgcgcacctgtaatcccaattactcgggaggctgaggcaggagaatcgcttgaacccgagaggcggaggttgcagtgagccaagatcgcgccacggcactccagcctgggcgacagagcaagactgtgctcaaaaaaaaagatttagtttaattcctgtaatgagtcagccccttggaaaatcagacagaattctgcctgctgagcagacacattccagaagttactctgtgagaggtttagacgaattcctagtgaaatttccaggggcgggagagcgtgtctggaaggtctgcggacatcacagcaatcacagaggcctttggggcgggcaaaactgtccgctggcgctcgctgctagcaggagggagttcatattctttcctggtttcctcctggctcagtgtatcatgatatgccagggaaaggaggagaattctcttttttgtttgtttggttttttgagacagagtctcacgctgttgcccaggctggagtgcagcggcgcaatctcagctcaccacaacctctgcctcctgggttcaagcgattctcctgcctcaacccccggagtaactgggattacaggcacccaccaccacgcctggctaatttttgtatttttagtagagacggggtttctccatgttgggcaggatggtctggaactccagacctcagatgatccacccgcctcagcctcccaaagtgctggggttacaggcgtgagacactgcacctggcctcaactccattttaattaaccctgcaggggccaggcatggtagctcatgcctgtaatcctggcattttgggaagctgaggcaggaggtggatcacctgaggtcaggagtttgagaccagcgtgaccaacatggtgaaaccctgtctctaggaaatacaaaaaattagctgggcgtggtggcaggtgtctgtaatcccagctactcgggaggctgaggcaggagaatcacttgaacccaggaggcaaagatcgtggtaagccgagatcgcaccattgcactccaggctgggcaacaagagcgagactccatctcaaaaaataaaaataaataaataaaaaataaataaaaataaaaaaaattagccaggcgtggtagcgcgtgcctagtcccagctactcaggaggctgagacacgagaatcacttaaacccgggagatggaggttgcagtgagctgagatcgcgccactacactccggcctgggcaacagagcaagacttcgtctcaaaaataaataaataaataaataaataaaataaagagatttaggagaggacacaagcaaacataactcagactgactttggcaaaactaggctttatgggttcccgtaactgaaacatcaatgtagggccagcttcaggctcagctggttccaggtgccacacagcatcctcaggttccttcggtgttgggagctcaggctccaagcccaggacagattcccagctctgccacatgcccctgagggaccctgggcaaggcctacccctctcccagcctcagtgtccttatctgtaagtgaagtcgccacattgacatccctgccctgggggacgtcatgagggtcaccgggcacctggtgaaaatcagtgaggaataagaatgaatgttgaggccaggtgcggtggctcacgcctgtaatcccagcactctgggaggccgaggcgggcggatcacgaggtcaggagatcaagaccatcctggctaacatggtgaaactccgtctctactaaaaatacaaacaattagccgggcgtggtggtgggcgcctgtaatcccagctactcgggaggctgacgcaggagagtggggtgaacccaggaggtggagcttgcagtgagccgagatcgcgccactgcactccagcctgggcgacagagcgagactccgtctcaaaaaaaaaaaaaaaaaaaaaaaagaatgaatgttggttctgaccaagtaaattaacgaattgtcaccagacaatgacttccatgtgactttctggtgtgagccggagaggagccgatgcacgctgccaccagagggcggcaaacaccaaggatgcagccgcggccctcgccccgccagggagaaaacgcacctgccgccactctcaccttctcattcccgtaaccggatggtgtttgcttagtgctccttgaaagcctggacagggccgggcgcggtggctcacgcctgtaatcccagcacttcgggaggccaagacgggtggatcacttgaggtcaggagttcaagaccagcctggccaacgtggcaaaaccccgtctctacttaaaaaaaaaaaaaaaaatagccgggtgtgatggcgttcacctgtaatcccagctactcaggaagctgaggcaggagaattgcttgaacctgggaggtggaggttgcagtgagctgagattgagccattgcactccagcctgggtgacagaggaagactccatctaaaaaaaaaaattatttgtagagatgacagagtgagactccatctaaaaaaaaattatttgtagagatggggttctcaccatgtttcccaagctggtcttgaactcctcaagtgatcctcctgcctcatccccacaaagtgctgggattactggtgtgagccatcgagcccagccctgaccaactatttagaggttgaaaacagagcccgcagggccgggcgcggtggctcacacctgtaatcccagcactttgggaggccgaggccctcggatcacgaggtcaggagattgagaccatcctggctaacaaggtgaaaccctgtctctactaaaaatacaaaaaaattagccgggtgtggtggggggcacctgtagtcccagctactcaggaggctgaggcaggagaatcacttgaacctgggaggaggcggagcttgcagtgagccgagatcgagccactgcactccagcctgggcgacagagtgagactccgtctcaaaaataaaaataaaaataaataaataaaattagccggaagtggccgagtgcggtggctcttccacagcagccagagggcgcctgtgaggctgactgggggtgtccctgctctgcccacagccctccatggctcccatttccctctgggtagaagcccaagtcctccgtgcagcccacaaggctctgcccagtcccctctctcctctccctcctctgtctactctccctcctccctgtctccccctcctcctctgcccagtcccctctctcctctccctcctccctctctcctctccctcctccctccctatctccccctcctcctctacccagtcccctctctcctctccctcctccctatctccccctcctcctctacccagtcccctctctcctctccctcctccctttctccccctcctcctctacccagtcccctctctcctctccctcctccctgtctccccctcctcctctgcccagtcccctctcctctccttcctccctgtctccccctccctcctccctgtctccccctcctcctctgcccagtcccctctctcctctccctcctccctgtctctccctcctcctctgcccagtcccctctcctctccttcctccctgtctccccctccctcctccctgtctccccctcctcctctgcccagtcccctctctcctctccctcttccctgtctccccctctgcccagtcccctctctcctctccctcctccctgtctccccctcctctgcccagtcccctctctactctccctcctccctgtctccccccttcctctgctccagccacacgggcctcctccctgttcctccaacttgccaggcggggtcctgccccagggcctttgcctccccaggtgaggtccggccccagggcctttgcacggccatgtcctctgcctggtttcccttccctaggtacccactgggttcatttcttcacttctttcaaggctttggtgaacgctcccctcatcacacagctgttgctcagtaaatatggcagaataaatagctgggcagggctcagtggctcatgcctgtgatcctagcacttctggaggctgaggcaggaggctcacttgagctcaggagttggagactagcctggccaacgtagagagactccatctctacttagggtgaccaggggagagaacaaaatcatgggctcattttttttttttttttgaaatggagtcttgctctgtcgcacaggctagagtgcagtggtgagatctcggctcactgcaacctccacctcctgggttcaagcaattctcctgcttcagcctcctgagtagctgggattacaggcacatgccaccacacccggctaattttgtatttttagtagagacagagtttcgccatgttggccagggtggtctcgaactcctgactgcaggtgatctgcccgcctcaccctcccaaagtgctgggattacaggtgtgagtcactgcacccagcaaaaaatgtttattattcccatttcacagaccagcaaactgaggcccagagggagccgcctgaggaaactggattgcgcagctgatggagtctcaaccagagaaggggcccgtggggcctagattcagacttccggctgtgcaggcaagcaggagggccccccagtcagggtccccaggacaccaaccccaagccaaatgaggccaccagaggctgtgcccagccccagtcccgcacggggcaggtgtggagcaaatgctggcgggatagagggatggagaagggggctgcctgggagtgaggggctgggtgccccacccacctggcctcagcctcctgccctatccgagaacagagctctggtttcctgcccggcagcccgtgaggagcagcgaggcatggccagctgggggccggacagtcctgaagagcttgaggactggctcctggctcctaaagcatagcgccggctctggggatctgccagggagagaccagctccagggcccctggatgcaggttagagctcaggctgtcccctgatggcctcggtgctatgggtgagtttctccacctctctgtgctcagcctctcaccggagagggggtgggtgatcctggcctgagtaggtgaccaaggcatcctcctctgtggctggtatttcccaacaccctcaataaattcacaggtggctcaggcctgtaatcccagcactttgggaggccaaggcaggcagatcacctgaggtgagcagtttgagaccagcctggccaacatggtgaaaccttgtctctactaaaaatacaaaaattagggccgggtgccatggcacatgcctgtagtcccagctactcgggaggctgaggcaggagaatcgcttgaacccgggaggcggaggttgcagtgagccaagattgtaccacttcactccagcctcagcaataagagcaaaactccatctcaaaacaaaataaaaaataagggcgcagtggctcatgcctgtaatcccaacactttgggaggccaaggcaggcggatcacaaggtcaggagattgagaccatcctgaccaacatggtgaaacctcgtctctactaaaatacaaaaaattagctgggcatggtgacgggcgcctgtaatcccagctactcaggaggctgaggcaggggaatcgcttgaacctgggaggcagaggttgcagtgagccgagatcctgccactgcactccagcctgggtgacagagcgagactccatctcaaaaaaaaaaaaaaaaacaaaaacaaattggtttgtttattttcctgttgatttgtgggagttctttatatattctggacctgagtccttgattacattatgcactgctagctagtaccttctcccagtctggcactttccttttgagtcttcttctttttttttttttttttttttttttctgaggcgcctgccaccacacccggctaatttttgtatttttagtagatacggggtttcaccatgttggccaggctggtcttgaactcctgacctcatgatccacccgcctcggcctcccaaagtgctgggattacaggcatgagccacagtgcctggccccttttgagtctcttaatggtgtctttggacaaactcatttgttcaaaataaaatgcaatttttttttttttagatggagtctcactctatcacccaggttagaatgcagtgggacaatctctcccaggctcaagcgtctcttctgcctcggcctcctgagtagctgggattacaggtgggtgccaccacgcccagctaattttgtgtatgtttagtagagaccaggtttcaccatgttggccaggctggtcttgaactcctaacttcgagatccgcctgccttggcatcccaaagttctgggattacaggcatgagccactgtgcctggccatgttaggatatttctttttttcttttcttttcttttctttttttttttttttgagagtctcgctctgtcacccaggctggagtgcagcggagccatctcggctcactacaagctccgcctcccaggttcatgccatctcctgcctcagcctcccaagtagctggaattacaggtgcccaccaccacgcccagctaattttttgtatttttagtagagacggggtttcaccgtgttacccaggatggtcttgatctcctgacctcatgatccgcccgccttggtcccctaaagtgctgggattacaggcgtgagccaccgcgcccggcccatgttaggatatttctgagcaaatctgagggtttggcctggaaccctcaatttgaggttgcaaaccctgtttcctgctaagccagacagatggtgctggagatggggaggccatggtttatgttttgtccactctgggtgctgcctggacaggtgactcatgcatgtggcggagcagtccagagtgaggactgtacccctacagacactcccccagaccatgctggtggcctgagctgggggctgcccaagtcccctccccgggatccacttctggggcctcccaagccttccctggggtcagtgagtgctggaagggcagccagcagtgtgtgtccacgggggggggcgggtcaccacttatctgggcattaaatatttgggggggtctcaaaataatggaaaacagggggccagaagtggtggctcatgcctgtaatcccaacactttgggaggccgcagtgggaagatcgcctgaggtaaggagttcaagatcagcctgggaaacatagcaaaaccctgtaatgaaaaacccaaaaattagcccggcgtggtggcaggtgcctgtgatcccagctactcgggaggccgaggcgggaggactgtttgagcccaggaggttgaggctgcagtgagctatgattgcaccactgctctccagcctggacaacagaacgacccactttctcaaataaataaataaataaatacgctgaggccaggcgcggtggctcacgcctgtcatcccagcactttgggaggccgaggtgggcggatcacgaggtcaggagattgagaccatcctggctaacatggtgaaacccccgtctctactaaaaatacaaaaattagccaggcgtggttgcgggcacctgtagtcccagctactcgggaggctgaggctggagaatctcttgaacccgggaggctaaggttgcagtgagcccgagatcacaccactgcactccagcctgggtgacagagtgagactctgcctcaaaataaataaataaataaatattaaaataaatagggccgggcacggtggctcacacctgtaatcccggcactttgggaggctgaggcaggtggatcacgaggtcaggagatcgagaccatcctggctaacatggtgaaaccccgtctctactaaaaatacaaaaaattagccaggcgtggtggcgggcgcctgtagtcccagctactcgggaggctgaggcaggagaatggtgtgaacccgggaggcggagcttgcagtgagccgagatcgcgccactgccctgcagcctgggggacacagcgagactccgtctcaaaataaataaataaataaataaataaataaaaataaaataaaataaaataaattaattaattaaaatagagatgagatctgcctctgccgcccaggctggagtgcagtggcgtgatcatagctcaccgcagcttccaactcccgggctccagcaatcacaggacaaacctcccgcccggccctgcagccaggtgctcacaccagccctatttataacaggaatccatggaaatttctggccccaccaagctgctgtcatgaataagtcatcgtccggatcaatgattccacccagggagcatctgcaagtttccacctcgttctccctgggccccggacagcctggctgggacgtcagagctaccagtcaggctgcggaaacagcctgggggttcctctgtgaccaaaccattccacgccgtggtctctacccagagaaaggaaaacacaggtccatacgcgtgttcgaggcggcatgattcataacgaacaaaaggagaagacaggccgggcgcagtgcttcatgcctgtgatcccagcactttgggaggccgaggcgggtggatcacgaggtcaggagatcgagaccagcctggccaacatggtcaaaccccatctctactaaaaatacaaaagttagccgggcatggtggcaggtgcctgtaatcccagctactcgggaggctgaagcaggagaattgctctagccagaagggtggaggttgcagtgagccaagattgtgctgctgcactcagcctgggagtcagagcgagcaagactccgtctttaaaaaaaaaaaaaaaaagaaaaattcagccgggcgcggtggctcacacctgtaatcccagcactttgggaggctgaggcgggtggatcacaaggtcaggagttcgagaccatcctggctaacacggtgaaaccccgtctctactaaaaatacaaaaacttagccagtcgtggtggcgggtgcctgtagtcccagctactcgggaggctgaggcaggagaatggcgtgaacccaggaggcagagtttgcagtgagctgagattgcaccactgcactccagcctgggcaacagagcgagactctgtctcaaaaaagtaaaaaaaaaataaaatagatgtatataaaatatataaataaatatatataaatatatatataaatatattttttcttttttttttggatggagttttgctcttgtagcccaggctgggtgcaatggcgtgatctcggctcactgcaacctctgtctctcgggttcaagcaattctcctgcctcagcctcccaagtagctgggactacaggcgcccgccaccacacccagctaatttttatatttttagtagagacggggtttcaccgtgttagccaggatggtctcgatcttctgaccttgtgatccaccctcctcgacctcccaaagtgctgggattacaggcgtgagccaccgcgcccggcctattttttaaaagattatggatttagggcacctcctcccttctccttttagccccagataacattccattctcgatgtttatctgctcgcctgccgaaggacgttttggtggcttccagggctgggctgttatgaatagcagagctgcaggccgggggcggtggctcacgcctgtaatcccagcagttcaggaggccaaggtgggagggttgcttgaggccaggcaatcgagaccagcttgggcaacacagcaagaccccaatctctaaaaaacatacaaaaattagccaggcatgatggtgcacacctgtggtcccaatggttccagccactcaggaggctgaggtgggagaatcacttgagcccaggaggtcgaggctgcagtgggctatgactgcaccattgcacctcagcctggacaggaggacaagaccttgtctcaaaaaaaaattttttttttgagagggagtctcactctgtcacccagggtagagtgcaatggtgagatctcggctcactgcaacctccacctcccgggttcaagcgatcctcctgcttcagcctccagggtatctgggattacaggcgcctgccaccacgcccagctaatttttgtatttttagtagagatagggttttgccatgttggccaggctggtctcaaactcctgacctcaagtgatctgcctgcctcagcctctcaaagtgccgggattacaggcgtgagccaccatgcccagccaaaaaaaaattttttttttaaataataaaatagaggctgggagtggtggctcacgcctgtaatcccagcactttgggatcacctgaggtcaagagttcgagaccatcctggccaacatggcaaaaccctgtctctgctaaaaacacaaaaattagctgggcgtggtggcttgtgcctgtaatctcagctacttgggaggctgaggcaggagaagcgcttgaacccaggagccggaggttgcagtgagtcgagattgtgccactgtgctccagcctgggcaacagagcgagagttcgaatcaaaacaaacaaaaaaagccacaggcggccacacatagaccgtcactgacctcctggagcttctcttctcagggaaaggaacttccagactcagaaaactggggcaggaaacatccaggccagtttttccagcccaccggatctcaggcagcttccaggaggattgcctgaactcgctgaaattgcccaattccctcctgggcacatggttttcagatgatgaacacacaccctgcaccggggctgaggcctcaccctggcgtttgaatcctgggccccgggtttagtccacaggaggagaagccacactggctgctgggagggaatgggaagcgggcagccgccgtggaaaacatggatcagtgcttcagaaagccagacagcggcgccgtctaaccccaccgtgcggctccgaggaatccaccccagataaccgaacacagcggctctcaataaacatgttcacagcagcatgagccacgggagccaggggtggacggaaacagtggcacgagccacaggagccaggcgtggaaggaaacagtggcacgagttacgagagccaagcgtggaaggaaacagcagcatgattcacgggagccaggcatggacggagtccacaggagccaggcgtggaaggaaacagtggcacgattcacgggagccaggcgtggatggaaacggagaggagcagagagcaaggctctgacgccagccacagcgcagatgcaccctgaggatgtagggctcagacggatgcccgacacgaaaggccacacagcgtgtgatcccatttccatgaaatgtccagggccaggcgtggtggctcacgcctgtgatcccagcactttgggaggccgagccggcggatcacgaggtcaggagatcgagaccatcctggctaacatggcaaaaccccgtccctactaaaaatacaaaaattagccgggtgtggtggcgggcgcctgtagtcgcagctactcaggaggctgaggcaggagaatggtgtgaacccaggaggcgcagcttgcagtgagccgagatcgcgccactggattctagcctgggcgacagagcgagactccatctcagaaaaaaaaaaaagaaaagaaaagaaaaaggaaaaacagaattaagcattgtagtgaataattcagtgggatttggtgccttcacggtgctgtgctgctgtcacctctaattccaggatattcccatcatcctttgtggttggggcatcatctgtcactccccatcccctccccatccctgagaatccatgcatccccttcctgtctctgtggcttggtctgtctgtcctggacatttctttttttctttttgttgttgttgttggttttgtttgtttgtttgttgtttgtgggttttttttgagacggagtctcgctctgtcgcccaggctggagtgcagtggcacgatctcagctcactgcaagctccacctcccgggttcacgccattctcctgcctcagcctcccgagtagctgggactacaggcgcccgccaccacacccggctaattttttgtatttttagtagagatggggtttcgccgtgttagccaggatagtcttgatctcctgacctcgtgatcagcctgcctcggcctcccaaagtgctgggattacaggtgtgagccactgcgcccagcctagccttttatttttaatagagatggggtcttgctatgttgccacgctggaatttttttttttgaggtctctctgtgttgcccaggctggagtgcagcggcacgatcttgacccaccaaaacttctgcctccctgcttcaagcgattctcccacctcagcctctggagtagctgggattacaggtgcccgccaccacacccggctaattttgtatttttagtagagatggggtttcatcatgttggtcggggtggtcttgaactcctgacctcaagtgatccgcccgcctcgccctcccaaagtgctgggatgacaggcgtgagccaccgtgcccggctgcccacactggaattctatgttataggaacttcatctcactgaaagaaaaaggggactcctggatgggtcctgaatttagacatttatttgttcatgaaacaaacgctgatggggccgttgcacacccaggtctgcactggccgccctgtggggccccggaggggcgggggcagggagaggccgcctgagaggcagtggcccgggtggaggacccagggctgggcctggcgatgctccgactgcagcttccggagaacaatctcaggtccacaatgtggagacgttggcagatgctcctgctgaggaccgacagacatcatccccgcttcatcctgctttttcctcccatgaggaggtcaaagtcacaccgtggggccaggcccggtggctcatgcctgtaatctcagtactttgggaggccaaggtgggcagactgcctggacccaggagttcaagaccagcctgggcaacatggtgaaatcccatctctactaaaatacagaaaattagctgggcgtggctgggcatggtggttcacgcctgttatcccagcactttgggaggctgaggcgggcggatcatgaggtcaggagatcgagaccatcctggctaacagggtgaaaccccgtctctactaaaaaatacaaaaaaaaaaattagctgggcgtggtggcaggcgcctgtggtcccagctactcaggaggctgaggcaggagaatggcctgaacccgagaggcggagtttgcagtgagctgagatcacgccactgcactccagcctgggcgaaagagtgaaactccgtctcaaaaaataaaaagaaaagaaaagaaaagaaaagaaaattaggccggtgtggtggcacacacctgtagtcccagctgctcgggaggctgaggcaagagaatcgcttgaacccgggaggcgagggttgcagtgagccgagatcgcgccactgcaagactccgtctcagaaaaacaaagtcgcacaggagagtcacgtccaccccctgggccaccggacagtcgccacagaccaggcagctgaatccccgctctacagacaaccccatcaaggctggggcagtgagacgctctgaaggccacaggcccccaggatcccaccccgtccgtctctccctccctgctgtccctctgtgagccacaccctgcggctgtcagcggcagtgatgggggctgcaggggctggggacagagggggatgagtttccagccaggcggcctgggagggtagctttaatccccacctcggttttgtcttagaagcagttgcatggctgtgctccaggccgtccagggttcaggctgagccaccgtctaggtctagacgtcagtgtccatcaggacctggcgtgccctgcaagcagacatgtgctccttcgacctccgtcaaccctggagatgaagcagggaaggggccctggctggaggcttggacatccatccggaggggcggagtggcctcgaggcggtgtgtgagtccccggggaagatgcaggggacgctgggtggccggtggcacgagtgaggctcggggtcccgcagccccccgtggtgtgggtgcctgagttggggggtcctcgaggaggacaagggagggaactgaagggggccaggacacccggtagcttggctgccgggggctctgtgatatgctaagtccctcctgctcaccactaaacccaagaggaaaaggaattcctggcagagtccaatttaaagtcaacaaacaaacaatgtgggaaggagagaaggaatcccaggaatgtgggcgaggtcctcctcccgccggggccaccctggacccggcgagaaatcgaaggtcccccaaggacccacgtccaggagccaacagcctctctgtgcaaaccagacaaccctgcaggaactgtgcttgaagaaaccgtggaaactgcccccaaccctcccgtctctatttctttctctgttttattatctcattcttggctgtgaggtaaacaggagaaaatgagaaggtggttctggaggacccgaccgaatttgctttcgtgacagggtcaagcgccctttcctcgccggccgcagccctcaccaaaggggatttgggggcctccggacaggggtcctgaaggttttgaattgttcaatctctgggggtacaggaacccctgcaggaggtttcaaaggcaagagtttcgcagagagaaaaaaaccatgaactttgcaggttggtggcggaatctggtgatttaagaaaacgtgtttaagcctcggccgggccgcgcctgggctgtctgcggtgctcttccggaattctctacaatatctggaagtgaccaagaaaattccagaacccggaggctgcgccgtggagataaacatgggcacctgggtatgtttgtttttattgttaggacctattttatcacaagcaaaaaaaaggaagctgcccagaaatccaggggtgatggatagaaggcgatggggcctgcagtggcccaacggattctagaattttcctctaggaagatgcccgggaattttaaccctgttggctcgacccagaagctcggggtggcagggaaaggatcactgtggccttccttccttccttccttccttcctggaatttcgctctgttgcccaggctggagcgcagtgacgtaatcatagtttgctgcggccctgaccccaatggcacaaatgagcctcctgcctcaatctcctaagtagctgggactacaggcatatgccactacgcccggctaaattttttttttttttttttttgagacagagtttccctcttgtcgcccaggctggagtgcagtgtcgcaacttcggctcaccacaacctccgcctcccaggtggaagcgattctcctgcctcagcctcccaagtagctgggattacaggcatgagccaccacgtctggctaatttttgcatttttagtagagacggggtttcgccatgttagccaggctggtctcgaactcctgaccttgtgatccacccacctcggcctcccaaagtgctgggattacaggcgtgagccactgcgcccggcccattgtttatttatttatttttgtagagacagggtctcgctgtgtcacccaggctggagtgcagtggcaagatcacatcccactgcagcctcgacctcctgggctcaagtgatcctcctgcctcagcctcctgagtagctgggaccacaggcatacgccagcacgcccagctaattaaaaaaaaaaaaaaaaaactttagcagccaggcacggtggctcactcttgtaatcccagcaatttgggaagctgaggcggacagatcactagaggtcaggagtttgagactatccctgtctctactaaaaatacaaaaattagccaggtgtggtggcgcacatgtaatcccagctactccggaggctgaggcaggacaatcacttgaacccgggaagcagaggttgcagtgaggtgagatcgtgcccctgggcgacagagggagaatccatctcaaaaaaaaaaaaaaaaaatttccggatggggtctcgccacgttgcccaggctggtcttgaactcctgagctcaagtgattctctcacctcgacatcccaggttggtggattacaggcgtgagccacagtgcctggccctggcttttcttcttgtttgtcaggctctgctgttgtgataggaaggcttgaggacttcaaaggggcggctggtgtgcggggttggggacgatggcagggacaggagggaggtgctgttggcatgtgtggaatgtggcattggcgctggatggacgggtctgtgtgcgctgactgcgtgtccgatgccagggcctgtgttccccctgcacgtccccaggaaggaactgctggaccagcagaatgaggggccaacgccaggggcagcactgcccggccacagaggactgtggccccacagatgacaccctcagctaccagctcctgcatctggaagatgaccaggaggaggaaggacggtctgcaagtgttcaaagtgatgtttccaggccgggcgcgcttgtaataccagcatttgggaggctgaggcaggcggatcacctgaggtcgggagttcgagaccagcctgaccaacgtggagaaaccccgtctctactaaaaatacaaaattagccaggcgtggtggcgcagctactcgggaggctgaggcaggagaatcgcttgaacccgggaggcggaggttgcggtgagctgagattgtgccattgcactccagcctgggcaacaagagtgaaactccgtctgaaaaaaaaaaaacctctataacatccaaaatactaaccacttgttacctctagattgtttggggatgttagatttctcctttgttgccagctcttttatttttatttatttatttattattattattattattattattattattattattttgagatggagtcttgttctgttgcccaggatggagtgcagtggtgtgatctcggctcactgcaacctccgcctcctgggtttgagcaattctcctgcctcagcctcccgagtagctgggactacacgcgtgtgccaccacgccaggctaatttttgtatttttagtagagacggggttttgccatgttggccaggatggtcaggaactccccaactcttatttttaaatgttgggccacacaagtctgggaaatgttagttttcaaacacatcagggaataaatggatacaaaagtcttgaggaccacttaagaaatgaacaatagcagatgtgtaacagttatactacgctgctaccttgtaaaacattttagaaacatctgtttccagccgggcctggtggctcacgcctgtgataccagcactttgggaggctgaggtgggcagatcatgaggtcaggagttcgagaccagcctggccaacctagtgaaccctcatctctactaaaactacaaaaaattagccaggtgtggtggcgggcgcctgtaatcccagctacttgggaggctgaggcaggagaatcgcttgaacctgggaggcggaggttgcagtgagccaagattgcaccactgctctccagcctggcaacaaaggaagactccatctcaaaaaaaaaaaagaataaaaagaatacaaaaagaaaaaaaaaacatctgtatcatccttgtagattctggggtttggaaacaggctttgaaaaaagtcctgaaacaggccgggcgccgtggctcacacctgtaatcccagcacttctggaggccgaggcgggcggatcatgaggtcaggagatcgagaccatcctggctaacacggtgaaaccccgtctctactaaaaatacaaaaaaattagccgggcgtggtggtgggcacctgtagtcccagctactcgggaggctgaggcaggagaatggcctgaacctgggaggtggagcttgcagtgagccgagatcgcgccactgcactccagcctgggcgacagagcgagactctgtctcagaaaagaaaagaaaagaagagaagagaagaaaagaaaaaatcctgaagcaaatggagcaaattttgaacagcttgaatacctgagacaggccaggggtgcggggcaggctcattttatattcttcacggttgtgtgaatttcttgcaattatatgtagcaattttttcaccaggatttagtatattagcatgtttcgggctgggcacggtggctcacgcctgtaatcccaacactttgggaggccgaggcaggtggatcactaggtcaggagtttgagaccatcctggccaacatggagacacctcatctctactaaaaatacaaaaattatctgggcgtggcggtgggcgcctgtaatcccagctacttgtgaggctgaagcaggagaatcgcttgaactcgggaagcggaggttgcagtgagctgaaatcgcaccactgcactccagcctgggcaacagggcgagattccgtctcaaaaaaaaaagaagcatgtttcctagcaagccaattcagaataaaaagaaaacaaaggagaaaatataatcccaataaaatatattgaaataaatatgtacacacatatatatatgtgagtttatgctttgttttgttttgttttctggaagacggagtctcgctctgtcacccagactggagtgcaatggcgtgatctcagctcactgcaacctctgcctccctggttcaagggattctcttgcctcagcctcccgagtagctggcattataggtaccaccacgcccggctaatttttgtatttttagtagagacggggtttcaccatgttgtccaggctggtctcaaactcctgacctcaagtgatcctcccgcctctgctatttatttattctgggttttttttattcttttttgttgttgttttcattttatctttcttttcctatttatttagagacagggtttcgccatgttgcccaggctggtctgaactcccggactcaagccatctgcccatgccggcctcccagtgtgctgggattacaggaggaagccactgtgaccagcctgaaagtgttcatttttaaatttttaatagagatggggtctcactatgtcacccaggctggtccgaaactcctgggctcaaaccatccgcccacctcggcctcccaaagtgctgggatcacaggtgggagccacgcgcccggccccaaagccctccttgcacaagcacctgagccgccatggcccacaggcccatcaaaaccagagcaaactggtacctgtgatacagcctccactccagccccagggcccagccccaggccacccgagccggctgtgggtgacctgagaccaagtgtcgtttcctgctataaactattgatgcctgagcagtcacctccaggagctccgggcttggctacggtgtcctgggttccctgtaatgaagcccggggcagctgcggcctggagggcgtctgctccgcctccatcctgggcccgcctggggctcttttccttctaggcctggttccctccaaaattagcttcctatcgggatcccacatcccctcacaatggaggcctgacctctggggagacacaatgtcagggtcactgtgaggtttttatttatgtacttttatttttatttatttgataccgagtctcactgtgttgtccaggctggactgcattagtgtgatcctggctcactgcaacctctgcctctcgggctcaagcgattctcctgcctcagcctcccaagtagctgggattacaggcacccaccaccacgcccgggtaatttttttgtatttttagtagagacggggtttcaccgtgttcgccaggatggtctcggtctcctgacctcgtgatctgcccgcctcagcctcccaaagtgctgggatgacaggcgtgaaccaccgcgcccggcctcgatttactcattttttttgagagagagagagagtctcactctgtcacccaggctggagtgcagtggcgtgatctcagctcactgcaacctccgcctcttgggttcaaataataattctcctgcctcagcctcccgagtagctgggattacatgtgtatgctaccacacccagctaatttttatatctttggtagagacaggcttttgccctgttggccaggctggtctcgaactcctgacctcagggcatccacccgcctcagtcacccaacgtgctgggatcacaggcgtgagccaccgcgcctggcctgactttattattgttttacaaagagcagaccttccacctgccatggataaaacgccgagttctagaggacactggagacagagtgttccccagaacaaggcctgggcgcagcagcctgcagggctggggtctccactcccgggggagcgtgcagcggggcctgccatccctctgtgcccccgccccacccccactctgcaggccgctgaccctgtggtcgggctggtgagcagatggctgctggatcactgacagcccggctcacgttccctctccctatggagacatcttccttttaataaattttgcaaggccgtggaggggggccagcgctctggcccacgtctgtctcccatccccatcaccacacgaggccccagcacgcctggctggcctaagtccccgcaggatgaatgggcttccggggcctgctgggaccaggtaagcaggctgtgcggcttaaaacaacacaaatacactctcgtctctggaggccggaagtctgaagtgaaggtgtgcaaggtgccaggcgagtaccctcccggcctcttccagctcctggtgccgacagccacctctgaccctcctggacttgcggccgcttccctcccaattctgcctctgctgccccacggcggtctcctctgcatctgtgtccaaatttcccttgtctcccgaagtcgcctgtcactgcggtggtgcccgccctaatgatctcatcctaactaattacatctgcagaaaccctatttccacataaggtcccatttgtaggtgcctggggttcacgcaaagacagatctttgagggaactcaattcaccccaccccggggagtttgcctttgtggccggcccttccccctcagatcaaattctgcctcctcagcgaggccttcctgaccctcccgggcccttcctgcctttctctctggctgcggctgtttcctgcggggctggctgcagctcccggcggcgccctgtcctgtacctgtttcatgtccatcgtcggcaacccctggcttctaacacagctcattgcccgcaggacctcccagcaggagcagggacccagtaggccctgcgtctccgtccgaaccacaagctgctgtgggtggtcacttgacagaaagacccctgcccccccttccttatttgtttatttgctttttctgttgctttagagactggattttgccctgtcatccaggctggagtgcagtggcgaaatctcggttcactgcagcctccatctcctgggctctggtgagactacggccttagcctcctgaatagctgagaccacaggcgtgcaccaccacgcccagctgattctttgacttttgtttatacagggttttgccatgttgcccagggtggtttcaaagtcctggcctcaagcaatcctcgtgcctcgccctcccgaagtgatgggattataggcatgaacaactacccacttcactccatcctttcctttttttttttttttgagacagagtcttactctgtcaccaggctggagtgcaatggtgcgatctcagctcactgcaacctccgcctcccaggttcaagcgattctcctgcctcagcctcccgagtagctgggattacaggcatgcaccaccacacctggctaattttgtatttttagtagagaaagggtttcaccatgttggtcaggctggtcttgaactcccgacctcaggtgatccacccacctcagcctcccaaactgctgggattacaggcatgagccaccacacccggccgagacagggttttcaggcgatctgcctgcctcgggctcccgaagtgctaggattacaggcgtgagccactgggcctggctttatttaattttttgagatgggatctcactctgtggcccaggatggagtgcagtggtgggatcccagctaactacagccttgaactcctggcctcaagggatcctcccgcctgggtttcccaaagggctgggaatgacaggtgtgagcccccacccccctggcctggatatttcatagaaatgggatcacacggggccaggcgcggtggctcacgcctgtcatcctagcactttgggaggccgaggcgggcggatcacctgaggtcaggagtttgagaccagcctggccaacatggtgaaaccccatctctactaaaaatacaaaaattagctgggcttggtggtgggtgcctgcaatctcagctccttgggactctgaggcaggagaattgattgaaccaggaggcagaggttgcagtgaactgagatcgtgccattgcactccagcctgggcagcaagagccaaactctgtctcgaaaaaataaaataaatgggatcacacgctgtgtgtccttctgtgtctggcgtctctcacggagcgtgacgtccttaaggtgcatccgcgctgtggcctgggtcagagcctggatccttttcacgctgagttgtgttccgcggtggacggccggcactgggttggtcttttcttccactaacgggaatttgggctgtttccacatgtggcctccgtgaataacactacgatgaacgttcatgtacgcgtttctgtgtggacttgtgtttccccttctctcaggggcatgaataggaggagaattgcggggttcctgagggccggcccccagtgctggcacatccccaagccaagccccacccctcttttttttttttgagacagagtcttgctccgtcacccatgctagagtgcaatggccccatctcggctcactgcaacctccgcctcctgagttcaagcaattctcctgcctcagtctcccgaggagctgaggttacaggcacccaccaccatgcccagataatttttgtttttttagtgggagacggggtttccccatgttggccaggctgatcttgaactcctgatctcagggatccacgcacctcagcaccctctttggaagttcctagcaagttctctgcctgagttcagacccacagggcctcttaggggacgggggagggtcagggcccagctctagctgaactcccccggggggaggggggaggggggaggctcaggacccagctctaggggggattgaggaggatcagggcccagctctagctgaactcccctgggggtagggaggagggtcagggcccagctccagctgaactcccctgggtggggtggggaaagagggtcaggctggggaggggagcacagaatggcggggtgccaggcctgggggagaggcggatggggtggggaaggatgggtctgggcagataacgctgtggccttttcctgttggcctgagggcccagggtgggggtggggagaggctggtctccctgaggtctgggcatagggaggtgtcctgggatgagaagactcttgagaagtgactttgataattcgggggcagatccttgggcccaccaccccttgcagggacaggggtccttcttggggtgggggatgaacagagactggagagggtgggggagaaaggagttgaggggctaatttacaggacctctcaggccgggtgtggcagctcacacctgtcatcccagcacactgggcagctgaggcaggaggaccccttgagcccaggagtttgagaccagcctgggtaacacggtgagattctgtgtctacaaaacattttttaaaatgagccaggcgtggtggaactacttgcttatagccccagctaccgagaggctgaggcgggaggatcacctgagctggggaggttggggctgtggggagccgagactgtgcctctgcactccagcctgggcaacagagtgagaccctgcctcaaaaaaataaataaacaaaaaataaataaagcccccattccctttaggatctctacttcctataccaacccactgtcccagcttggaggggcgggaccagcctcgagccgcagttgattcccagagcacagagcacaggacggaagtggttctgcatggggtatagtgaggccagggaatagcaatgcattcctgtccgtgagtcctggccatcaggccttggggtggcctcaccgaacccccactccaagctccgttcaacagaaatccaggaaatgggccggagaggctgggagaccacccaggagaccagcccgaggccgcgccctggatccctgagccctcacttttgtaattaagataataaacctgtgctggctgtgcgggcacacacctgtcatcccagcactttgggagaccaaggcgggcagatcacctgaggtcaggagttcgagaccagcctggccaacacagtgaaaccccatctctactaaaaatacaaaaattaggctgggtgtggtggctcacaggtggattacagggtggcctgtaatcccagcactttgggaggccaaggagggcagatcacaaggtcaagagatcgagaccatcctggccaacatgctgaaaccccgtctctattaaaagtataaaaattagctgggcatggtggtgggcgcctgtagtcccagctactcgggaggctgaggcaggagactcgcttgaacccaggaggcggaggttgcagtgagctgagatcacgccattgcactccagcctgggcgacagagcgagacgccgtctcagaaaaagaaaaaaataaatcaaataaaaaaataagaataaaaatacaaaaattagctaggcgtggtggcaggcacctgtaatcccaactactcaggaggctgacgcagaagaatcacttgaacccgggaggcagaggttgcagtgagccaagattgcgccactgtactccagcctgggcaatagagtgaggttccatcccccccaaaaaaaaaacaaaaaaaaaggaaaaggaaaaataaatctatggaactgctcatggggaggagggacggcctggccctgccactcatgttgacgaagaagtaaactgaggcacggcccttccctcccccatcagaactgaaaggtgtctgaggccccagcaggccctctgcatgagattcggtggctctgagggcctcagatgtcctcactcccccccccgtttctcctgccaggctcagagtatcattttcaaaatggtaaccagcaaaccaacgtgattctcgcacaaaggcaaggtgagcctgttcctcgctcaccctgaatcattcatgaaggaggcagctggcctgcgggctgggatgggagacaggagaggagaaaagacagaggctgggccctgctcgctaaataaatcaggtgcccacgggagcccctgggcgtcttcccgcgctggcgttctgcatatgacagctgacctgtaaattgctgggccctcagccatggttactgtcaggccagcccaggaaggacactggtttcaggtgacctgggtgaggtggaggcggtggggggggttcctgggaccaggccgccattgcaaaaacaaacggcctgcttgtacctgctatcgccctctaagcttcaggtggtgggtggggctgaggggctgagaggtggccccaaagaaagacaaccacatcctaaaccctggaacccgtgaacaaggcttcatttggaacaccagtctttgaaggtaccattaagtgtcttgagatgagatcatcctggagtctgcaggtagaccctaaattccgcgacatacattttattttttatttttacttttttttttgagatagcgtgtcactctgttgcccaggctggagtacagtggcgtaatctaggctcactgcaacctccgcctcccgcgttcaagtgattctcccgcctcagtctcccgagtagctgggattacaggagcaaaccaccacgcccggcaaatttttgtatttttagtggaaacgggctttcaccatgttggccaggatagtctcaggctcttcaccttgtgatccgcctgcctcggccttccaaagtgctgggatgacaggtgtttattttcgtttttgttttttagagacagagtttcactcctgttgcccaggctggagtgcaatggcgcaatctcggctcactgcaacctccgcctcccgggttcaagtgattctcttgcctcagcctcccaaggagctgggattatagggcatgcaccaccacgcctggctaatttttgtatttttggtggagaggaggtttctccatgttggccaggctggtctcgaactctgacctcaggtgatccactcacctcggcctgccagagtgctgggattacaggtgtgagccattgcacccggccagacactgtcttaaaaaaataaaaataaaaaaaggtactggacaggtggctggtcatgtggggcttgcggggtaagggatggccttgggtttatactttgagcaagacaggaggcctggcggggccacgatcagaagtgggttttaacacgattccgaagggttagactggtgcttggaacctggtggtctctactgctgccagctgccactcagacccccggccgcccctgcctgtctgctttcagggcggggcccatcccaggcactccgcgaacagacagaagcggctggttctggtggtgtgaggatgggggtctccaggggagcaaatccacagtaacacactgggcttctcccagatccaccggacattcctgatgagtgaccctggctgcagatggctcttggtgagtctccgttgaccgggtggttcgggccaaaggaccttgccgtgcgatgcctccatggagctcggcggccacccctaatccgggctggaatcctctggcaccagacgcccggcggggctccaaggctcctgggcccacgccaggccccggcctgaaacgcagcactgctggaataaaacacgccagagaagcagggcgctaggctcgcctggatttggggaaacgagaattgtcatgtcttctccctccgtaggttggtgttaatgaaaaacccccttttcagcatggactaaatcccgctaattctatttagggagcagtgtctactccgggccgggaactgctccggtttccaaccgcagcctcccgtgagggtcccagtgtggagggccggggtcatcccctcactctgggatggctcccaacccgctgacctggcctccccgtcaggcaccctcacagctctgtcagactcttcatgtgatcagcgctcctgggaacattagtttagggtgttttctgctgctgggatggtggcccgggagggaccctcctggtgaccctgctgggcctggccctcagtttccccagccgtaggctggcagcctcgaactgtacgagctccaggccacagtttccccagctgtaggtcagtgggccagggactgtagggggctcgggcctcagtttccccagctgtaggcgggtggcttgggcctcagtttccccacctgtaggcgggcggccttggattgtatggagcccgggcctcagtttctccagctgtaggcggatggccgtggactgtgtgtggcctgggcctcagtttcccccgctgtaggcagatggccgtggactgtgtgtggctttggcctcagtttccccagctgtaggcggatggccgtggactgtgtgtggcccggacctcagcttccccagctttaggcggttggccgcggactgtgcaaagtccaggcctcagtttccccagctgtaagcgggcggccgcccactgtacaaggtccaggcctcagtttccccagctgtaggtgagaggccgcggactgtacaaggtccaggcctcagtttccccagctgtaggcgggcggccaaggactgcaaggtccaggcctcagtttccccacctgtaggcgggcggccgcggactgtacaaggtccaggcctcagtttccccagctgtaggtgagaggccgcggactgtacaaggtccaggcctcagtttccccagctgtaggcgggcggccgcctactgtataaggtccaggcctcagtttccccagctgtaggcgggcggccgcggactgtacaaggtccaggcctcagttttcccagctgtaggcagccggccgcggactgtgcggggcccggacctcagtttccctatctccgcagtcgggattcgctgttccggggcgaacaaagaacggtcgggggtgaccccggatcatggcgcgcccgcagtatctgtggccactgtggaaacagccctggcgtgtccgggacgcgacgcggcctttccctccccgcgcgatcacccagatgtgagcgctcagtttgaatcggactttttggccatgtgcccacaaccaacatggagccctgagggtttcctgcccgactccaagatggcgatgcgactccctttgccctcacggcccaggcgggcgggtcctgcccacttgcaagatggcggcagcctgggcaaagcacgcttcccgccgcctgactcgccacgtacccactctcaagatggcgtctcccgcaaagccacgcgccagctgactggctcagacgccgtcacgtgatcccattttctccccctcccccgactacacaagccgtttccgccttcggccttgaggaataaccgcctcccccaataggcgcctgcgatttctctgggtcccgcccccgggcggccttctggccagtgggaggtgctggcgggggcccgcggggctctccccgccccctggctgcagcgggagccaatgggcagcgcgcgcgggggacgtgtgcgggcgtctccgccattttgtgagtctataactcggagccgttgggtcggttcctgctattccggcgcctccactccgtcccccgcgggtctgctctgtgtgccatggacgggtgagtcgcacgtcgccccgcgccccaccgccctccccgcgccgcagccctgcccccgccgccgcgccggcctccccggggccgatctcgccccctctcgggcgggagggggcggcgggctctccccttcctctccgcgtggcgggcgcgggtgcggggcgggtcaggggcttcccgggggtctggccgcgtccccatcccccgtccggcccgcttccggcccccgcgcgccccgtccctagcgcacgcggcctcccgcgcccctccccctccgcgcgcgtccccgcacttcgcctttgccccgcctcggcggcgcgcggcccttcccgcttcccgtccggccctcgcgcgcccggatggcccttcccgcctcccgtccgctcccctcgtgcgcctgcgtagcccgtcgcgcgtccccgttggccccagcgcgcgtgcgcggccgccatcgggggcgcgcgcctttcccgccgcccggactctgcccccggcgcagccccggaagcgcaggcggggctggggcggccgccgggagggaaagctggcgccggggcctcgccgcgggcccgagtctctgcgctccccgccctacccctgccccccgtgcgccccgggccgcggccaaggggtttcggtgatctcgggagagaagcggccgccccgagggtctgtcctccgccccggggccggaggggcctctccagggacccccgcgggcgccgtcatggggaggggccttcccggctctcgggccggggcagcctttccgggcggctttgctgggcgggcttcccttgggagaggtgggagccccctccagaaaggccgtgtcccgccgagcgcttcctgcgcgaggccctccctgggaataggaagcgggagaggctggagatgtttcgcattctttccgttttcctgagaagtttttcttgggttcagtcacttttaaaagtctgttaaacgtggtccgtgcagtctgtggtgtcagaagaggcgcagccctagagtgggtctggaccccttagcatgcgtgcgggcaggtgggtcctgcagacggcgagacgagggctccccgctctcggacccagcaccgcgggctcgggggccgcgcactcgcctcccggagtgaggcaggaggcccggaggctgcccttccgacggacgctccgagtcacttagggcctcgccgggagttgcagtggccgggagaagccgtggggagctcactgttgggtcaggacctggccggggctgaagggagggcctcggacagtccggctttctatccaccttccccccggggtgtcccgaggagggagagtcgggtcgggcggggctcgggttgatcagtaactgaggctgtgttctggtcggtctgttaatttttattgacggtttccacggccgcctcctgctctcctcggtggatcgggctccactctgctgagaggcaccctcttgggggcccacccctacccgggtggaagctctggcccaggcctgtgagtttgccagtttcagcctctccgaggcgtttccaacttactggaaagcacacagcagcccttgaaccctctcagcggcatctagcattcctcggggcttccgatgggggtgtctttgtcttggaacgtgtggggcctggtccagaggtggggcctggggtcctgctgggagggaggggcgccaaaggacaatggtggccccttttcaagttgcagtcaagtggacggctcacttccctgcccttctgagctttctctagcggggcctcgtgcagccagagggagccctgcggaggtggcagctgcagggacctacgggctctcctggcccggggacagctgggtgctcctgctgctgagtggccaccaggctaacgttgtctcctttctttctctctacagcattgtcccagatatagccgttggtacaaaggtaggcacttctcactttgcttctccgtgacgctcctctgaccttgtgccgaccccgggggccaccccccagcgctgttgcgttggctagagggcgcttttccattcctaaggggcactacccttggtctggaatctggagttgggcggtagggtttgaaccccgggctccagtgcccgtgagttttgggggcttgggtttgctggccgcccctcaggtctggaatctgagctgctcttcggttcttgctgtcagcagcgagggctctgtgtgccccaggcctgcctttggaacttctgcctctagaggctggaatcgtgccgttcagtgggaaacctcatgttgtggctgcctgggagactcttggttttgataggaaaagagccacctggctgtggaggggacctggatagaatccagcctatttgagtggctaggatgggcatttactggttgattttgacgttaagtttttttgtttttgtttttgttttttatttttgagatggagtcttgctttgtcaccaggctggagtgcagtggtgtgatcttggctcactgcaacctccacctctcaggttcaagcgattctcctgcctcaacctcctgagtagccgggattacaggtgcccaccaccatgcccagctaatttttgtattttttttttttttttttggtaaagatggggtttcgaacattgttggccaggctggtctggaacacaggtgatgcaccccccttggcctcccacagtgctgggattacagttgtgagccgccagacccggctgacattaagtatctttgatggcatctggttagaacagcagcaaactgtcaaaggtggtgtttggggcaagagaaaaatgaatgtgccacgtctctggggtgtgcgaatcttgcagccccatggagggtgaggccagggctcagcatgtgaggaaagggggtcagaacctggagaagaagaaggtcctggggaggcgattctcgagggagctgtagtcctcgcttagctggggtagttggttaatgattctgctggtcattgtgggttgagggggctcccgacttcagggcttgtgccccgagagcctcccgcagggcgagcccacagtggtggcgtcctgagccagcagccagttggtttctggtcagtcagcagtggtgcctgggccaggtttcggtttttcccaagtggactgctgtctttacgcgctgcctgccccgatcttcctggagataaaacctgtttgttcagtgtgggaggagggagaggtactttcatctgaagcatttgcaacaatccctagatgtgtctggcttgcaggcagtcgtctcttccctgcttctgtgggcctgctttccagctggagtggccctcagcttccatcgggtggtccttgagccctcctctgcagttcctagggggctcctgggctgggacgttgaagcccagccaggacttgaagcctgcgggagggattttgccacagggcagggttagggctcctgctgggtgcaggccctggtaggaggacggggtagtaccctgacccagatgataccccccctcccccccaccaccagggagccctcagctgacctgggcccacacctggctacgctgtcctttagcccaggacagagcaagctcttgttcagtgtggggttaaagacacctaggaactgtgctgtagggccccagctgcagactggaagtcctggggcgtttcctgtcaatctgtgtgcttcaggacaggtgccctgaagggaccctcctggggtacctggcagctgctgtgaaggcagtggaggcgctaggcccagctcgtgtctcctggttgctgccctgtggagcctcggagcctccaggtgtcccttccgttctgctggggcgccgttgagctgagccaagccggcctgtgccgcctgggcaggcatggagtttgctgccgcagacagttgtgggcaatgccaggccacttgcccatgggaatgagattagggcttcaggcaggcggccaagaggaccgctcagaggaagcggccccgcccaccactccagtcaaagacagggtccaagatgccctttttaaggtttgtgcagccagcacatgggagccgcatgggcgcttggccactctccagcttgggggaggaccagccctggtgtcctggacggggtcggctcctgggctcccccagcctctgagctggaggggagagcagacaggaagcgacttcctgtgggaggcgaaggttggaggccctgcgtctcaggtgcacccatcctcccttcctcccgtcctcccttcctccggtcctggcactgctgtgttttctgatcgcgtggtttccacctgaggcggctggctctgacccctttcccctgggcctgcgcagccccgccttgtgctcatagggggccccagactctgaaagcgagaggactcgagggtctgttttcagtatttggcttcatctgtgtccggccggaacctcagggccgccgtgacactggacactgttcattctctgaccctaaagtcttggggactgaacaggtgccatttgggtgggcgccgggcctgtggaccctgagtgattcctggttccggcccttgtggctgctcgattgcttgtttggtgacgccctgagtgcttgtgggattggtgggagactcagggctgcagttagaggtctcattggcaagggccagtccctgttccccatcctccttgagcaggtgccggagtctcccgaggctcttgccgtccgcgtcgggaggaggcagctgtggggctttggaggctcgggcagtcttccttccaggaagctcttgagccagggccagggcaggagtggagctgaacgtgggtggaggggaggcggccttaagagaagaccaagcgcaggctcggggaggccagcgttggtgggggctctttggccaggtgtgggggcagctccttgaccaggcatgggggtgtgtggagctgggggttgtctgaggggggacagggtgtgatatccactggttctttctgatgcgatggccctgggcccttcagcaggtgggggcaggctcttggcctcaatcctgatacgggagatggaggctcctttgttccctgggatggccctgtcctggggggcctgggcgttgctgccctcagcgcctgcagaggctcgctttgcagaccaagcgcctgtgctccaaggtcctcagacccgagctttgttttctgtgtaactaagggccgtaaccaacgtctcctccaatttcactctttgaataaacgtgtgtcttcaatccttgcagcgggggggatgtctgccgtcctgagcctaggatcagtctagtgcaattcttagaagttgatccaattacatagaaataaccagtgaatagattgtttctggagagaaaatggacaggtcagaagtgatggagccgctgtggagctcccccggccctagtcacggccgcgataccagcggatcactgggcgggaggccgtgtctctagtcctcagtctcgcgtgtgcagagacggaggtcgggtttcttttccgggctggaaaacaggagaggaggggctcctgcgagagtgagggaggcagcgctataatttggttctcttgcgaggccaccagaagtgaggacggctgcctgggccctgccgtgtgctgctgggggggctggctccatggagggggtcctctgccctgctggctggtggctgaggccccaggcctgtgcccagggccgctggcagcacagtgaggccacgtccacagcagagttggccgtggagatagtgtacgtggtgccctccgtagctgagagcctcccagccccacactggctgagtacccagggcttccagaatttggaaaaaggagcagtgttttggtcgtggagctgtggggtgccgtgcgcgtccatgggctgggtctgcgctcaggctgccctgccgtggaagtgtgggtgtgggtatgggttgggggtctgggaccccaggcagcccaagtgggagcagggccggccggtggggaagggaggctctggcctggtgggaagtgcagctccgcgttgtcccttctcttgcagcggggatctgacgagcttttctctacttgtgtcactaacggaccgtttatcatgagcagcaactcggcttctgcaggtaaggccgggactcggcccagggcaagacccgtgggtgtctttccctggaacaacgttacgttcttgttctgggactctactttccatctccaactgcaggggcccatggtccacgctacagacccaggtccaagttctcgctgcagagaatttccagggaggcgctggatggatggtccaggctggcacttggacctgtgggcgggttgtcaggagctgtcgggagcaggggtcctgactgtgcaggtcttggcctctcgcgctgctggttcacatgcaccctcctggggctcagggttggtctccgtagcaggcagggctctagggggatagcagggaccttcctctgtgggctcctgcgagttggtgcctgcatctcatggcacccccttttcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggtacctgagccgcgtttctccggggtgctcacaccgtgcaggcggggacgaggagggcccagcgctcactgcctccccaacaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcggtgcgtggccccgcggcggaccccagcagcccggggacctcgggggtgggcccagccgcaggggccggggactcacggctgtgcctcccacagcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccaggtgaggtggtcccatcaccgccagggcaggtcggctgctattgctgtgggcacaggcacacgggaggggcctggcagggctggtgggcaccgggcaggagctcatgctgtggcccgggacctgcagattttctccaagttcggcacagtgttgaagatcatcaccttcaccaagaacaaccagttccaggccctgctgcagtatgcggaccccgtgagcgcccagcacgccaagctggtgagtggggctcccgggacggcgcccgccctggccctggcccggcgacgtctcacggtccctctcccctcagtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtaagaggctgcccgacgcggcgccagtgtgcagagtggtctattagggccgctcagtccggagccccggcggcacgggcccggccctgcaccagggtgatgcacctgctgctctctgcacggccagcacagcacggtccagtgtcccccacgtcgggaccacggccccccctggagcagcggatctgcccgcgaaggctctgccggggccgcccgccggccgggttggggcccatcccgcagcacagcgcccgctcgcggtggaggttgtgggtgcgatgattagtgtctcatttatttctaggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcggacgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggtatgttatcgttcacacttttattaccttgttttcattaattgagatgattttgatgccctgagacgtattatgagtttgcggtttggcactctgatgctccgtggcatccgcctcgttttatggtttgctttcggtttgcgaattttatttggtcccgtagatacgtacgcatggtttatcgccctgcatgcttttcagagttagacctgtcggtggcatatgccaccgtggccacccgctggcagcttacctgtcctggatgctatgactttgctgaacggagctgctcctgttagcgcgccctgtggctgcgagacgcagctccgcagtggccgataaagcaaacccggccgggctgagccgggccttgtgggggtgcgcggggccggggctgacggggagatgggcggggcaggcagcaggagactcaggccccatccctgggcttttgaaggcgtctacggtgacgtgcagcgcgtgaagatcctgttcaataagaaggagaacgccctagtgcagatggcggacggcaaccaggcccagctgggtaagaggccggggcggccccggggtggagggggcaggggcgggggctgcgttccctctcgggcgcctggtcacgcgggtgctgctcccccagccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgtgagtgctgggccggggggctcatggggccgggggcgggcaagggctctgcttggctgtcctaccgcgtcggtgtgtggacttctggcgtttccagagtgcaggtcgggcacctcttaccccaaacctgaagtactgcaaggcctggagcttgagccgagggctgctcaagggagggggtcgttggacactttggaggttttggctcaggggatgctccctgtgagaatgtataatgcacacatttatttatttatattttttgaggcgaagtcttgctttgtcacccaggctggagtacagtggaacgatctcggttcactgcaacctccgcctcttgggttcaagtgattgtgccacctcagcttcccgagtagctgggactgtaggcacccacaaccacacctggctaatttttgtatttttagtagagacggggtttcaccatattggccaggctgatcttgatctcctgaccttgtgatccgcctgcttcggcctcccaaagtgctgggatacaggcgtgagccaccgcgcctagccacatttatttatttatttatttattttacttattttgagatggagtcacgctctgtcgcccaggctggagtgcagtggcgggatctctgcaagttctgcctcctgggttcatgccactctgctgcctcagcctcccgagtagctgggagggactataggtgcccgccagcacgcccggctaattttttgtatttttagtggaaacggggtttcactgtgttagccaggatggtgtcgatctcctgactttgtgatcaacccgcctcggcctcccaaagtgctgggataacaggtgggagccaccacgcctggcctaatgcacacctttataatcccagtactgtggggggccgggcaggggattgcttgaacccaagagttaagaccagcctgagcaataaagtgagacctctgtctctacaggaacaattggttaaaattagctaggagtggtggtgtgcacgtcaggtcccagctcttccggattgggaggttgaggtgggaggttcacttcgcgctcaggaggttgaggttgcagtgagctgtgattgcactgccagactccaggctgggcggcagagtaagaccctgtctgtaaaaattacataatgcaagtatttggaaatgcaggtacatctggccccaagcatgtcaaccagtagtaagccctttgatatttaacacgttacttgtgaaatgttatcagaaaatcaacaaggggcctggcagagtggctcacgcctatcatcccagcactttaggaggccgaggcaggcagatcacctgaggtcaggagttcaagaccaacctggccaacctggtgaaaccccgtctctactaaaaataaaaaaattagcctggcatggtgttgcgtgcctgtaatcccagctacttgggagactgaggcaggagaatcacttgaacctgcaggcggaggttgtggtgagctgagatcacgccactgtgctcccgcctgggcgacagagcaagattccatctggaaaaaaaaaagtggaggagcgtggtactctgtttctgcaaacttgtagatgcctggtttcgttagaagctgcttcagaccattgtggacatgatttgataccccatttctgggctcctaaaaggccctacgccttccccggctactctgaaaactagtctggggaaagcctcgcggacctgactgggcgcccccacccccacgcggccccaggctcacgcctttctcctcccacaggccctcagtctccgaggaggatctcaaggtcctgttttccagcaatgggggcgtcgtcaaaggattcaagttcttccagtgagtatgaggcgggctgtccctggctctccccaggctgccctgcggccggccctgaccccctgtcttgcaggaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgcccgcgccctcggcccgccccccgcccgcccccggccccgccgcgctagtcggggaagcggcgcgcctgcatcttgcggaagtagccctcggcctccgcctccgcctcgcgctccgccagccccaggccgcccgcgtggcgccgcagcgtggactcccggctgcccgggcccagcgccccatcggccgcgcccagcgggggcagcccctcgcccgtggccaggttgacggtggccacggccccgaaccgcggctcctcctggtccacgtcgctgaccgacgagccgggggacacgcccgggggcttggccccgccgcggaagccgcgcgccaggtcccccagctcgtagccgccgtcggcctccgccttggccccgccgcccgccgccttccactcccagggcgcgccgccggccgacaggtgcaccacggggtggtgcggcgcgtgcgcgtcgatggtcacgatgctggcggagtcgcggtccgacggcgaccggtactgcgaggagtcggagctggcgctggacgacgacgccgtctcggccgccttggggcccggcgcgcccggagccttggacatggcgatgacctgcagcagccgcggagggttggccactgccgccccgctcttctcggccatcatgagccacttggcgcgcaccccggcgccgcttttgggggacaggccggcccccgtctgcgcgccctcctccgggatgtgcaccagcggcggcggccccgcgcgcggtgggaggatgacccgaggccccagccccggccgcgcctgcacggtggggtagagcgagggcggggccgggccctcgtcctcctcctcttcctcctcctcctcttcctcttcgtcctcctcctcttcctcctcctccgccatgggttcggcgggcgcgcgcaggtgcccggggctggcgtcgtcgggcagccccaggccgcggccctccaggctcttctgcttccactcgctgatgagctgcttggagcgcgaggcgtccagcggcacgtggatggtcatgtggcggcgcgcggggtcgtccagcgagggcgcgctggccctgggcagcgtgtggctgaaggtcaccatgttctccttggccatggggctgcgcggggccagcaggtccacgtccacgctggcgcgcttcaggctgcccagcgaggtcttctcgcgggccacgggccggggcgcgccctccagccgccctgggggccccagctcgtcggtgctcaccgacttattctgctgataaaccgagtcgtggccccgctgcgtcagggcccgcagcgcgtccttggcgggggccggggccgcgggcttctctgcaggtggggcctggaagttgcccaccgcgtggcaggcctgtcggggagaggggtctgggggtgaggcctggggctcagagggctcctcccctgtgatcgttggacttgccgcggggggctctggaccgggggtgggggctggcaagctcttgtccagtgggaccggttcccaccccaaggttgctgacccagcacatcgggcaggtctgagcccacgggattctgactccagcattccaagggcgagacacttcagcacccatgccttccccctaagaccccttcgggacccacgtctatcccctcagacaccctgggcacccgtgcctcccccctagagcccctgggcacccatgcctcccccctcagaccctctgggccagccccccgccagaacccctgggaaccatgcctcacccctcaggctaccagcctcccctgtcagaccccctgagcctgcctcccacctcagacccctgggccagcctccccactcaggccctgtgggcactcatgcctcccccctcagatcccctgggaacccatgccgacccccatcagaacctgccactcaccaggtaggcagcgatgcccgccccgatgaggaagccggcatacacgtccacagggtggctgcggtactgcgtgatctgcgtgagcccgcatacgcccgcggcgatggcaaaggcgaagaccaggatgggcttcagcagcttggtggtgtccgagatgaccgagttgaagtacatctggggcatgggggttggggtcagggagggctccccacgggtcagcaagagggcctgggaagggcagtgaggggccggactcaccgacacatagaccgcggcgaaggctgacagcgtggcgtgctgggacgggaaggtcttcctgtaagaggcgtccagcgtgagccccgcccacctggggaccccagctccagtggcctctctgtgtctctgtttccccgcatgttcaccggggcggaagaaggctcccagtcaggggagttgggggtccggctcaccgtgcagacaggatggcgtggatgtcgtggccggagcagatgtcctgcgtgatgtaggggttgacctcgcaggacgtgcccaggagagtgtagttgggcttgcagacggtgaggaagaagggagtgtggtaacccgtggccagctggatcacgtccgtcaccagggctgtggcacacaggccgaacacgtggacacctgcagggcggaaggctcggccaggcggggagctggggacccgggacagccccaccccctgcatgtggaggtagctcagggtcggggcgcgtcccgcaactcacccacaaaccgcaccgtacgccgcaggaaggagttgaagttgcagccgccggcgttgatgctgccctccgccccggcgggccccccggcacggccccacagccgggactgcagacagtacaacatgccctcggccaccatgatctgccaacagggagggggcgctcaggcctcggtgcccacagggagggggcgctcaggcgggctcccatctgcagtgcccacaggctggcacaggccccggtgtggatgttcaccgaggtggcgggggtgggctcccagccgtggtgcccacaggctggcacaggccccggtgtggatgttcaccgaggtggcagtggctgcggtgcccacaggctggcacaggccccggtgtggatgttcaccgacaggccccagtgtggatgttcaccgaggtggcgggggtgggctcccagccgtggtgcccacaggctggcacaggccccggtgcaggtgctcaccgaggcggcaggggccgcgaaggccaagctgagcagcatcagcagcgggatgagctcctcgttggtctccacgtagggcatggagagagtgcggtcatagcactggaagcccaccttggccggcttgaagaggtcggtcagctccaggaagtacaaggatacgatggaagaagccactatgggcagctgtggggacaaggtgggccaggttcaccctgctctccctcgcggaggcgtctgtccagccctccatgaattcagggccatccaccgtctcactcacctatccacagatccaacccgctcccagccactctttcccccatgagttattcatccatccacagatgctccatctgtaactcgaccatctacacatcacacacccactcactcatcctccatccacccaaacacctatgcccccaacatccacccactcaccgacccatcacccacccatccatccactgggaaccatccatccattcatccatccacccacccacccatcatctatccacccattctccacccatgcacccaacggtacccatccatccatccatccatcacctagccattcattcatctgtccatccatccatccatcatccacccatgcagccatccatctatccacccacccaactgtccatccatccacccacccacccatccatccgtccattcattacccagccattcatccatccatccacccacccatcatccatccacccattctccacccatgcacccacccacccatctacccacctacccatccatccaaccgtccatccatccattcattacccagccattcattcacccatccatccatccacccatcctccacccatgcccccagtggtacccatccatccatccatccattcatcacccagccattcattcatctatccatccatccatcatccacccattcatcatccagccattcattcatctatccatccatccatcatccactcatgcacccaatggtaccatccatctatccacccacccaaccgtccatccatccgtccattcattacccagccattcattcatccatccatccacccacccatcatccatccacccattctccacccatgcacccaacagtacccatccatccatccatccatcacctagccattcattcatctatccattcatccatccatcatccacccatgcagccatccatctatccacccacccaactgtccatccatccacccatccacccacccacccatccacctatccatccacccatccatccattgatcacccatccatccatccatctatccaccctcccacccacccatctaccaacctacccatctatccacctactcatccatctacccatctgtccatccacaacagtcttgctctgttgcccaggctgcagtgcagtggtgccatctcaactcactgcaacctctgcctcctgggtttttgtatttttagtagagacagggtatcgtcatgttgcccaggctggtctcgaactcctaggctcaagtgatacacccgccttggcctcccaaagtgctgggattagaggcgtgaggcaccgcacccagccatggcctcaagcctttttttttcccccactctgtcacgcagcctggagtgcagtggtgcaatctcggctcactgcaaactccgcctccaggttcaagagatcctcccacctcagccctccaagtagctggaattacaagcgtgcactaccacacctggctaattttttgtatttttagtagaggcggggtttcaccatgttccccaggctgccctcgaacttctgacctcaagtaatccacctgcctcggcctcctgaagtgctgggattacaggcatgagtgaccttgctcaggcatggccccagtcgtaatttctgccttgttatggcatcttagcaggggttcagccctcagtccagtcctggggagggcacaggtcagggctgggggctccaggaagggaaaagccatcactgaacatcccagggcagaattggatcgagggagctgagttcatgtccagtgagcattcattgagtgcctgttgcatgcaggcacgaggcccggggcagacgcggaaagtgggtagcagcgtttgtttgcacctgacacccggtttgaaaaccacccactttaacctgtgggcggccagcagaccccctgtgcctcagtctcaccagctgcaaaatgggaatgataaagtagccgcctccaagggctcaggtggagatgagtcaatgtgggaggtggcccctggcaactatctacttgttctctccactttcattatcagcatgattttgctggggcgggcagacagcatcaagcccggggagggtctgaggtggggcctgggcgcggccttaaaaatatctaaccatgggccgggtgcggtggctcacgcctgtcatcccagcactttgggaggccgggacgggcagatcacctgaggtcaggagtttgagaccagcctggccaacatggtgaaaccccatctctactaaaaatacaaaaattaacccagcgtggtggtgcgtgcctgtagtctcagctactccggaggctaaggtgggagaatcgtttgaggacgggaggtggaggttgcagtgagctgacattgttccactgcactccagcttgggcaagacagcaggactccatctcaaaaaataataataataaataaaataataataataaggccgaccgcagtggctcacacctgtaattccagtgctttgggaggctgaggcaggaagatcacttgaggcctggagttcaacgctagcctgagcaacacagtaagaccctgtctctactaaatacatacttttttttggagtctcgctctgtcgcccaggctggagtgcagtggcgcgatctcggctcactgcaagctccacatcccgggttcacgccattctcctgcctcagcctcccgagtagctgggactacaggcgcccgccaccgcgcccggctaattttttgtatttttagtagagacggggtttcaccgtgttagccaggatggtctcgatctcctgacctcatgatccgcccacctaggccttccaaagtgctgggatgacaggcgtgagccaccacgcacagcctactaaaaatgatttttaaaaattagctggggctcaggctagccttgaactccaggcctcaagtgatcttcctgcctcagcctcccaaagcactggaattacaggtgtgagccactgcgctcggccttattattattattttatttattattattattttttgagatggagtcttgctctcttgcccaagctggcgtgcagtggaacagtctcagctcactgcaacctccacctcccgtcctcaagcgattctcccacctcagcctccggagtagctgagactacaggcacacaccaccacgctgggctaatttttgtatttttagtagaggtgtggtttcaccacattggccagactggtctcaaactcctgacctcaggtgatctgcccgtcccggcctcccaaagtgctgggatgacaggcgtgagccactgcacccagcctactttttttttttttttttccgagatggagtctcactctgttgcccaggctggagtgcagtggcgcgatctcggctaactgcaacctccacctcctgggttcaagcgattctcctgcctcagcctcccgagtagatgggattacaggcgcccaccactacgaccaccatgcccagctaatttttgtatttttagtagagatggggtttcaccatattgaccaggctggtctcgaactcctgaccttaggtgatccgcccacctcggcctcccaaagtgctgggattataggtgtgagccaccatgcccgtcctgcaacaggaatttaagtgcaatttcgaaaaataaacagattttctatgaagtgatgtgggcaacttaatgatattgtgtttgggagggacccacttgcccgggtgtgaggtaacggattacaggccagccgctggccgtgtgacctgcacgggtcactgcttccttgagactagggtcccgtcttccatcgaggctctggaaggcccatcactagagccggttttcctggcctgacatgcaaggatggattaaagttattttattttttgagatggggtctggctctgtcatccaggctgaagtgcagtggtgtgatcttggctcactgcaacctccgccacctgggctcaagtcatcctccatctcaggctcctatgtaactgagacctcagctgcacaccaccacgcccagctattttttctgtttttaaaattttgtagagatgggtttttgccatgttgcccaggctagtcttgaactcttgggctcaagcaatccatctacctgggcctcccaatgtgttgagatcacaggcgtgagccaccaccccagccttaagttactctaccatcctgagccaggtgtgtgccaaaatggtagcttttttgttttagagacagagtctctgtcatccaggctggagtgcagtggtgtgatcacaactcactacagcctcaacctcctgggctcaagcaatcctcccacctcggcctcctaagtagctgagaataaaggcacgcagcacacgcccaactaatattttaattttttctgtagagatgggatcttgctgtgttgcccaggttggtctcaaactcctggcctcaagtgatcctcccacctcagtctcccaaagtgctgggattacaaacatgacaaacgtgagccaccgcacagggcagggggctccatttattacatttattgtcttctttttttttttctaagacagggccttgctctgttgcccaggctggagtgcagtggcatgatctctgctcactgcaacctccacctcctgggttcaagcgattctcctgccccagcctcccgagtagctgggctcacaggcataagccaacatacccggctaatttttttgtattttttagtagagatggggtttcaccatgttggccaggctggtcttgaactcctgccctcaggtgatctgcccacctcggcctcccaaagtgctgggattacaggcgtgagccacagtgcccagcctaatttttgtatttttaatggagaggggtttcaccatgttggctaggctggtcttgaactcctgacctaggtgatccacccgccttggcctcccaaagtgctgggattacaggcgtgagccaccgcacagggcaaggggttccatttatggtcataaactcctcactatgtgcctaacacgtttccgtattctgtagatattaattcctatcagctccaggagtggaaaagcggaggcccagagaggttaggggcagggcaccagcctcaccattagcagaggtgaactcagaccctgaggcttcggagcccacgcggcacctgcacccaaccccaccccctccggcctccccgccccctccaggcccccagcccccgacccccagcccctctgaccacaccttggtcagaagggctcccctcctagcacctgcccacagttcccacggcctggacccccctcggttcctctggagctcctactcgacccgcacagcccaagtcctctgccccaccccccatccgccggacaccccggtcctgccccgccccgaggccactgccggggcagctgcgccggctccggtcccccagcgcgggggtctctgcgggcgggcggaaccgaggcgtctcccccgggccccagcgcgacccccacccacctccacgaagtagaagcagggcagaagcgtcatgctgtccttcgggatcttgttcttctccttggtggagatcatggtgccgcgggcgccgcaggccgtggctggaggggagaaagcggcgctggaggggggcgcgcaggcggagcccgggggagacacggtggccggcgccggcgggggaggggcggtcggggaaactgaggctgcagagagcggcgtccgcgtggcctccccgcgccccggcccagcacgcggcttccgggcgcccctacacccgggatcggggggtcggggccgggatcgccgaggagggcggggggtctccgggcgggagccagtccccgcgtggtggtggggggcatccgggagaactggggttccgggcggcggaggagactgggtccgcgcccccagccccacagcccctcacctggcgcggccggcgcccagcacaaagcgcgtctcctccgtggggcggggccgggagccgggaaggggagggggacgggggaggggagggtccggcccggagacccccgcgcgcgcccagacgccgcagcccagacgccgcagccaggggcgggggctctttgtctgggcgcgtcctccgcaggccccgcgcaccgtccccgcctccctggcgccgcctcccaccgccgggggtctcgggggtctcaggtctgcgcgagcggctggcggggctcgggggtcgcgtcctcctcccttcgggcctgcggcggtgacggtcccgtcctcccctcccgggtggctgcggtcggcccggggggcgccatcgagacgggggcggaggcgggggcgggggttggggtttcggggtctctgactgtctccgtgtctctcacggtctctcgccggctccgactgcccccgccccgcgcctccgcccgcccctccgcggagcccgccgctcgctggtgcgcgtttccatggcgaggctcccagggcgcccggagcatcggagacaaaagagctgggggagggggactggggggtctcccggtgcctccctcccttccccccgcactcaccctcgccccctccgccgcgccggggtccaccctccgcctggccgcagccgctcggtgcgcacggcgggattgcggggcgcggggctgggggctgggggctgcgggatgcgggcagggccctcgggacccgcactcgggcagtgcctgctgtctgcgtgcatttcctcctccatatgcgcagccctgcggggtaggggctggttgacccccgttgtagggatggggaaactgaggcttgggcaccctgggtcgcaatccgaggtctccgggccccaaacggcaggatttacaaaaatcggtttttgggccgtgcgcggtggctcaggcctgtaatcccagcactttgggaggtcgaggcgggcggatcacgagggcaggagttcgagaccagcctggacaacatggtgaaaccccgtctctactaaaaatacaaaaatttttagggtgtggtggctcatgcctgtaatcccagctactcgggaggctgaggcaggagaatcgcttgaacctgggaagcggaggttgcagtgagccgagatcgtgccactgcactccagcctgggcaacaagagcgagactctgtctcaaaacaaacaaacaaacaaacaaacaaagagtgacttccaggctgggtgcagtggctcaggcctataatcccagcactttgggaggcagaggcgggaggatcccttgaggccaggagttccagaccagcctggccaacatggtgaaaccccatctctactaaaaatataaaaattagccggacatggtggcaggcgcctgtaatcccagccagatgggaggctgaggcaggagaattgcttgaacctgggaggcggaggttgcagtgagccgagatggcaccattgccctccagcctgggcgacagaaggagactctatctcaaaaaaaaaaaaaaaaacaaacaaacagtgactccagagggttggagccctgctagataccttagtttgctcataacaggcactgctgcccccgggaagagggtcgcctgccataaatgcggaaacagttaaatggcgatgggaataggatgggaactcaatggtgttgctacctttggatggactcggaggcagcccagcttcctgggacaggactgcacggactgcctggggaggggtctttggccccccggttcctgcaggggggctcggggaggccctgtgagcagttggtcacaggtgggtcccattcgatgcgatcctgttcctccccaacagccctggagaagggggacgttgcctgctgtggctgcggctgttttcctggcctgtgagaggcggggccagagtggccgttgggaatctgggtgttgcaaggtgaccacaaacagctctctgggggaggaggaggaaaatgcaattgattttcaggagccttctgaggtcaggagtgggagagtgtgcagggggaccctcctggcagcttgggggtccaacagaagatctgggggagtctcagggtcttctccccctaggatcaccagtggtggagatggggcaggcctggccatggagggcacgttgcttggctgaggggcctgggcttgagtgtggggcctgggcttgagtgatgggagagttccgagcaggccggaggggttgagcgtaccagacgctgctcaaaacttttatttaaaaatgattattattattattactattattttgagatggactcttgctctgtcgcccaggctggagtgcaatcgtgcgatttcagctcactgcaacctcccacctcctgggttcaagtgattctccctcctcagcctcccgagtagttgggattataggcgcctgccaccacgacgggctaatttttgtatttttagtagaaagaggatctccccatgttggtcaggctggtgttgatctcctgacctcagctgatctgctgcctcagcctcccaaagtactgggatgacaggggagccacggagcccagcctttttttttttttttgggagacggagttgcactctgtcgtctaggctggagtgcagtggcgcgatctcggctcactgcaagctccacctcccgggttcacgccattctcctgcctcagcctcccgagtagctgggaccgcaggcgcccaggactatgcccgggtaattcttttgtatttttagtagagacggtgtttcaccgtgttagccaggatggtcttgatctcctgacctcgtgatccgcccgtcttggcctcccaaagtgctgggattacaggcgtgagccaccgcgcccagctttttttttttttttttaatagagagagggtctcaccatgttgccaaggctggtctcaaactcctgggctcaagtgatcctcccacctcggcctcccaaggcactgggattacaggcgtgagccaccacgcccggcctcaaaaacttttcagaatatgaaccccactccatgctcagcactgttctgtctagaaggcagagtctatccctgtctcagggcacactgacgtgcagacagcgagctcgccctgaggtcatgcgactgggagggacagagcttccggctcccggcagaggggaaatggggcctggcccacgggagagctgaggcccacgtttggccaggacagggtggatggaggctggggcctccgcagggaagatggacaggtaggatccggggtgggcagagagggagagctggcttggacggaggcagggatctgggggctgtgccatggaccctgtgaggtggctgggctgtgaaactcagtggagaccggaattattattattattattatttttttgagatggagtctcactgtctcccgggctggagtgcagtggcacgatctcggctcactgcaagctccgcctcctgggttcacgccattctcctgcctcagcctcctgagtagctgggactacaggcgcccaccaccacgcccggctaattttttgtatctttagtagagatggggtttcaccgtgttagccaggaaggtcttgatctcctgacctcatgatccgcccgcctcggcctcccaaagtgctgagattacaggtgtgagccaccgctcccggcctggagaccagatttgagccctgggaccctacattcccgatgggcagcggacctcaaggcacaccggccccgcctccctggactctccccgtatccgccccttggaggggcaaactgccctcagagggctcccacaggcccagacacaaactggtgtccccaagggtgtgggggacacggtaagctccagacctcagtttcaccttggaaatgagcccctttgtaaaaaatggaggtgagtttggacgcagtagctcacacctgtgctcccagcactttgggaggccgaggcaggtggattgcttgagcttaggagtttcaaaccagcccgagcaacatagtgagactccacctctacaaaaaaatacaaaaattagccgggcatggtggcatgtgcctatggtcccagctacctgggaggctgaggcaggaggattgctggaacccgggaatcggaggctgcagcgagctgagatcgtgccactgcactccaccctgggcaacatagtgagatcccatctctacaaaatatacaaaaattagccgggcacggtggcgggtgcctgtggtcccagctactcgggaggctgaggcaggaggatcagttgaacccaggagattgaggctgcagtgagctgagatggtgccgctgccctccagcctgggcaacagcgagacctcaactctgaaaaaaacaaaagaaggagatgaaatttacataacttaaaattagccattttgaacggtacagtgaagtggttttcggtgcattcaccgacttgtgcaaccatcactgctgtccagtcccagaacattccatcaccccaaagaaggaagccccatctccatccatcagccatcaccccctgccctcccccggcccctggcaaccacagatccacttcctgcctctgcagatttgcttgttctggacatttcgtctatttatttttatatagtttttaatttgtttttatttattttttttgagacggagtctctctgtgtcacccaggctggagtgcagtggcgcaatctcggctcactgcaacctccacctcccaggttcaagcgattatcctgtctcagcttcccaagtagctgggactataggcgcccgccaccacgcccagctaatttcttttttttttttgaaatggagttttgctcttgtcgcccaggctggagtgcaatggtgcgatctcggctcgctgcaacctccgcctcccaggttcaagtgattctcctgcctcagcctcctgagtagctgggattacaggcatgtgccaccacgcccagttaattttgtatttttagtagagatggggtttctccatgttggtcaggctggtcttgaacgcccaacctcaggtgatctgcctgcctcggcctcccagagtgctaggattacaggtgtgagccaccgcacccagcttgtcaattatatctcaataaagctgttgaaaaagtttaaaaaaatcacccaatcgggcacagtgtttcacacctgtaatcccagcattttgggaggccgaggtgggtggatcacctgaggtcgggagtttgagaccagcctggccaatatagtgaaaccccatctctactaaaaatacaaaaaattagccaggcgtggtggtggacaactgtaatcctagctactcaggaggctgagacaggagaatcacttgagcctgggaggcggaggttgcagtgagtcgagatcacaccattgcactccagcctgggcaacaagagcgaaactccgtctcaaaataataataataataataataataataatcacccatacagacgcgcaggactcaacgcaggactgccagctccactgccctgagccccccggtgccaggcccagcgggcagtgctggagccccagtggcttgggatggggagactgggactctgagctggcaatgttcctgggtgctggctgcatgcccgccatgtgctgggctccgggatccactggttcctgacaccctcacctgcccctgggggtgtggccatcttctagagagggaaactgaggatcagtgcagaatgtagggggagcccaggctggcccagggagcagttggcggtggaggccttgggcaatttcccgtgttcccactgagtggggctgtccctgggcctgggcggggacgccaccaactgccaaggcctgtgtataagggcagccgccgccttagccacagacctgccccgccatgacccggctgacagtcctggccctgctggctggtctgctggcgtcctcgagggccggtgagtgcctctctgtgccggtggtcccccatctgtgctagggcccggctgccagggcagaactcagacttaaagcacagagaaggcaagcggcttggcctgggtcacacagccagcccggcctggacgatcccgcgaaaggcgtgagggcggacggtgtgcgggactcaggggccccctgtcctcttagggagtgggacgatgggggagggtgggtccccccgcagccccactgggtggatagagctgaggctgcagcttcacacgccctcccggccactgtgtggattcttggggatctcagagctgtctccccccgacccaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagtgaggggtcctggggagggggcctagggggcattggggctcagagaaggggcttggggggcttaggcattcagtgggggtgcttggtaggtgaggaggggaggggattgcaaaaggaggggctcagggaaaggagggggcttggagagggaaatggggactgagttgaggagggacccaaggatattggggggctcagatggaggaggcccagagaagggaagggggtcagatggaggaggcccagagaaaggaagaggctcagatggaggaggtgcagtgaaggaaagggggtcagatgggggaggcccagagaagggaaggggctcagatggaggagggggcccagagaaaggaaggggctcagatggaggaggtgcagagaagggaagggggtcagatgggggaggcccagagaagggaaggggctcagatggaggaggtgcagagaagggaaggggctcagatggaggaggtgcagagaagagaagggcctcagatggaggaggtgcagagaagggaagggcctcagatggaggaggtgcggagaagggaagggggtcagatggaggaggtgcagagaagggaagggggtcagatgggggaggcccagggaagggaaggggctcagatggaggaggggcagagaagggaagggggtcagatgggggaggcccagggaagggaaggggctcagatgggggaggcgcagagaagggaagggggtcagatggaggaggtgcagagaagggaagggggtcagatgggggaggcccagataagggaatggggtcagatgggggaggtgcagagaagggaagggggtcagatgggggaggcccagataagggaaggggctcagatggaggaggtgcagagaaggggagggggtcagatggaggaggctcagagaagggaagggactcagatggaggagggggcgcagagaagagaaggggctcagatggaggaggaggcgcagagaagggaaggggctcaagatgggaagggggccctggaaagtctcggctctgcttctgtaaaagcgggggagttttcagggtgaaggattgcagtctgcaggctgggatcccccctaatttgcaagccggcttgctctgtgcccaggccccagcctggtgtcctccctctgccctttcctccgctactctcaggaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccacctgtgatcccagcacctcgggaggccgacgttagccagggaaacaagtccaaacttggtctctacaaaaaaatacaaaaattagccgggagtggtggcgcgcacctgtggcccctgtgcttcaggaggccgaggcggaaggacggcttgaggtcaggagttcgagaccagcctgggcaacatggccaaactcagtctctacaaaaatatatatgtgtgtgtgtgtgtgtgtgtgtgtgtgtgtgtgtgtgtatcttgccgggtgaggtggctcatgcctgtaatcccagcattttgggaggccgaggtgggcggatcacgaggtcaggagattgagaccagcctggccaacatggtgaaaccccatctctactaaaaatacaaaaattagccaggcatggcagcgggcgcctctagtcccagctactcaggaggctgaggcaggagaatcgcttgaacccgggaggcggagcttgcagtgagccgagatcgcgcccctgcactccagcctgggtaacagagccagaccctatctcaaaaaaaacttccaaaaacaatacagcaacacatacagatgtaccacggttcgcgtatggagcctcctgttggtggagactgacgtcgttttcaaatgcttttgctatgacagaatcatgtgaatgtttttcatgtttggtttttttctttgagaaaatgataaaattatctcaaaaatatcattaaaaaatttaaaaaagtagagacgggggtttcaccttgttggccagtttggtctcgaactcctggcctcaagtgatccacccaccttggcctcgcaacgtgctgggaatacaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggtttgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgcccaggctggagtgtagtggcgtgatctcggcggctcactgcaacctccgcctcctgggttcaagcgattctcctgcctcagcctcctaagtagctgggattacaggcatgcgccaccacgcccggctaattttgtatttttagtagagacagggtttctccatgtgggtcaggctggtctcgaactcctgacctcatgatcgacccaccttggcctcccaaagtgttaggataacaggcatgagccaccgtgcctggctgagaaacagtagctatcaaacgccggctgtgagccacgtctgtgctgggggttggggacccagcaggcatggtagagccggtcactgagggactcaggcgtgtgattgccaggggaggggcacctggcccagcctggaggtgccaggaagctccagaaagcaactgatcccaaagtccactagcagttaaccagggcagagaaagagaagagccatgcaaaggccctggggctggatcaggacttgtaggttccaggggcagcaagaggcctctgcagttctggggtggcgtgggagccaggccctgggacgccctgacacagctgctgcctgcccagggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctgctcctggtttctgttcattggtgggggagggggctgtggggacgcgtgagtggcaccttcaccggccttaggggcacccaccgcaggtgcactgcctgtgcagatgtcagatgttcagagattccctcaaagcccgggaagcaggggctggtgttatctgcacccgacagcggggtgttggggggaggcccaggttcagagaggttgggtggctgcccagaggtcacacagtgaatgccgcccagcactttgggaggccgaggtgggcggatcacctgaggtcaggagttcaagaccagcccggccaacctggtgaaaccccatctctataaaaatacaaaaattagccgggcatgatggcgggcgcctgtaatcccagttacttgggaggctgaggcaggagaatcacctgaacccgggaggcggaggttgcagcgaaccgagatggcgccactgcactccagcctgggcgacagcgagactccagctcaaaaaaaaacaaaaaccacgggagaaaacggggaacattctcctcttggatccaatagaaacagtaaaacgtgaatatgaaataataaatataattgtatatataaataatacagaataaaatatgaatatgatggctggatgtggcagtcacatctgtaatctcagcactttgggaggccaaggtgggagcatcgtttgagcccaggagtttgagaccagcctgggcaacgtagtgaaaccatgtctctacaaaaataatttttaaaattattaaaattacacaggagaggccgggcacagtggctcatgcctgtaatcccagcactttaggaggccaaggcgggcggatcacgaggtcaggagatcgagaccatcctggctaacacggtgaaaccccgtttctactaaaaatacaaaaaattagccaggcgtggtggcgggcgcctgtagtcccagctactcgggaggctgaggcaggagaattgcttgaacccgggaggtggagattgcagtgagccgagatcacgccactgcactccagcctggtgacagagcaagactccgtctcaaaaaaaaaaaaaaaaagccgggtaagtggcacctgtcgtcccagctactctggaggctgaggtgggaagattgcttgagtccaggaggtggaggttgcagtgagccgtgatcgcaccactgcactccagcgtggtccacagagcaagacccagtctcttaaaatgataataataataataataataataataataataataagaagaagaagaagaagaagaagaagaagaagaagaagaaggaagaagaagaagaagaagaacctgtagtctcagctattgaggaggctaaagtgggaagatcactttagcccaagaggttgaggatgcagtgagctatttttatctcatttatttatttatttgagacagagtctccctctgtcacccaggctggagtgcagtggcgcgatctcggctcactgcaacctctgcgcccccagttcaagcaattctcctgcctcagcctcctgagtagctgggactacaggtgtgagccacaatgcctagccaatttatatatatatattttttagtagagatggggtttcattatgtcgaccaggctggtcttgaactcttgaattcaggtgatctacccatctcagcctcccaaagtgctgggattacaggcgtgagccaccgcgcctgaccttatttcatttatttttgagacacggtctttctctgatgcccaggctggagtgcagtggcgtgatcaaggctcactgtagcctcagcctcccaggcttcagcaaccgtgcccggccttagaattcactcttttaaagtgtgtacagccgggcgtggtggcccacacctataatcccagcactttgggaggccgaggctggcaaatcacctgaggtcaggagtttgagaccagcctgcccaacatggtgaaaccctgtctgtactaaaaatacaaaaaattagcctggcatggtggcatgcacctgtaatctcagctagtcgggaggctgaggcaggagagtggcatgaacccgggaggcggagcttgcagtgagccaagattgagccaccgcactgcaggctaggggatagagtgagactctgtctcaataaaataaaaaataaaataaaataaaatgaagtgtgcaattcaatggtcttcggtacactcacaatgttgtgtggtcatgacctctgttgagttccagaatatttcatcaccgccaaaggaatccctgtccccatcagccgtcactccctgtcccctccccagtccgcggcacccacgcgtcctcttcctgtctctgtggatgggcttgtcctggacatttcatagcaatgggatcacacactatgtggtctttcgtgtccggcgtctctcacggagcgtgacgtcctcacggtgcctccgcgccgtggtcgggtcacagctgggtccgtttcacggctgcgtcctgttgccacgcctggaggcctcactgtgctgctcgaggcccctgtggatggacgtctgagcctctccacttccggccactgtgaccctcactgctgtggacactcatgtgcaggtttgtgttggaactgctgcttttctttcttttgtgggtataacgggtccttttttttttttttttttgagacggagtctcgctctgtcgcccaggctggagtccagtggcgcgatctcggctcactgcaacctccacctcccgggttcacgccattctcctgcctcagcctcccgagtagctgggactacaggcacccgccaccgtgcccggctaattttttgtatttttagtagagacggggtttcaccgtgttagccaggatggtctcgatctcctgacctcgtgatccgcccgcctcagcctcccaaagtgctgggatgacaggcgtgagccaccgcgcccggccaacgggttctctttacagagggggaaactaagcctagagaggggtgccaatggctcaggagcccagccggtgggggccctgcctgggtttggagaggcaaagccactgcctgatcattgttcagatggggaaactgaggcccaaggcaggattggggttcaagggcttctggtgcccccggctcggggccacgttcggtcatgagggtccccctgctggggcgggattcctgccagaggcggtttctgccctcctccccccagcccctgctgctcccccttcctgggcccaagggtgctgttctcgggttcccctggtagcggtcagcccggctgcagggccctcagagcggggctgcgtgtgactgtgggcagcccgagtcctctccgcgcctcggatttcagggacatagaacggggtcccatccgtggacccacccgccaccccgcagccccgtccaggccccgacgcgtgcagcccccaccccgcagccccgtccaggccccgacgcgtgcgtgcagcccccaccccgcagccccgtccaggccccgacgcgtgcagcctcctggcagagccagctgtgctcaggctaaaaacagctgttctgtttcttctctgtgcccctctacccggccccactcactggtgtcttgagaaggtttttaaattttcggaattctcagaacagattgtgaaatgtctgggtttggcttagaaatcccgtgagagggggcatcaggggacaggtgggtggatgggcctggggggtgtggaaggcggccgggtgtcagggccccaagcacacgggaaggtcaacggtcggcacaaaacacacacaaaacacaaccactgcgaggctgagcctcgcgggcgaaccagcatcttcccgtcactcagggagagaaggttttcctttataaagaggagaggaaaggaggccgggcacagtggctcacgcctgtcatcccagcactttgggaggccgaggcgggtggatcacctgaggtcaggagttcgagaccagcctggccaacatggtgaaacctcgtctctactaaaaatacaaaaattagctgggtgtggtggtgggcgcctgtaatcccagctattcaggaggctgaggcaggagaatcgcttgtacccaggaggcggagcttgcagtgagccgagatcgcgccactgcactccagcctgggcaacagagcaagacttcatctcaaaaaaaaaaagaaagaaagaaagaaaaagaaagtagtagaggagagaaaaaagagagaacaagaaagatggagagacagagacggacagagacacagagacagagagagacggaaaaagagggacagagccagagagactgagagagatagttttaaaaaagggagacagcgatgacacagagagacacagacacagacacagagatgaagagacagacagatatagggagacagagacagactgagacagagagacagagacagagggagacagagacagagacagagaaggagacagaaagagggcggggagagagacagagacagagacacaggcctgagccccgcatgggtctcccctcggccccaggcggcgtcacctgcgatccctgaagccgttaccagttgcgccacctacggttggtacaggaaggggcccccactacctctgcccccaggccgacccctgcaaagcccccagcgtgttccacggaaccctccctgctacccgctcccagcgctcctgtcgccctggcctgtgcttttgagtccccccaggacgcacagggagcctggaggacccggggcccgcgggacggtgctgggaccctccggtcaggaccgggctgcatcagccttgcgtggaaacagatcctgacggggaagcccacgtacagtgaggacggggcagccccctgggcagctctcgcgtgtgctagatccagcagtgtgtgtgcaaggtctttcttttctttcttttcttttttttttggttgacagctttattgagatgtccttcacacacaccaagcaattcacccacttaacaattcggtagtggccagatggtgggggaggatcgctggagcccaggagttccagacgagcctgggcagcatagcaagacccctctctattaaaaaaaaaaaaaggcagggcgcggtggctcacgcctgtaatcccagcactttgggaggctgaggccggcggatcacctgaggtcaggagttcgagaccagcctggccaacatggtgaaatcccgtctctactacaaatacaaaaaacaaattattcaggcgtggtggcaggtgcctgtaatcccagctacttaggaggctgacgcaggagaatggcttgaacccaggaagccaaggtcacaccactgcactccagcctgggtgacaagaacaaaactccatgtaaaaacaaatcaagaaacctcaaatccgtcgacccccactgctgccctgcagaaggtcctattaccgtcctcacccgcctttacaggtggggaaactgaggactgcaagccaaacagcttgcctcagcatgagctgactcatggctgaaaccaacagcacttttgttgaatgagaataacccttttattttgagacggtgtctcgctctgttgcccaggctggagtgcagtgacgcgatctcagctcactgccccctccacctcccgggttcaagtaattctcctccctcagcctcccaagtagctgggattacaggcatctgccaccacacccagctaatttttgtatttttagtagagtcggggtttcaccatgttgcccaggctggtcttgaactcctgaccttgtgatccatctgcctcagcctcccaaagtgctgggattacaggcaacagccaccgcgcccggccacagctctagttctttttcttttttttttttttgagacggagtctcgctctgtcgcccaggctggagtgcagtggcacaatctctgctcactgcaagctccgcctcccgggttcacgccattctcctgcctcagcctcccgagtagctgggactacaggcgcccgctaccacgcccggctaattttttgtatttttagtagaaacggggtttcaccgtgttagccaggatggtctcgatctcctgacctcgtgatccgcccgcctcggcctcccaaagtgctgggattacaggcgtgagccaccgcgcccggcccacagctctagttctttaatacacatcaggtcggtcatggtggctcatgcctgtgatcccagcatttggggaggtcaaggcaggagcgtccctgaaggctggcagttcaagaccagccagggcaacatagcaagaccccatttctacaaaaaattaaacagccaaccaaaaaaaaaaaaaaaaagaaagaaaaactttagctggacatggtggagcatgcctgtggtcccagctacttggggggttgaggcaggagaattgcttgagcccaggaggtcgaggctgcagtgagccatgattacaccactgcactccagcctgggtgacacagccagaccctgtctcaaaaaatatatatgtatattttaaaatattatatattatataatgtaaataatatacatgctacatattttatgtatacatctatgttatatacattaatatagccaggtgcagtggctcacacctgtgttcccagcactttggcgggattacgggcgggtcacctgaggtcaggagttcgagaccagcctggccaatatagtgaaaccccgtctttactaaaaatacaaaaaaaaaaaaaaattagccaggcgtggtggtgggcgtctataatcccagctatacaggaggctgaggcaggagaattgtttgaacccgggaggcggagattgcagtgagctgagatcgcaccactgctctccagcctggtgacagagcgagactctgtctcaaaaaaaaaaaaaaatccaaaggggaaaacagtaactggacagtgcaggaaccggcagatgccctgaccacgtggtcaaggttattaccatcagcacgagacaggccgaagccatgggcttcgacgtggggggcctgagacagacacacgccacgcccgggactccctccattgagtcctgaggccacccaggaccatccccacggagggacgctctgcagagtgaccaccagctctcctcaatggtcccaagggctgagggagggcagagggactgcgcccgctggaggagaccctgacatctgaagatgggtggcttgtgtacccaggacccagcaaagggtggctggtgatactcagggggctggggcagagggggccatttggaatcaactttcgcgccctggcttcgatcacagcctggagggttgagcaagaggacagaatttagggaagctgggggagggaggccgggggagggagtttggggagcggggagggagtttggaccctttggacttctgtaagcgtgaaatcctttccaaatgaaacgttaaaaagctttttttctttttggcctccaagttcattcagtgcttctctccatttcactgtaggtttaaaccgttcagttataaataaataattttatcctctgtcctcggctttcccccgtttccggcactgcagacatgggggctggatttgtctctgcggcggggccatcctgggcactgcagggccctgccaggagctccctccaagtcgtgacaaccacggatgtctccaggcctcacacagggacccctgggggcagaatcaccccagggttagaggattccacagaccccaagagactctgagtcccatgatcctctgccctgctgaggtcccaggaggctgcacacattgaaatccacaccctgagtgggagggagagaggaggcgagtcccgggagctggggtcccccgggtttatgccgtacgccccatcgggagtttattctggtgtccggtgtgagcagggggcagactggattttttattttttatttttatttatttatgttttgagatggagtcttgctctgttgcccaggctggagtgcagtggcacgatcttggctccctgcaaccttcgcctcccaggctcaagtgattctcctgcctcagcctcctgagtagctgggactacaggcgcccgccaacacgcgcagctaatttttgtatttttagtagagatggggtttcactatgttggccaggctggtcttgaactcctgacctcaggcgatccacccgcctcggcctcccaaagtgctgggattacaggtgtgaggcaccgcacctggccatttttttccccaaataatgaacactggtctctcccctgggccctgtggacatcggggctggatccttctctggggcaggcccgtcctgggcactgcagggtgctaggcatcatccttggcctccacccactccatgccaggagctcccctttcgtgacagccacaggtgtcctcagacctcgcccagggtcccctgggggcagaatcacctcttgattgagaatcctggccttaaagggggaagaaaacccccagacaaaactggcaggaggatgttcgctggggcctcaggtgaggcactgagggcactcgtggtggggccctgccttcccgagctctgcatcctgtcccctgctacgtcctgctgtctgtccgtttccagctcacccacccacgggacacacctgccacggccggctttgctggggccacagggacctcgtcagggaggcgtctccttgtgggtggcacgtgggcatgtgttgctctgagggctgtggccatgttgcccacctggccagggacccccgacttgggtgggtgacagccagcctccccgcccccacaaaggttgggaccttgagcccaaagcccccacctcctccccggagtccgttctgactcccaggctcccaaggcaaaaggaggaagtggggacccagcctgggcattgggcaactcaacggcctctggcattgggctataagaggagcttgaccgtgggtgcaccctggaccccaccatggctcaccggccccccagccctgccctggcgtccgtgctgctggccttgctgctgagcggtgagtgagccacgtgcccatccatccagcctccaggccccggtggattgtggggaaatatccaccacgaggtccatccaaagcccttctggcacagctggggaaactgaggcagggtcaggggagactccactcactgctcgggaccaacgcttgcaggggtggggaggacaagggcaagggggagccctggccatttgactcagttgcctatctgtaaaacgggcaaaacccagcccttccctcctgaggagctgttttgggaattagctagtaacaggcgaattcctggacagcacccagccttcagcaaatgctcagtgaatatgcatgaatgaatgaatgagtgaatgaatgagtgagtgagtgaatgagtgaacaaatgaatgagtgaatgaatcaatgagtgagtgaatgaatgagtgaatgagtgaatgagtgaacgaatgaatgagtgaatgaatcaatgagtgagtgaatgaatgagtgaatgagtgaatgaatgagtgaatgagtgaatgagtgaacgaatgaatgagtgaatgaatgaatgagtgagtgagtgaaagggtcgaggagttagtgatgctggaatcaggggaagaagagagcatgggccccctcaggtccctatcctgagggtgattttctttttctttttcttttttttttttttgagacggagtctcgccctgtcgcccaggctggagtgcagtggcgcgatctcggctcactgcaagctcagcctcccgggttcacgcctttctcctgcctcagcctcccgagtagctgggactacaggcgcccaccaccatgcctggataattttttgtaatttttgtagagacggggtttcaaggtgttagccaggatggtctcgatctcctgacttcgtgatccgcctgcctcagcctcccaaagtgctgggattacaggcgtgagccaccgcgcctggccctttttttttcttttttgaaacggaatcttgctctgtcgcccaggctggagtgcagtggtgcaatctcagtttactgcagcctcagcctcctggggtcaaatgattctcctgcctccgcctcttgagtagctgggattacaagcacacaccaccacacctggctagtttttgtatttttagtagagatggggtttcaccacgttggtcaggctggtctcgaactcctgacctgagggggattttcaatgcctcagtttgttcatctgcaaaatgggtctctttgttggctgatttttttttttttttttgcttctttttttttattttgttttgttttgtttttttgagatggggtctcactcaggcatgagccactgcgcccaggattttttttttttttttttttttttgagacagaatctcactctgttgcccaggctggagtgcagtggtgtgatctcggctcactgcaacctgtgcctcctgggttcaagcgattctcctgcctcagcctcccaggcagctgagattacaggtgcgaaccaccacacctggctaattttttttttttttttttttgagacggagtgtcattctgttgccaggctggagtgcagtggggcgatcttggctcaccacaacctccgcttcctgggttcaagcgattctcctgcgtcaacctccggagtagctgggactacaggcacgtgccaccacgcccagctaatgtttgtatttttagtagagacagggtttcaccatgttggccaggatggtctccatctcttgacctcaggtgatccacccacctcggcctcccaaagtattgggattacaggcgtgggccaaccgcacccgaccaatttttctgcttctttaaaaacatttttttaaattttgttttagagacagggtcttgctctgttgcccaggctggagtgcagtggtgtgatctcagttcactgcagccttgacctcctgggctcaagcgatcctccctcctcagcctcccaagtagctgggacgacaggtgcacaccaccatgcctggctaattttaaaattttttgtagagatggggtcctcacaattttgcccaggctggtcttgaactcctgagctcaagggagcctcctgcctcggcctcccaaagtgttgggattacaggcgtgagccactgcacccagccacctggtctgcgtcttaaaagccttcctgactctcaggactgaaagctgccaccagggcgcctttggaaatcgtcgtaattataacccccccggcctgggcgctgagtccttcccaccagccagcaggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacatgtgagcggccgcctccacacccctgtccgcccgccccgccctcttcctccagccctggcccggccactgtccctctgcccggggaggacccagctaagccccgtctgcagaccccaggccccgcgcgcgtgggcagttctggggggaggcccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccaggtgggcgggcagggccgcgagggctcggaggggcacggccagagggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggttgggcactgtggctcacgcctgtactcccagtactttgggaggctgggatgggaggatcacttgaggccaggagtttgggagcagcctgaccaacctagtgagaccccatctctataaaagacattttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatggcaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggagggcggcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggcgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctacgaaagacctcagcccctccctgctcacactttttgtttgtttttgagacggagtgtcgctctgttgtccaggctggagtgcagtggtgagatctcagctcactgcaacctccacctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctggctcctgtctgtccttcccatatagggaggggagggggaactgcccaccgtgacctcaataaacgttgaaactccccctggctcctgtctgtccttcccatatagggagggaaccagggagaggtcccctgggttcaagtccccgagccccaaactcaggatggggggagtcggagcgggggatgggggcccaggttgcagggggtctctctcctggatgctcgtggctgtgggttctaacccggccccatcagggtggccctgggcaggttgttattcatctccgtgcctcagtttcctcatctggaaaatggactcgccccagacgtttcctagaactgtccctgctggctcagggactccttgaggaaggggatggggatggggaagcagcctggggggcttcctggaggaggtggcagtgccagagctgcatatcaaggtgtgaacagaaacatccgaagggctgccaggcagggggcacagtccaggcagagacctgagggctagaggccaggggacggggaggagggcaggcaggggagggatgtgggtgcaggggaggggtaatggggttggagcgctatttctcgtaggaggggtaggcagggcaggagttccctggtagaagcatgagcaatgaactgggtgggggggtggccagaggggaggtccgaggcggggaagaggtgggactcacagtccagctcaaagacgggcaagtggccactagaaggaggcattagccacagagaggggacgacctgctccaggacacgtgtagagaagaaatgaagctcattgctggtgttttttttttctttttaatatttttttgagacagagtctcgctctgtcacccaggctggagtgcagtggtgtgatctcggctcactgcaagctccgccacccgggttgaagcgattctcctgcctcagcctccggagtagctgggactacaggcacagaccaccacgcccagttaatttttatatttttagtacagacagggtttcaccacgttgtccaggctggtctcgaactcctgacctcaggtggtccacccgcctcagcttcccaaagtgctgggtttacaggcgtgagcctacttacttatttacagctggcctacttatttatttttgagacagggtctcactctgtcgcccagtctgtagtgcagtggtgcaatcttggcttaccgcagcctcaacctcctgggctcaagtgatcctcccacctcagcctcccgagtagctgggactacaggtgccaccacacccagctattttcttagtttttgtagagacggggtctggctgtgttgcccaggtgggtcctcagtgactctttacatatgaacacctccaggtcactgtaatcttagcaatctcctggcctcccagaagaccccacgtccccctcggagtctacacccgctgtgaccataacacccctaccttccctgccacagttaatggtgaaccagctctcaaagcaacactttctttttttttttttttttttttttttttttgagacggagtctcgctctgtcgcccaggctggagtgcagtggcatgatctcggctcactgcaacctccgcctcctaggttcaagcaattctcctgcctcagtctcccgagtagccgggattacaggcaggtaccaccacgccaggctaattttgtatttttggtagagacggggtttgtccatgttggtcaggctggaattcccaacctcaggtgatacacccgcctcagcctcccaaagtgttgggattacaggcctgagccaccgcgcccggccagacaacactttcttagctaagaactttatgaacgtgaatttatttcatcctcttgacaggtttatgtgatggatcctacgattataattttacagaggaggaaactgagtcacggagagtttatttcaggggcctgaagttacacagtggccaaatggccacaccagaaccaggatatgaacccagcgtcggcacacttaataatgactgcacgtgagaatgtagtatacagctggtgctcaataaatgcagctgacgccaagtctgatctccgtgctggaggccaagccccttccaaagatacggcgtcccccacccctgaaatccccccacccccgacttgaaacagggctgtgtagacagtaggcgcttactaagtgcactgtggtgatgttaaggcagcaaggtgggaaccctgccaaaaggggaggggagaaggcagggtagtgtgtgtctgattaagctgaggacagggcagacatggactgagcgcctgctgtgtgccaggctctgggagggcagggccattgtctccctaacccgagagccatgggggtccacttgcctgtggtcacgtcaggactccagcctggcccaggctctgcgtgtccccgggtgccctcgccccgcctattcctggagacaggcccgttggttcccttcccctccccttgtcctggagccaggaggacgttggttcttgcgacagccttggcccggccgttgcagctggaacatcgtgggggagatgggaagaggaacggggcccggagcccggggctgggtcctgggaatccctttcccgcagctgggactccagctcccctgccagttcctccaggcggaagccctcaggcttggtcctcactccagcctcccggcctggacaggaattctctctccagcagccctgccagatgcccgcccagcccctgcctcaggcggggagggcttcagggaagctcaccaaggcagaagggcgggagagattgtcagagccccagctggtgtccagggactgaccgtgagcctgggtgaaagtgagttccccgttggaggcaacagacgaggagaggatggaaggcctggcccccaagaatgagccctgaggttcagggagcggctggagtgagccggccccagatctccgtccagctgcgggtcccagaggcctgggttacactcgcagctcctgggggaggcccttgacgtgcctcagttcccaaacaggaaccctgggaaggaccagagaagtgcctattgcgcagtgagtgcccgacacagctgcatgtggccggtatcacagggccctgggtaaactgaggcaggcgacacagctgcatgtggccggtatcacagggccctgggtaaactgaggcaggcgacacagctgcatgtggccggtatcacagggccctgggtaaactgaggcaggcgacacagctgcatgtggccgtatcacagggccctgggtaaactgaggcaggtgacacagctgcatgtggccggtatcacggggccctggataaacagaggcaggcgacacagctgcatgtggccggtatcacggggccctgggtaaactgaggcaggcgaggccacccccatcaagtccctcaggtctaggtttggcaggtttggcaaaaacacagcaacgctcggttaaatctgaatttcgggtaagtatatcctgggcctcatttggaagagacttagattaaaaaaaaaacgtcgagaccagcccggccaacacggtgaaaccccgtctctactaaaaatacaaaaaattagccaggcgcagtggctcacgcctgtgatcccagcactctgggaggctgaggcaggcggatcacccgaggtcagatgttcaagaccagcctggccgacagggcgaaacactgtctctactacaaatacaaaaattagccgggagtggtggcaggtgcctgtaatctcagctattcaggaggctgaggcaggagaatcacttgaacctgggaggcggaggttgccgtgagccgggatcacgccaccgcactccagcctgggcgatagagcaagactctgtctccaaaaaaataaattaaaaaacccacattgattatctgacatttgaatgcgattgtgcatcctgaattttgtctggaggccccacccgagccaatccagcgtcttgtcccccttctcccccttttcatcaacgccctgtgccaggggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggtgagtttttgagtccaacctcccgctgctccctctgtcccgggttctgttcccacctctccatagagggccccaccagtgtgggtccctcatcctcacaggggaggtgccagctgggacaaggagaccagaagagactgaggttctgagcggtgaagccaccaccaggagcccagagttggggtttgaaaaccggggagggggggggggtcgcaggtcgccctctgggttcaagtccaggtctgtctgtgccttggaggggcaccgtggggaggtccctttgcctctccgtgcctcagtttcctcatctgaacaacaggggtgcgaacggccccgatcccgtgggttcccggtgggggatcccgtgggttcccggtgggggatcccgtgggttcctggtgggggatccagaggccccgtggccgggaggggacaggctccttggcaggcactcagcacccgcacccggtgtgtccccaggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtgtgagtagccgggagtgtgcgcgcccggctcggaccccgcgtcccggtctgtgaggtgggtggggggaggccggggccggggctgctggcgggggggggtccgtccagggcccgcggggcccctcgagcaccttcgccctcaggcccgtcgccggatggggacgacaaggcgcggctgagccccgacccccggggccgcccctgagccccgcctctccctccccggcagaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccaggtgccgccgggcggggcggggggcgcaggggcggaggccagaggcctggggagggtggaggctgcgacggaggggcgcgtcggggccgctcgtggggacctggggtggcatcgtgggctgggtggtcccctctccgcgcctcggtctgcacctctgtgaaacgggaaaatacccgccatgggccgttgaggggttaaatgagatcctgcagggaggccccgatctgctgtcaatcaacaaacttactgagaagggaggccccgatctgttgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagattctttgtgtctctccattcaccagtcctgtggcccagggcaggggccgcctctgtctttgggaaaaggggcaaaagtccccacctttccacccctgtccgcggcttgcagttctggttatttcctgggcgccgggccccgtggctcaggcctgtcatcccagcactttgggaggctgaggcgggtggatcacgaggtcaggtgttcgagaccagcctgagcaacatagtgaaaccccgtctctactaaaatacaaaaaaaaaaaattagccgagtgtggttgtgggtgcctgtaatgccaactactcaggaggctgaggaaggagaatcgcttgaaccccggaggcggagattgcagtgagctgagatcacaccactgcactccagcctgggtctcaaaaaaaaaaaaaaagattcctccctgggaagggttagagggagagtttccttgtcactaagttttctcatagctctcacccagtgcagtggcgcgatcgcagctcactacagcctccatctcctgggctcaagccaccctctcagcttggaatggggggtagctggaaccacaggtgccaccacgtgggtccaccacgtctggctaatatatatatatacacacacacatacatatattataaataataaatatatattttatttaaataaaatatataatatttataattattttataattataataatatttatataattataaatatcatttataattataatatttattattttataaaataataaatataaaatatataaaaatatttttataaaataataaaaatatatatatacacacatatatatatattttttgagacaagtctcgctctgtcgcccaggctggagcgcagtggcacaatctcagctcactgcaacctccgcctcccaggttcaagcgattctcctgcctcagcctcccaggtagctgggactacaggcgcccgccaccacgcctggctaatttttggtattgttagtagagacggggtttaaccatgttagccaggatggtcttgatctcctgaccttttgattggcccacctcagcctcccaaaatgctgggattataggcgtgagccaccgcacctggcaatttttttttattatttttgtagacatggggctttgccacattgcccaggctggtcttgaatgcctggcctcaagtgatcctcctgcctcgccctcccaaagtgctgggcttacaagcatgagccaccgcgcccggctgtagtttttttgttaactgagcacctactgcttcctgcactcaagccacatccagggacaacctccaacgccctgagccttggtgacggctcccactctacagatggggaaaccgaggcttgccttggggagcagagtgtggggtgggtatcctgccctgcaggatcccagaaccacagtggaacctgagatggggaaactgaggcccggagaggggagggtcatcatcactgccccgtgtgacgcgctgacgatctgtccccaccgccacagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcgtacgtgccctgggtgtccctctgctccccacccgctcccagcccggactgcagcaacaggcaccgtggctagaccctaggagggacttcccaaccctgacaggcggcgggcaggtgggcagggcctcgcagtccagcttccccaccttgtctgcctccacagggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaatgtgtttgatgctccttggctgtgtgattgggtgttgaaaatggtcagtaggtcgggcgtggtggctcacacctgtaatcccagcactttgggaggttgaggcaggcggatcacttgagctcaggagttcaagaccagcctgggcaacatggcaaaacccccgctccattaaaaaaaaataaataaataaaataaaataaaataaaatggtccaagcctggcccagtggcttacgcctgcaatcccagcactttgggaggccgaggctggcagatcacctgaggtcgggagttcaagactagtctgccaacgtggtgaaaccccatctctactataaatacaaaaaaaattagcttggcgtcgtggcgcgtgggaggctgaggcaggagaatcgcttgaacctgcgaggcgaaggctgtagtgagccgagattacgccactgcactccagcctgggcaacacagagagactccgtctcaaaaaaaaaaaaaaaaaaaaaaaataccggtgcggtggctcgtgcctgtaatcccagctctttgggaggcccaggcaggcggatcatctgaggtctaaagttcgagaccagcctgaccaacatggagaaaccccatatctactaaaaatacaaaattagccgggcgtggtggtgcatgcctgtaatcccagctactcgggaagcctgaggcaggagaatcacctgaattctggaaggtggaggttgcagtgagccaagatcgctccattgcactccagcctgggcaacaagagcgaaactccatctcaaaaataaataaataaataaataaataaataaataaataaataaataaatataaataataatgataataataataataaacaacaaactagaatccagagtctcttgggcatctctggagtaagccaccaccagggggcagcacagccagggcaatggagcagaagtgacttccccacattgtgtttttttcttttttgtttttagatggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctcattttttgtatttttagtagagacggggtttcaccgtgttagccaggatggtctcgatctcctgaactcgtgatccgcccgccttgacctcccaaagtgctgggattacaggcgtagccaccacgcccagccctgttgttatatcattttctattctctgtgcgtatgaaataatccacagggggccaggcatggtggctcatgcctgtaatcccagcactttgggaggccgaggtgggcggatcacctgaggtcagaggttcgagaccagcctggccaacatggcaaaaccctgtctctactaaaaatacaaaaagttagcccagtgtggttgctcatgcgtgtaatcccagctactcgggaagctgaggcagtagaatcgcttgaacccgggaggtggaggtcgcagtgagccgagattgtgccactgcactccagcctggacgacagagcaagactctgtcgcaaaaaaaaaaaaaaagcaagaaagaaagaaaaaaagaaggaaagagaaagaaagaaagaaaaagaaagggaaagaaagagaaaaacagagaaaggaaggaaggaaatgaggctaggcgtggtggctcacacctgtaatctcagcactttgggaggccgaggcaggcggatcacgaggtcgggagatcgagaccatcctggctaacacggtgaaacccatctctactaaaaatacaaaaaattatccgggcgtggtggcggacgcctgtagtcccagctactccggaggctgaggcaggagaatggtgtgaacccgggaggcggagcttgcagtgagctgagatcgcgccactgcactccagcctgggcgacagagcgagactccgtctcaaaaaaaaaaaaaaaaaggaaagaaaagaaagaaatgatccatggtgaagagaaaagccgggggaacctcgtgtgctgctccccctggggacaatgtctgaggtcctccccacaaggtatccccatccttctggtccccgcaccatggattaatgcaacgtgaatcccgctggcccctgtggggcagatgtgaaaaatggagctacaccatgagcaggcctgcagtcccagcacttctggaggctgaggtgggaggatcacttgagccccggaggtcgaggaggctgcagtgagctatgattgcaccgctgcactcgagcctggatgaaagagcaagaccctgtctgtaataaaacaaaaacaacacacacaaatccccacctcacaaaaggccctatggcccagattctgagaagtattttattttaatttttttgtagagatggggtctcgccgtcttccccaagctggccttgaattcctgggctcaagagatgctcctatctgggtctctcaatgtgccgggatggtaggtgggagccactgtgcccggccagccctgactctgttcatcagaacctgccctcagtgaacagtttgggagggggcgtgtgatccaggctccaccaacccaaggcacccttgagacttggctggagtgaggaagaattttaggaggggcccactgagccactgggttgagtgtggggtccctggaaacacaccaggggaggctggtgaggaaagaagccatcagagaagaaaggagaagccagaagcagacactggacattgttcaggcacctggatcaagccacacctgaaggcggacatccctgaactttccatataactttcatgattcaggctccacccagtttgtctgggttttcctgtcccttgtagccagtcttcccagctgcctctgccttggcctttccaactttctattcgtcagggtgtcaagccccagaggccacagggacagagacaaaggtgtcaagtgaccttcctacccccaacagaccttctctctaatatagaggaggaaaagaagggagggtagcaggacaagaaagtgggttgtttacacgctgtggcctccagctaggattgtgaaacaccctgggggactctgggtgtggtgaagttggggccggggtgggtgcagcccccctctctgcctcctgcccatctgagggactgccccccaccagggccagcaggctgtcaggctcacagaggcccgagggtctcccagcgacttgtcgactctggtgtgagtctggcaggaggtaacccagtcccggggagggcggaggctgggcgggcgagttcccctttccccagctgggccgctgcccacccggggagcggcccgccccctccaccctcataaaagcacccccagggccctgcctgggtcagtgtctcagccacagcggcttcaccatgcacagctgggagcgcctggcagttctggtcctcctaggagcggccgcctgcggtgaggaggcctgggcctggggtgagggacagggctgtgtaggggcgtggtgctcccttccgtcacacggacggtcctccagcccctccaggtgggcaggaagggggtgtctctcctcactaatggaaggctctgaacgctgaaaaattctagaaaattcagattggaaatcggaactttctggagtcagcttttcttgcagacagagtctgaacgtctgcgtggaaaacttcatctgcgtggctgactgggctggcccaggcactggctgggtcagccccatttctcttatgtccaactggaaggcactgcgcccagggtagggcgctgggatctgcccccggtccccagcccactgtgggttctgtactctggggcattcccgcccgagggtatctgagtttgcaacgctgaggggccccaagacggaaacgggattcttttttttctttctttttttttttgatagggagtctcgctctgtcgtccaggctggagtgcagtggtgcgatctcggctcactgcaaactccgactcccgggttcaagcgattctcctgcctcagccttccgaatagctgagattataggccacgccgactaaattttgtatttttttttaaagtagagacggggtttcaccatattggccaggctggtcttgaactcctgacctcatgatctgcacccccccctccccccccgcccccgcgcggcttcacaaagtgctgggattacaggcgtgagccaccgcgcccagagatgggattcttgcggggagcggcctggggggtgagagctgggatcccgtcaggcagcctcgcccgggggaggagtccaccccgcggccctcacgcgcccgcccacccacagcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcgtgagtgcccgcgccgcgcgggggaagagcccgggtgcggtggggggagtcggctggcaccgaccgcggactccgtccggtccccagggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacaggtcggccccgtgtagcgcagtccctcctgcggcgctgggatccccggcccaccctcactccaccccgcctacaccgcgccccgggtccagcctcgacctctcctgctgcatggggaccccgccccacaacccccacaccctcaccccgggtctagcctcgacctctcttgctgcgctcggagcccccccaccctctgcaccctcaccccgggtccagcctcgaactctcctgctgcatggggaccccgccccacaacccccacaccctcaccccgggtctagcctcgacctctcttgctgcgctcggagcccccccaccccctgcaccctcaccccgggtccagcctcgacctctcctgctgcatggggaccccgccctacaacccccgcaccctcaccccgggtctagcctcgacctctgcggctgcactgggagccccccaccccccgctccccctgcatccccatcccggttccagcctcgacctttgcagctgcactggtgagcctcgcacccaccccatccccacctgcacccccacccagggtctagcctaaatctctcctgctgcactgagacccacgcccctgccctgatgcccacctcccccgtcccgtctccccgagcctagcggcattctccccagcctcgcacccccgcaccccaaccctgacgtccgcctccaccctcagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaaggtgagccttcaggcctgggaggagacgcggggcctgcaggccccgggaagggcctgcagagggagcgcgaagcggggggcaagtaggaacagggcccagggaaggggcggggcgcgtagggggcgggaactggaagatgggcggagcatgagggtggcccgtgggcggggcctgtatgagggggcggggcatgtgggtagggtggggccttgggggcgaggcctggagaaggtacggggcctctggagagggtggggctgaagaagggtcagggcgggcagaaagggcaggaacgggtgggatgtggaaggacctgtgggttagggtgggaatagggggcggggctcgaggagggggcggagtccagtaatagcgggactgcaagggggcgaggccaggaagagggttggggcatgaggggcagggcatggaggaaggggcggtacctgtggggagggtggggctggagaagggtcagggcgggcaaaagggcaggtggcagagaaagggtgggaggtatagggggcgggcacgtggaggaaggggcggggcatggggacggggcggggcaggtggaaggggcgggaacctctgaaggggcagggctggtgcggagcgggatccctgctgtggcagggaagagaaggggtcctgagcagggcagaggtttaagaccagccgaggcttgcatggtagccggggccaagattgggtggggcttaagggaggggcgtggcctgaggtgagtggggactgagcagagcaggtggccactgagacgcgttagggcagaagtgggatccacggcaagtcaaagcttggaagagcaggaatgaggtgtgggacccccatactggaaagggcttggagcggggtggggtcgggggaacacgtggtgaggttgaggccagagggggtgtggccaggagctgggggcgggcctagaggggcgtggcttgtggttgtggcctaggcgataggcgtggcgcggggctattgactagtgaagaccaaattaacacgggagggatgagcgagcattgtggggcgggagcggcagccaggtgagggggtctaacacgtgaggccggggtgggcgcgggccgcccctcacggccccgtcctgttccggcagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaaattctgcgtggtggctcacgcctgtaatcccagcactttgggaggccgaggcgggcggatcatttgaggtcaggagttcctgatcagcctgaccaacatggtgaaaccccgtgtctactaaaaatacaaaaaaaaattagctgagcgtggtggtgggcacctgtagccccagctactcaggaggctgaggcaggaggatagcttgaacccgggaggcggaggttgcagtgagctgagatcgcaccactgtactccgacctgggtgacagagcgagactctgtctcaaaacaaaaacagaaacattaaaaaaagaggaacgcgggaagctacagataaaagcgcaagaacggagaatacagcgaagttccgggtccagcgcttccgtggggctgacgcggccacacggcggcgcccttgccacacacacacacacacacgcgcgaaggcccgccaggcatgggtgtcccctcctggtctggctcataccgtttccctttgcttaccaaggggaatgtgagcgtcttctgtgtgcaaggctgtgggctgagactcaggtgcacagaaacccttcgaggccgtgttcctatgacccatatcccataaggggaaactgaggctcacagggactgtgcgactctcctgaccttacacagaagctccaggacacagcctggactggagcccagagccacggagcctgccttcacaaaccaccctgggtgcggccagacccacaccaggacgacgagcagcggcacctgcttgctggaggccctggacctcaggtcacccttcttggcaaggccagggaggacacctgaggccctgtgccctttctcccacctggtggaggggcagccaggcgctatcgtagaaaaagactgatgggccaggcgcggtggctcatgcctgtaatcccagcactttgggaggccgaggcgggcagatcacaaggtcaggagattgagaccatcctggccaacacggtgaaatcccatctccactaaaaatacaaaaaaattagccgggcgtggtggcggatgcctgtagtcccagctacttgggaggctgaggcaggagaatagcttgaatccaggaggtgaagcttgcagtgagccgagatagcaccactgcatttcaacctgggcaacagaaggagactccatctcaaaaagaaagaaaaaaaaaaaaaagagaaaagaaaaagtgactgatgggccgggtgccggtggctcacgcctgtcatcccagcactttgggaggctgaggcgggcagatcatgaggtcaggagatcgagaccatcctggctaacacggtgaaaccccgtctctactaaaaatacaaaaaattagccgggcgtggtggcaggcacctgtagtcccagctgctcgggacgctgaggcagaatggcgtgaacccgggaggtggaggttgcagtgagtggagatcacaccactacactgcagcctgggtgacagagcgagattccatctcaaaaaaaaaaaaaagactgatgatctgagaggcaggtccgctgggaaaaggggggatggattgatgaacactgtgcttgggtgtttttggggctatggaacactcacctaggaatcacactgacgtgcaagcacgtattgagcacttactgtgtgcagagccctgggccgggcacggtaagacacatctaagccccagccctgctcttaggaatttggtaaatactgcactgcacggaagggggcccattcagccgtctggtgaccaccacgaagttggagctcactgtgtgaatttcacgtttttgtttttgttgtttttgagacggagtctctctcgtcgcccaggctggagtgcaatggcacgatctcggctcactgcaacctctgcctgatggttcaagcgattctcctgcctcagcctcccgagtagctgggattacaggcatgcgccaccacgcccggctaattttgcatttttagtagagacggggtttctccatgttggtcaggctggtctcgaacttccgacctcaggtgatccgccccccctcggcctcccaaagtgctggagttacaggcatgagccacctcgcctggccacccagctaatttttaagatttttgtagagatgaggtctcgccatgttgccccaggttggtcttgaactcccaggctcaagtgatcctcctgcctgggtctcttatggtgctggtgcgtgagctgctgcatccggcctgcctgggcatctttgcatcctttggtccgcaggagctacggagggttccggaggaggagacggtttaggaggcggtggaacaggagtggtggggaggatgcaggacgggaacatctgggcaccacatagtcctctgagttgagacgcggtccagtctccgcactgccatatatatggcctctgtttcctcatctgtatctcggggccccaacgtccctggctcttagggagattttgaggacccctgggggaaccgcgaggcgacgaggaccttgggaagccgggggcggggacagcagagcttcagggccacaggccgcctctcagcacccccatgccctgcctgcctcgcccaccccactgtacctgagtgaggtagaagctcatgacagccagcttgtgacagtggtctgacagaccccccccccacctagtgacgcaaagcccaccccggctcaagtggtcaggaactgatgggaccagggggcatcctgtccccactccacgcgtccagacctcagccaggtcaccagaaccacggggggctggggtcagctagaggcattttcacttctgagtcgggcactgggtgactctgatctcccggcccctgaagctgcccacgagcctgcgtcccacaacgcatgggcaccctcaccagtgctcccatctcctccccgtccacccgccgcaggcctgcacccctcgccagcgctcccatctcctccccgtccacccgccgcgggcctgcacccctcgccagcgctcccatgtcctccccgtccacccgccgcgggcctgcacccctcgccagcgctcccatgtcctccccgtccacccgccgcgggcctgcacccctcgccagcgctcccatctcctccccgtccacccgccgcgggcctgcacccctcaccagcgctcccatgtcctccccgtccacccgccgcgggcccgcacccctcaccagcgctcccatctcctctccgtccgcccactgcgggcccgcacccctcgccagcgctcccatctcctctccgtccacccactgcgggcccgcacccctcgccagcgctcccatctcct

SEQ ID NO: 36440 - DNA, 25565 bp, Homo sapiens
gctgactccagtgtcccgagaggcgccgcttcttccgctttctcgtcaggctcctgcgccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaaggggtgagtacagagcgaagcggccggggctgcagcctaactaaggaggggagctctcaccaccggtgtgcttacttctcttctccctgtaccccaacctttgcagggcggccagatcctgagagtctctacggccttgagctgtctcctaggcctccccttgcgggtgcagaagatccgagccggccggagcacgccaggcctgaggtaaatctggctggagggggagttgggccgtgaagctgggggatcggggggtcgggctgccgggctggggcatcgggagtccgagtggtggaacccagaaggtcccagacgcaggtatgggcgatccagggcggggcactctgcctgggcggtggcctgggttgtaaagtcttgaaagcctggaggggtgagtttagaaatggtctcgagttttctctgtttgactaaatagtgtcatttgctgaagagctagcttttaaaatgttttctcacctcaccgggcattccaaatatccgaacagcacgtatgagctggcaagatagatagggcagaaatgcttgtgacgccagaggaaaccctgttttataaccagtgcattctggttctgctgtcagttttagaatcataaaacaggaaagaatcctgagatgtgttatcccagccttcattcatacctccagagagctgttatgaccagaattatctgttgtggagagggaaacaccttgacatttgaccttatttcttctgtctgggtagctgggcatgccactagttgagcttcaggtacatgcacctgctagaagaggacccaggtttgaagccacactgattgctttgtatgtattctgtatttattacattttaataaatcagcggtctcagtcttttgtctacagttttgaaattaccaaaaggcaattactgatatgttaatgttaattgcctttgtcatagtttgcagccctccagttcaccaacaggggaatccaattcattaggctgtaggtgttgtattagtttgctagggctgccataacaaaatgccacacacagagtggagcttaaacaacagaaatttatttcctcacagttctggaggctggaagtccaagatcaaggtcctgacaaggttggtttcctctgagagccatgagaaaaggatctgctccaggcctgtctttttgcctcttcacatggtggttcctctgtgtaccttgcccctagcgtctctgtatgttctagttttttttttttttataaggacaccagtaagattgtatggtggccttattttaacttaattatctctttaaaggctctatctccaaatatagtcacattctgagatacggagggttacagtctcagcatattaatttagggggaacatagttcagcccatacaggcaccatagattgttcagtcaagtgcaagcgagactggtggcactgaaataactattagttttcttctttagcacacttctaatttgcagcaatatatcagggtatgtatttatagtcagaaataactggtctgcaaggaagtgttaaaatgatacatactagcaggtagtctaggtgcataaaaacccaaaaggaagctgacactgaagatgtggcacttactgtggttagaccttgctgttttcttgccattgcagttttataaatttgtcataaaatgtggggatgtaggcagtctgaatgcacacgttttgatgcagtattatgacctgaaggcctcaacatttatctggactggaaatgattcgagatttgtgtgatgggcaactggagggggcagaaattggctcaacagaaataacctttacaccagagaagatcaaaggtggaatccacacagcagataccaagacagcagggtatgtatcacttaacattccatttaagtaacctgggtttaagtccaggttttgccactttctgggcaagttgcttaatgtctatgagcttgtttccctacttttatgttttttttttttgagacaaggtatccctcttgcccaggcgggggtgcagtggtgcaatcactgctcactgtaagctgtaactcctgggcccaacaggtcctcccacctcagcctcctgcgtggctgggaccataggcacacagcaccatgccccgctaatttttgtattttttaaagagacaaggtttcgccatgtttttcagctggtctcgaattcctaagctcaagcaatccacccacgttggcctcccaaagttttgggattataagtgtgagccaccacacctgtccaataaatattcattgaattaatgaaattcattattactgatagagacttcccagttcaatacttaagcatcattgtgtaagtgagttaaataaagatctgtcttttgatagctaagaggctatgtcgaattccctttcaaactacttatgaatatgattgctttcacttaactttggagaagggagataatggctcatttagaaaacaaccaggccaggtgcggtggctcacgcctgtagtcccagcactttgggaggccgaggtgggtggatcgcttgagctcacaaatttgagaccagcctgggcaacatggcaaaaccccgtcatatatatatatttatatatttatatatataaataaaaattagctgggcatggtggtacatgccggtagtcccatctacttgagaagctgaggcttgagccttggaggtggaaggtgcagtgaactgagattgtgccgctgcactccagcctgggtgatggaaggagcccctgtctcaaaaaaagaaaagataatgaccaagtgtttcactttatgaaattcatcatgttacataactatttcttgtgatttctcacattatttgactataaggaccaaacaggcaagtaaagcaaggattacttcactaaaacttcccatgtgaaatatttagctatcagtcttttttttttttttttttggtctcccaggctggagtgcagtggcatgatcatggctcactgtagccttgacctcttgggctcaggcgattctcctaaagtgctgagactacaggcgtgcaccacaatgcctggttaatttttaaattttttgtaaagatggagtctcactatgttgcccagattggttttgaactcctgggctcgagtgatcatcccacctctgtctcccaaagtgctgggatacaggcatgagccaccacgcccggccaagctgtgagtgtttgttattattaaaattaataattattaaaatattttattatactttaagttctggatacatgtgcagaatgtgcaggtttgtcacatatgtacacatgtgccatagtggtttgctgcacccatcaactggtcatctaggttttaagccctgcatgcattaggtatttgtcctagtgctctccctccccttgccacctgccccccgacaagccctggtgtgtgatgttcccctccctgtgcccatgtgttctcattgttcaactgccacttatgagtgagaacatgcagcgtttgcttttctgttcctatgttagtttactgagaatgatggtttccagcttcatccatgtccctgcaaaggacatgaactcattctcttttatggctgcgtaaaatattattctatcatatcatgaactccacaatgacaggaactatatctttatacctggaacagtaccttgttatatagtaactaatcatatccagaccttgtctattttgaaagcattttcataaactgctagtttcaagaattcttttgtaaaacttttgaagaaggttttatttttaattttttttcttttttacttttttgtaatataaagaaaagtatcagaacttagccaaggtcacacagctaatgtgtttagttgaagattcagacccaggtttggttatcatttaaagctatttttctatggtgaaatactgtttttctttaaaattcaggattttactattcagacactaaaatgttttttaactagaaactcaatggcatatacctgccttcacagttgtctgtgctttagttggtagtgatgaacaagaatatagcttatttaagagtttgaaaagaaaatgcagaaaagaaaatgaaaataagccccttctgccttctccttaggagtgtgtgcctcttgatgcaggtctcaatgccgtgtgttctctttgctgcttctccatcagaacttcatttgaaaggtggaactaatgctgaaatggcaccacagatcgattatacagtgatggtaagggcttttgttgttgacaaactaagatgatctcatacatgcttctgagtctccattctctaaatatatcctgagtgtttttttgtgactttcttgtttatctcttcatggtgtcttttctttctttctttctttttttttttgagacagtgctgttgccaaggctggagtacagttgcatatcacagctcactgcatactcaacctcctgagctcaagcaatcctcctgtcttggcctcctgagtagctgggactacaggcacacacccagccaatttttttaaattttttgtagagtcgatgcctcactatgttgcctaggctggtcttgaactcctgagctctaaggatcctcccacctcagcctcccaaatgtgtctattgcagtagggggtggggaattatgtttactttaagtttgttgttatatcttggaatagtgtttatagtgaattaaaaaaaaaaactcaagtgtagggcccggtgtggtggctcacacctgtaatcctagcactctgggaggctgaggtaggcagatcacttgagcttagaagttcaagaccagcctgggcaacatggtgaaatcccatctctacaaaaaaataatataaataaaaaacaaaaaacactacacacagaaaaattagccaggcatggtggtgcacacctgtccaagctactcaggaggctgaggtgggaggatcacttgagcctgggaggttgagtttgcagtgagctatgttggcactccatcctgggtgataaagcaagatgctgtctttaaaaaaacaaaaaacacctcgagtgtgatataaattatatcagttgtgatgtgttattttataaatacaaggattatgatttggagggaaactcaaactttttttttctattaagccccttccattctaggatcaaacatttaaaaaatgatttaaaaaatactggcatgctcatataactagtgggagagaaaagtggtataatcttttttcttctagatttattaaagtgtaattttttcaattgaatccaccctttttaacatgcagttctgtgatttttgacagtgacatgattcacagttatgaaccatctaccacaatcaagacatagaatagttccgttactctaaaaaattcccttatacgtttttgtaatcagtcctgagcctcagcccctggcaactgctgatctgttttctgtcatagttttgccttttgttcagaatgtcatataagggataatactgtacgtaggctttgagtctgggttttttgctctccataatacatttgagattcatccatgttgcttgtatctgcaatgaaaacttgagttgtgttctcgtatatggatgtaccagtttgcatatccattcatctattgaagggcatttgggtgtttccagattttggcaattataaattaagttactgttaacattcatatacaagtttttgtgtgattgtacattttcatttctcttgggaaaatacttgctgggttgttataataagcaaatgtctaactttataatacatagccaggttattttagcttccaaagtggctacattttgcattattaccagtactatatgagagttccagctgaagtgggcacagtggtgtgtgcctatagtcccagctatttaatacttggtagggtgaggtgggaggatctcttgagcttaagctggagtctagcctgggtaacatagcgagaccccatctctaaaataaaaataaatatcaaatagagggttccagctgttctgtatccatcctagcacttgatattttcaggtttttatttgttaagctttttctgcctttaaaaaaaaacacaaaacaaggttaataacctgtatacctcctggatacataggagacaacccagagaaataagtaaatctctagagtagatctcaaagagttgccttagacatcaggcttaaacaccatctttctctgaaatattgccattctaatagatggtataatcttttcaaagtcagttcgatgggatgtataataaaaattaatctctcctcacctaataatttgacttcaaggaaactcctctaattcaatattgcaaagttcagctaaagataaatgttaaaggtatttgaacagagcattatatactgtaattatcattatataagatatatcattatctaataatgaaaacttggagaaccgttaagtcaattaggctaggatgccatggagtcattcagattttgtttaggaataattttatgatgtcaggaaaatgcttatgtttataatgttaaagcattgtctgtggaatgagatttcaactgtacaaaaaattgagatgacagaatggaatgctcttcaccaataccccctcatttcttaaatgtactatattgagatgcgtgaggaagtattggccttcggagtagaataaccactgatatcaaatatcctaagttccaatttttttcgttagatagacttgcacagctctgattaaataaatgtcaaacttttaaatttagctacatatcagtttttttatttgaaaaaaatggaaccagcctacatattcttataacactgtttacctatagcacccagttactagccagcaaagcgcttttgtttaataaatacacttgttaaattagtgaatattgctgattaacctaatgataaaaactgattttttcaggtcttcaagccaattgttgaaaaatttggtttcatatttaattgtgacattaaaacaaggtaagttgcttgtttcttaaatgttaggatctattacttacgctagaagtagtggaaaagttagacccttagagaactgtctttctggtacccacttaatacattgcatctcttgtaagaagtaattgtactttgtggcttaaaaataatgaatagcaggagcatggggactcgagagcagctacacatcatggttatttatttctagggaaaatattttcaagggaattttcacagtgaggtaccctcatatctagtgatatttcatgccccagcacagcttaagtgctcactgtgtgtagacaactggactagacactaaggggtcataaaaggaattctcttccacaatgtgatcagaattgttttcctaagaaacacattgggcattcaggttatttctctttaaggcttcccttctgccacacaatcactaggccatatttcttggtgtggcatttaagtgctttgaagtcttgccctaacttttctaacttcttcgtccctctcctcctttcaacgtgttatgtattctaacaatatgtttgcttgttattccttaaatatgctttgtgcctttggacttttgtgtctttgttcatgttattcttcccctgctctcccaaaagttagaaatcctatgtttttttcaacgtgaaacttataattctttatgaactgtgattgtgcctcaatcagaattcatatttgcacctatgttgtagcctttcttatagcctgacctgtattctagtagacagtgtgtggagccatctccctaccagatggtgagctctttgaggggaggagtactgtcttctcaccgtctgctgtaaaataaatgacaccaattaattgaattaaaactttttaagtgttttgctacttaaatattcatcatatatttatttgaggacctaccatgtgccagacattgttttaggcacaggaaaatagcaggaacaatataggtaagtctagccctcaaggcgcttatattctacaatagccctgtcaaatagaactttctgcattggggtatatgttccatatctatgctgtccaatatggtagtcactagccaaatgtgactattgagcacttaaaatgtggctagtgcagctggggagctgatttttaaattttatttaattttaatagtttcacatatctcaaggctaccacattgtatagtacagacaaaattttgttttttaatgtataaaattttacaaaatacagacctaaaatatttagacctttccatggattacatgtttggatatcattgacatgtcattttattgtaatatagagctttgtttttgtcatgcaatcagtttatgtgggcatttgttatacttttcataggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtaagttgtttagatgttcttagaaataaaatatatgtgtgtcttgataaatattatgtcaactaaattttgaaattattgagagaacttaacatttttttaaggaaagaaataatgtcctttgtggcaatatggctgcagctggaggccattatcctaagcaaattaatgtgggaacagaaaaccaaataccacatgttctcataagtggaagctacgcattgaatacacatggacataaagatgggaacactggggactgctaatgggaggagggtggaagggggctgagggttgaaacactatcaggtactgtgttcactacctaggtgatgggatcattcatataccagatctcagcgacatgtaatttacccatgtaacaaacctgcacatgtacctcctgaacctaaaataaaagatgaaatatatgtattaatggatacattaattaacaaaaataaaattaatttgcataagcatatttaaaaattcagtgctctcttgaaaatcaagttattaaataatgcatgtaaaagctaccaattattttatgtgtctttgaagtcttgaaaacaattttccaaataatcagtaattgttttattctatttttctgtcttgctaaaataggtagcaaaagatatggcagcggcagcagttagatgcatcagaaaggagatccgggatttgtatgttaacatccagcctgttcaagaacctaaagaccaagcatttggcaatggaaatggaataatgtgagacaatactttttcctacacattagttgagaaccctaaaatagttatctaattaaattaaagatttttagggtttcttgcttaagtttatagttttaagaagtatttatttatttatttatttattgaggtggagtctcgctctgttgtccaggctggagtgccgtggtgtgatcttggctcactgcaagctccgcctcctgggttcatgccattcttctgcctgagcctcctgagtagctgggactacaggcgcccaccaccacgcccagctaattttttgtatttttagtagagacagggtttcaccgtgttagccagggtggtcttgatctcctgacctcatgatccacctgccttggcctcccaaagtgctgggattacaggcatgagccactgtgcccagcctcagtttatatttttaaggacattcctacctaaaacaccagtatgataaattaagacaattattctgaattttttctgaggatggcttgccttttgttaccttgtaagatccctttcccttatatagtgaacttaaacgtttaatcagaagttaggctttaaagctagtcctatgagaatatttccagttgcataaaatacgtcaaatgtgaaatcagttcacaaataaatatagcaaagagctttttaaaaccagactagaggccaggcgcggtggcttacacctgtaatcccagcactttgggaggctgaggcgggcagatcacaaggtcaagagatcaagatcatcctggccaacatggtgaaaccctgtctctactaaaaatacaaaaattagctgggcgtggtggtgcacacctgtagtcccagctacttgggaggctgaggcaggagaatcacttgaacctgggaggcggatgttgcagtgagctgagatcacaccactgcactccagcctggcgacaaagcgagactccatctcaaaaaaaaccagactagaactattatgttaattcagttaggagttatagatttaagtattagtacaaattctttaactgatgtttttgaagtataaaagtaccatttttggatatttaagttccaaatcctctcattcagaatttccattaaaaggtttaaagtaaacgcttgctctacttatgataacactatctaaaaaccgtagaacaataccaaagtctctgcataacgacctttttatttaagataattctgaaacactttatagtactgtgtgcctgtgaaatggtaccacttagtgctaatgacatgttaacttgttggggggcatggtagacatttcttaacctgtgaattagaatctggtgtgacttctcctggtcaagtggtaaaggatactactggtctgattaagatagacaatgttaatcataccactctatatgaagaatttttacttttgcaatttgttgcccagatttagttctgcctatttaatagtcattgttctcttttgttgtatttgcataaatttggaacatttatagcaaaggtagtaataactttttttcttgcatagaattattgctgagacctccactggctgtttgtttgctggatcatcgcttggtaaacgaggtaagataaatgaagggggtccatagttcccaatgctactgcagaattctttaatccatcaggattggaatgttatagaatgatggatgaaagtttaaaaggatgtagttaattgattctcttttagagtcaattacactttcagactttcagtctttctcccacctttatactttggaaaatttcaaacctatggaaaagttgaatgactagttcaactagtcatccatacaaccttctcttagattcactagttatgaacatttagtttgttgtgtatatttctgagccatttcaatataagttgcaggtgccatgtctcacccctgaatactgcagcatatatgtccaaagagcaataactacataattataataccatttttacacctgaagaatttgttttattctgacacaccagatagcttcatacataatgaattgtttccaaaatattatttagagcgatgtggaatttttttttttgggggggggcacatagcatttgtttctcaagtctctttagtccctcttttaatacacaatcctcccattaccttttttgttgttgttcatttcatgatactgacatttttaagagtccaggccattttctcacagagtttcccacaatttaaatttgtctgattgtctcatgatatattcagattaaacatttttattaagaatactacataggtgattttgtgtacattccactgtatcacggcagggggcacatgatgttagtttctcctttattggtgaggttgagtgtgatcacttggttaaggaggtgtgtcctgcagatctgtctgccatgaaagttccttttacctttgtaattaactagtgatccaagaaaatattttgaggccatctggttatcctgcacccataacagctttcatccagtggttttaacatctattgatgattcttctctgcatcagttattacattggtgatttcagaattttgaatgtttttgtgaaagggaaatttgtttaaggtttggtatattagagagagaagatacatacatgcatgtgtttgttaatatttaaagttacttttaccaatcaggcaacttttaggtgaacttctagttgtttgcgtggtcattgattgctttattcctactttgtagcatctttaaaaatgcttaccaagctgggcacagtggtacacaactgtaatcctagcactttgggaggctgaggtgggaggattactgagaccagaagttcaagactatcctgggcaatgtagtgagactttgtctttgcaaaataaataaacaaataaaaatgtttaccctagctatgctgttaagccacactattactactgaatacaaaaaaaattaggaattcttcagtttgctcagttggtaaatctagaactagttgggcatcaaatctgatcaagagaataaataaaatcaccatttccagttgaactcacataaatgaattctgtctaaaactgtgctattcaaaatgtggttggcagacaggcaaacttgtcagcatcaactgggagttcgttagaaatacagattttgggacctacctcagacgtattgaattagaatctgtgggagtggggcccaggaatccattttaacaaactttccaggtacttttaatgtatactgaagtttgagaaatagtgatctaaaatatgtatttggcatatactaattacatattaggtgcagtgaggaatcagtgtggatattgagccactgcatgcactatctacaacagtctttagaagcaaagagaatacaaatataaaacggagactaggagcagacatattacaagtaataagtacttagcaggcattgggagaagtgtgagtttgtttgtattactggttaccaaatgtgccaggtactgtgtactagggattcaaaagtgacagctatgattcctgcctcctgggttattctggcagaggaaacagaccagttctatgatagtggtatccccagggtaccataggaatacaggggaagcaaagggaatccttctggggactgattgacaccaaatctgccttctgccatttaatggtcctccagtgggttctgtgggtaaatagaagttagctggatagaaaagtgagagctaaggaggaaggacaaagaaatttgacatacaaaagtattctgggtgaggtggcatgcagctttagtccaagctactcgggaggctgaagcaggatgattgcttgagccaggagtttgacaacagcctggccaacatggcaagattccatctcttaaaatttttttttttttaagtagccccatatggtggctcacacctatagtcccagctgctcaggaggctgaagcgggaggattgcttgatcctaagatgttcaaggctgcaatgagctatgattgcaccactgcattccagtctgggtgacacagtgagaccctgtcaccaaaaaaatagtgttctgtgtttgagcaagcaactgcaagtggataatagatctgggtaagggaatggagagagatgacaacagaaatatcgacaggccagattctgaaaggctataggttatatctaggaatttacatttcatcctgaaatatagagcatttaatgagggatgtgatatgagagtttttgaaagataattcagagaagtagaagaaagccatattagaggcaggaagataagagttcattacaattcaggtcagaatggtaagggcctgtgccaaggaatgctgggctagagaggtgaatactgataaaagggtatttgcaaaggtgaatggacaatatttgctggccagttgggtatgggaagtgaggaaggcagtgtaaagtatgaccttctagatgtctggcttaggtaactggatatatttacctcttgtgaatatacggggtagagttagtttgccagggtagatgataattttagatatgctgcgttgagattgattgtaaagggatcattactttatcagtaatacatggaatttttttaccaggcctgaaaaaaattttctaatgttctgtcagcatttttttctcactttgtcacatgaagcaacttgtactttaaagtagtttttggataaaacacttgtagagtacacagtacttatttttagacttagggtgttaggagagaatagaggagagagcaacatgcctgctgagattgactgactcctcctggtatccttccttggttcctatcatgcacatcagtcaaatgagatgttagcaaatgcaaaagtaacttgtggtcttctcaatccagcttgtctatatattaaggatctcagagagaatgtcatgacctctattatccagatcccctttcatttctgatttaaattaactagaaaattactggatttaggggctgggtgtggtggcgtatgcctgtaatcccagcactttgggaggccaaggtgagcagatcacttgaacccaagtgttcaagaccaatctgggcaacatggcgaaaccctgtctctacaaaaaatacaaaaattacttgagcatggtggcatgtgcttgtagtcccagctactctaaatgctgaggcaggaggcgggaggatcacttgagcccaggaggtgtaggttgcagtgagctgagatcacaccactgcactccagcctaggtgatagagcaagaccctgtctcaaaaaaataaaacaaaactaccagaccttgaatcctaatttcttagggttatcaccagaaggaacattggctgcttgtcaataccaccataggtggtagaggcaggaagttgtaactagagatgtctttatcattgtctcagttactataaccattttgatcttagtttccttatatgttgagcaagaagattagcctggagaatctccaaaatccttctaactataacattcttcaattttattttaaaacggtgagattttgttttgtctgagaaaatctcgctgttttagactgaggcagtgtgttatgatagagagcactaaacagagagtgagaagacctaaattttagtcccatgtcctgtcattatcatgcatagtgactctgggctttccttatctgaaaaatgatattggaccgtgattgtgatctatgtttaaggatcccttccaactttaagtgattgcattatagacagaatgtgttttgtctttccattgttgcgtatctgtgtgatctttcattactcttatcttacagttagttatattctttactatgggagcaaaataatctgctgaaatgaattgtgcctctggttaatcaatctttatttcctttgtatagtaattgcctcacttatagcaagcaccttccttccctccctcagtgtatgtggtaattcagggcatctctctgtttttgtttttgtttttttttttcgagacggaatcttgctttgtcgcccaggctagagtgcaatggagcaatctcggctcactgcaacctccgcctcctgtgttcaagcaatcctcccaccgcagcctcccaagtagctgggattacaagtgtgtgccaccatgccggctaatttttgtatttttggtagagacggggtttcacagtgttggccaggctggtttcgaactcctgacctcaagtaatctgcctcccaaagtgctgggattacaggcgtgagccaccgtgccggcctcatggcatctctctgatgtcctaaaacaagtccttgagacctttgtttaaaaacatccaaaatgtgagaagattggcaattagttagaaaagcattaagatttcagaagaaattgagattttgcttttggtgtgtataatactaataagcaagattctcatattttgcttattatgttcagttgctacagactgctagtaatggcagttagtaatgtagaaccattcatgccattactatcaaggtggctgggtggaaaggaatgtgaatggctctgaggaattctttgctacatggcagaaaactttagtgtacctgctgttttctagtactacaaagccggaagttctttccttttcctttacatcctccatccctattttagctgtttttcaaggactcacttaagtccttcatgctttatgaaacctcaaattattctagaacctatataatctcttacttttctgaactcctgtcgggtatatagtttatatcacagagttagcacttaattatcctctaattttctaatatatgtgtattttaaatgcctccttagcaaaggatctggtttctattacttagcatggtagataaatagtgggtatgcaatactcctacaggttgagcattcctaatccaaaaatctaaaatctgaaatattccaaaatcagaagcttttcaagtggcagtatgccacaaaactttgttttatgcacaaaatcatttaaaacattgtataaggttgccttcaagctatgtgtgtaaggtatgtatgaacattaatgaatttcaggtttgtttatttatttattgagatgggagtcttactctcttgcccagtctagagtggagtggtgcaatcttggcttactgcaacctctgcctcctgagctctagagagcttcccaccacagactcccgagtagctggaattattagtgtgcgccaccatgcctggctattttagtagagacagagtttcaccatgttggccaggctagtcttgaactcctgtactcaagctatctgcctgcctccacctcccaaaatgctgggattacaggcgtgagccactgtgcttagctgaatttcatgtgtagacttgggtcgcatccccaagctatctcattatgtatatccaaatattcctttttttttttttttttttttttaattttgagacagaatctcatgtgtcacccaggctggagtgcagtggcacgatctcagctcaccataacctccgcctcccgagttcaagagattgttgtccctcagcctcctgagtagctaaaactacaatcgcacacaaccatgcctggctaatttttgtatttttagtatttcaccatgttggccagtctggtctcgaattcctcatctcaagtgatctgcccgccttggcctcccaaagtgctgggattataggcatgagccaccatgcctggctcaaatattccaaaattttttaaaaatccaaaatctgaaaccttctagtcccaagcatttcagataagggttactcaacctgtgttattattaatagctttttatgtactagtctgggtaatagatgctttataaatattatctctaatttctataacaactttgcagcataattattatcatctccatcttctagaagaggaaatggcagtggctaacaagaagtcaagattcacaaaacatgtttcaaaccatttcattcagtcacgtaaatacttggccaattgataatataaagagggtaatttattatattattatgactactataaagaaaaatagagtttctgggcatgatggctcatgcctggaattctaacactttgggaggctgaagcgggaggatcacttgagttcaggagtttgagaccagtccaggcaacgtagtgagacctagtcgctaaaaaaaaaaaagaaaaaaaaaaaaaagaaaaaacaagaaaaaacaagaaaaacaaagaaaaatagagttaaaattctacaatttccactttggggaaaattttatcatatataatcaagtaaatttgcaaatataaaatagaaacaaaactaaccacattttcatttttcataagacgttttcatttgcagccaagaattttttagttgagagtaaataccttaaaataataatgtggcattctactacttgtgacagacttactttgtattcagtgttgtaccaaagatttggaatatgtatggagagatagggaatagggcaagagggtaaatattctgacttatatttaaaataagcgaatacctgttcaaatcttagaggaaataaaactctaaaatattttatctgataatgttatatgctctttttttacataaaatgtaatttcctgactttaaaaaaattctttaattttttttttttttttggcagagtcctgctctgtcacccaggatggagtacagtggcacaatctcagctcactgcaacctccacctcccaggttcaagtgattctcttgcctcagcctcctgagcagctgggattacaggcatgcaccaccatgcccagctaaattttgtatttttagtagagatggggttttgccattttggccaggctggcctcaaactcctgacctcaagtgatccatccgcctcagcctcccaaagcattgggattacaggcgtgagccaccgcactgagccaaattctttaattctgatggaattacctgcagactaattgtaacacgcatgcttttctaggatttgggaggggaatttgtttgtttggtagatggcgtctagctatgttgcccaggccagccttgaattcctggcctcaagcaattcttacaccttagcttctcaaagtcctgggattacaggcatgagccaccatgcctggctgcaagttttaatttttgaaattgaggcatagcattatagggtcataacttaacttataaactggctttataaattagtacattttaaataggactaatgaagcctatattttcctccactagtatatttaaaggtataagacttgtgtatcccaaacactcagaatattaaataactaaagatcttattctaaaaggtgcattgagtgggtttttgaggcctaaaaattgtataccagtgctaattgggatataccaaactttttgtctcttagtaattagttttgttttgttttgttttgttttgttttaatgttgtgcttatcttaaggtgtaaatgcagacaaagttggaattgaagctgccgaaatgctattagcaaatcttagacatggtggtactgtggatgagtatctgcaagaccaggtaatgacacatttaggttaaaaaccctctaacctgttagatttgaatatgtggtagattgaatatcaatttaaataattgactttcagacactaattagcaagtcctacttcaataatttaaaaaaatattctgggatttgcattcctcaaatttcagccctcattttactttacgtgtctacagtgttttgcgcaattgaccactccttcctttttgaagtattttctttccttggtttctgaaatactgttatcttcctatctcactggccatacattctagtctcctttgctagtttattatggttttcatcttctcaacaacaatttttttttttttggtggagacagagtcttgctatgttgcccaggctggtctcgaactcctggtttcaagtgatcctcctgcttcagcttcctgagtagctaggcctacaggcacatgctgtcatgcctacctaatttaaaacttttttttgttttaatttttatagagacgaggtctcagtatgttgaccaggctaatcctaaactctggcacccaagtgatcctcccactttggcctcccagagttttgagattaagggccatgagccactgtgcctggccaacttctaaattttgatgagcccctggactttggcttatacttgttttctttttctgtagttgctccctctcttagtttgtccagtctcatggcttaagtaccgtctttatgctgacaactcccaaatttatatccgaagcccaggcctttctctttaactccttgctcataatatcccctatgcctgtcaacacctccacttggacgtgtcacagacctctcaaacttagcacgttgcatggcgcggtggctcaagcctgtaatcccagcactttgggaggccgaggtgggcggatcacgaggtcaagagatcgagaccatcctggctaacacggtgaaaccccgtctctactgaaaaaatacaaaaaattagccgggcgtggtggcgggtgcctgtagtcgtagctactcgggaggctgaggcaggagaaaggcgtgaacctgggaggcggagttttgcagtgagccgagaatgcgccactgcactccagcctgggtggcagagcaagactccgtctcaaaaaaaaaaaaaaaaaaaaaacgaaaaacaaaaaaaacttagcacgttcactcacagtgagaagtgatactgaatatttccaaatattgtttttatggtctgttatctttatagattttcctttctaccatacttttgtctccttagtcccaaatcagtagtgtccacatttagaaatatagtcctcgagatttcttgacctgtttcttaagacagtttctgttatttctagtctcctcctccttgcccaggtctactttaaactcccagtaaagtcccagtattagtctgtctattcagctgttaaaatgtaatttaagagagtagaataaacatcatattatatataccaacttgtagagatagttggtctaagtatattactgttctgtattttacttgtaaatattaatttaaaaaattatatgttgagagctgctaccaagcctttttgtactactcacagacttagggtaacataggttttctgtcatcttctgagtatgtctggaaacctaaagaaatagaaattctgttttagcaatttttatttctagtagtatttttattatgggcagcagtggaattataatgccaaatattaataaatgtgtgaggtttttctttgttcttttttaaatagctgattgttttcatggcattagccaatggagtttccagaataaaaacaggaccagttacactccatacgcaaaccgcgatacattttgctgaacaaatagcaaaggtgagtattctatcagaaagggaaattgatattttgatttttattttagccaattttgggttaaattttaataggaaacttaatagtaatcataattgctatcactgtttcctgtgtgacaggcactgagctaatttagcaatttatctaaactgtctactcagcataactattgtaggtggctatttattattattcccattataaatatgagtaaagtgaggcagagagattcattaaattgttcaaggccacatggatttttagtggcagagctgagctttgagcaaacctgggaaagcatacttcaaaacccatgttataatcactgtgtggtactgccttacagagtaagtaaagatgttttgttgtgaactatgatatcaaatcacaagggattcatagttggctataaaaaaatttatataaaattttagacattttattttcttgattctattggtaaaatagaatatttgttgaaactaatattcactgtcctctgaaatttagtagagttgacgtacagtttttaatgaagaaggatttatcattatatgagctcatattcatacctttcctacaggattctttttttttttttttttgagacagggtctcacactgttgcccaggctggagtgcaatggcatgatctcggctcactgcaacttctgcctcccaggctcaagtgattctcctgccttagcctcccaagtagctaggattacaggcacatgccaccacacctggctaatttttctaatttttgtagagatggggttttgccatgttgcttaggctggtctcaaacttcatagctcaggtgatctgtccaccttggcctcccaaagtgttgtgattataggtgtgagccactgtgcctggcctggattgttaatttaaagaaacaataggtatatttcatcatgaaactaatgtaatttctttataggaaatagaggggaaaagccttctcataatttccccttgccggtaaaaccactgttgacatttaggtgttttcctcttctcctaaatcgtttctctttgcattttttgcagttaatgcatacaacttcatttcttgcttatttcagtaacatgtagcatatttcccattttgcttattctttataaagtaattttataaagaaatataaaatttgtaacaattttataagggaagttgctaatcttaagcatttttattattattgtttttgagacagggtctcacactgttgcccaggctggattgcagtggcacaaacctcctgggctctcaaatgatcctcccaccgcagcctcccaagtagctggggctacgggagtgtgccaccacacctggctaattttttgatgttttgtagagatggagtcttgccacattcccaggctggtcttgaactcctgggctcaagcagtcctctgacctcaatctcccaaagcgctaggattacaggtgtaagccagcatgcccagccctagtcttaagcattttttaaagtgacaaaagtaacatatattaatttaaaaaattaatcattacagaagtgtcccatacacaaaaccactgttgctgccctactcctatttgtatgatgatcctttttcttttctttttttttttcttaagatagagtcttgctctgttagcccaggttggagtgcagtggcacagtcttggctcacagcaacctctgcctcccaggttcaagcaattctcatgcctcagcctccagagtagctgggattacaggcgtgtgccaccatgtccagctaatttttgtactttttagcagagacagggtttcactgtgttagctaggctggtctcaaactcctggccttacgcgatctgcctgccttggcctcccaaagtgcagggattacaggcatgagccaccgcgcctggcctttcttttttttttttcttttaagagacaggggcttgctctgttgcccaggctagattacaatggcagtatcatagctcacagtagccccgaactcctgggctcaagtgatcctttcacctcagcctatcaagtagctaggactgcagctgtgcaccaccacaccctgctaattttttttttgtttttgtttttgttttttgagagacgggatctccctgtgttgcccaggctggtcctgaactcctgggctcaagtgatcctcccacctcagcttcccaaatgccgtgattacagctgtgagctactgtgcccagtttgattcttaattatgtatacttttaattgttattaagaaacatagataagtttttgttaaattgtaggaaagactgatgggaattaaaggcaaattgtatttgatgtcaagagtgttaactctattttttttgttactctacttatgctgtatttataactattacttgtctgtctctccttatagattgatctccttaatagcagagatcaggttttattcattatattctttacttttcacagtactttacatatagtagatgcttacttgttatttgaaatgtatacataacggaaagtgctatgaacctgtgtatagcttgtatcttggtcagctttgttgtgtataactgggtgacttggggcaagtttcttatctttctttgtctcaatgcaaatagttatctgtaaaatcagacttaagctagataggcctgctatgctcctttcaggtctacatatttgtagttttaagtaggtttatgtataggctagaaatgattttcatagctgctacgtgtgtttcatatttacataatgcttgtaatttgaaaaatatataaacgcatgcatatattactaattaattaatatggttacctagctcagaattcagcatttattcattcaacagtaatttcaagtgtccactctgtgtcagtacattaccatgtaatgctgaaagtgaaagaatttttaaacattactattcattcagtaaggcccccaagtgatggttttcaaattgtgcttccaagaatcctaagattttaggcatatttgaaatccttttgccacaaacttaacctatttaattgttttgatttttttttttaagacgttgatgggagttgtgaggagtcttcctgtgttgcccaggccagcctcctgaactgaactcaaatgatccttccacctcagaatagctgggattataggtgtgcaccactgcacctggctagttgttttgattctaaatttagttttgttaaaatgaatcacatttgctttaaaaataatgatgttttcaaaatacagtgatataggccaggcacaatgactcatgcctgtaatcccagcgctttaggaagctgacgcaggaggatcacttcagcctaggagtttgagcctgggcaacaaagtgagaccctgcctatacaacagaattaaaaattagccaggcatggtggcatgtgcctgtggtcccagctacactggaggctgaggcaggaggatcccttgaacccaggaagttgaggctgcagtgagccgtgttcatgccactgcactgcagcctgggtgacagagcaagactctgtctcaaaaacagaacaaaaacaaaagcaaaatacaatgatacaggtaaaatatttcaaagccaactttagttactaagtgaaaaatgtgatgttaagcccagtacattaaagatgaaggaagatgttaatcaccaccaccacccctcctccccacataccttctctgaactggatcttttgaacgatatatatagggaactaaattagcaagaaaaaatgtaaagaaattaaagggtaatttgtgacttgacaagataaaagtagaaatgtttcagaaaaattttagggcatagggaatacagttgcattaaaattaccatttgaggtttcaaaattgttatttgcctaagctgtacatctgagctttctgattcagtgtgcgtggaaggggcccaggcatatatatttggacaaaactcacaggtatgtatacctctgaagaagaaccatggttgtacaatgaaatgtgttatcttgaggctattaagtttctttctcatcaatcatttgatctttgtgtctctgtaggtttttcaataaaatgggcttgacattaactctctgcctacataagttggagttgtgggctctttcctccatctctcttcgtattacttatatactcctcttctgatttcaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctga

SEQ ID NO: 36441 - DNA, 28101 bp, Homo sapiens
gggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtaacggccgctgggtacaggatgcaccttcctccagccgcacctcgggcgactggtggcagtgggctcgccgggcatccgcggccctggttctgcgccggcagcgcaggtcgtggtaaggttgtgctgtcgctcacgcgccggggaggacgcccgcgagtcgggacggtggtggcagcctgtagcggtgggtctcgtccttccagggcctgcgggctctggaacgggaagtctccccagcgggcagcacttgctgtggactggctgcccataggcgatttgtggcagccgattatttgggtcagaacgtttagaatttgtgtaatattcaataataaattttagtaacctgagaagtcggttgtagtccaaggcacaaaaaagccctaagccaaaatgaagaacaaaggtacctgtgtatactggaatgtgccctagtagatttaatggggggatagtaaagctctcaggccatatgccaaagaaggttgggggcggttctcctcggtcaggatttgtctctcctccttagctccaccttcccgggctatgtctctgtgctgctctctgatccaggtgaccacccgttttcatcccaggtatctcgctaaaaatgcccctgattacaccgagtactgtgcacttgtttgacttttcatcaatggcctaaaagttaagaaaaacactttcctgtaatatttatgattgatatgaagtgactttcagaattaggccgtaaaagtcacacatggtctttttgtttttttccaggtttatgatgataaagactacaggagaattcggtttgtaggtcgtcagaaagaggtgagtaaaaaatctagtgaagagaggtaagctttcctaaaacttttatgtaaccaacaagaaataaaaattaatatataagatttaaataaattttccccatattgcaagcaccctaacagttctggatggggttcttcctttcttaaaatcttaattgtgtctatttctgacttgtttccccctgaaatacataacattgtagccgtagttctggtttgcatataaatggaagtgatcttttttaaaattcttgtcccttattctcctgagactctcagatttaagtaaatcatatcaactttaaaaaaattattcttttaaccacctggaggtgtgttttttatagttttcaccaaataaattagtgtgtgttttttacagggacttacactgacaagctgaaaatggcacatgagtttttcttcccttagtgggtctgttagctctatgcattgtaagggaagatcagttcaggtgcctgtgagtgaccactggagaaagaatgttgaaattagaatccttctgcctaaatcagcctattttttttttttacctgactccttctctatcactcatgtcaatgagctcctgaattcgtaattagatcaggcatgcctccatgattcctgaatttgcttcctgaaggatgctgtgaagtgtccttcacagccaccttattcattctttttcccactttggttagcctggtgttcttcttgttaacaccgtagctatccctaaatcatgtattttcccttctccttcaatcttggttacgttatccattcccagtgtgtagtttttgtacgtctattccagagctacagggcattccagaaaagctcacatgatcatgaattgactataaattcacattctcaaaattcagctggttcactgttgtgtggtttgatgggtgggtgtcagaaaagtttgttttatagtggttgattatttggcaatgccacttgagtgttgggttgagaaagatcctgaggcctgatgcacattcagtggaagagtgtgccatgattgattagtgatgtctaccaggatcatggtggtggagaggggcttgtgtctggtgggtttgcctctcggagtagaagctgtgtggacttgcagtctaaaaattgtgaggttgaatcacagcatgggttcagttttctcatttgtgaaatggaaccatgtgaatatttttaattgaatcataagtctccagtgatatcacactgtcagttgtcgagtaagtggtgtatagggtaagtgctctttctctccatcctcagaaacccttttctgtttgttgtttgaattgttagtgtattcccagtagaagcatctgttccatgtgccacattctccaatgctgtatcccagtgattcacacaaaggagctcatggcattgcgaatgggacatttcttccgtgtgcaggctgtcctgggcattcttgttaggtatatgaacttgacatttggaaggtggaaaccgatggatgttgaaaggatttgcaggccctttggtttcttttggcagtgatcgtggagaaggggaggtttctcttagtgtggatgcggtatggtttcttttagtggtgaccgtggagaaggggagaaaccgatggatgtggggagggttcgcaggccctttggtttcttttggcagtgaccgtggtgacggaggtttcctgggcatcgatgggtggttgttactgaggtagtggctggactctacatccttgctttgtgggtgttatggcacggtcgtgggggcaaggtaggagccccagattgagcagttctggagcagattggtcctgaagcccttgggctcattcatgcaatctggcttccagcccagctccctatctcagctcttgtagtgacgaagcaagtatgtgggtccctgtcacaaacgcctctctgctgaacattctttgtgtagcttctggtttctggttggtgtagcatagggtagtgggaaacaacttaaaccaaacagaatcaggattggcgaagccagtgaggggtgggtacgggatagtgtgatagtagtgtctgtgaccggcagctcacccagggcgtcctggttgtgacctcaacgctccagccggcctagcctccagtgccttcccccattcagcatcctgagtgtccagggcacgtcttggcctcacaccttggaggttcaaggcatgttgataacatgatgagtgggcatcctgcccaagctttccttctttcaacacaaatttggtgtttagtactatttttagtagtagttgtttggcttctgagagacttaattttttggaacacttttagatttacagaaaaactgaagaaagtagggttttcacagccccccagctcagtttctgctgtttactgccatctctcattagtgtgctgcctgtgtcacagttgatgagctgatactcatacattattactaactcaagtccacaggttcactcttaatgttgtatgttctagggtttggatagatgtgtaatgacatgtattcactgtgacagtgttgtaccgagttcactgccctaaaaatcctctgtgctctgcctgttcatccctccctctgcccaacccctggcagcccctgatcgtactgtcctctagttttgtcaagtaatactttaagaagtaaactgggccaggcacagtaggcttatgcctgtcatcccaacacttcgggaggccaaggtgggctgatcacttgagcccaggcgttcaagaccagcctgggcaatatggtgaaaccctgtgtctacaaaaaatataaaaattagcctagcatggtggcacatgcctgtagctcaagcaacgtgggaggctgaggtgggagggtcattgagtctgggaggttgaggctgcagggagctgagatcatgccattgtactccagcctgggcaacagagcaagactctatctccagaaaaaaaagaaaaaaataaactgaatctgaacttcacctgtagaacaagcatagcaggaagctagataattgagctggtctttgcagaaaaacagtggaaagtatctttgtgtggctcctgcccagctttgaccgggggtaccttcaaaggaatccatggcccctgggcctgtgacgggcctgcctgtgaggagactcctcacgtgctaaagaatgtgccagccacccccagccagaagtcaggcctcacatggtcctggagcaggtggcactctggggccacataagtcagatgggggactggaacaaacttggaagtgaccaggtatttctctgctgttgatggaaatattttcattgctttatagtcgtacaagtaaaattaaaagcagatatgacttgtcccctaatagaagggatgactgggggaggtctgcagtgaggtgtggtaataataacagcaataacaacagcctggtagccaggtacttggcgacatcatttgcttttttggttagtagctggggctgccctgcctggccgcatccggattcaggctcctgcgctgatgggcttatgagggctgtgtgcttcagtgacttagcttgtaggctcgtgggcactgagtccgtgtagatgaggaaaggcttggagcagcgcctgtcccagggaagcctctagtgtgtgttcgccttactctgctgctgccttcgccaccaccatgagggcaggcttcacttttagatttttttaaaatactgaagttaaacgttagtgtctatacacaaggtctttacttttagtttttgaaaagaaggaattaggcagcaaacccggaacatcaggaggctgggatcccttgagtgcgactctgtgccacccctctccacctgtgtgtgtcaggatcacggaacagctgggggcttcagcttgtgccttcatctgcccgccagtgggatggattctctcctcagatgctcggcagggcggagtcactccctgacccgcacagcccacagctgggcgtttgggtcagcgagattctgcacgttttctgagacacctaggctggcagggttgagtccagttgtgaccctgtggcctcacctgcctggccctcagttcttcagtagcagacttcaaggtgcgtggtgccaccaggattaggagcagttgcacgcggtgcaaatgtctacctggcgtgctgttttgttgcgataatgtgaagttttatccttctgagaagagtgtgtagatttcgttaatggaaataattgagtagtgctcacgagagaggaaaactaccaagaccctccaaacagaaaacaagcgtgggtgacggcgtggagcaactgaaactttgtgccttgctgctgggaatgtaaaatggcacagccgtgaaggaaaacagcgtgtgggttcctcaaaaagttgaaactaggacttccatccaatccagcggttccacttctgagcgtgtgcccaaaagaactgaaagcggggtccggggtacactcgtgtcatagcagcattattcattataactcaaatctggaagcagtttgggggtccattgtcagctgaacggataagcaaaatgtgatctgtccatggacagtggaatattattcagccttaaggaagaacgcttgacacgccccacaacacggataagcctggaggacgttgcgctcagtgaagtgagccagtcacagaagcagactgcgtgattcctctaacacgagggaccagaacagtcgcttcttagaagtactgtatgaggtactcagaggtactgcgtgaggtactcagaggtactgcgtgaggtactcagaggtactgcgtgaggtactcagaggtactgtgtgaacactgtgtgattcctctgatacgggggaccagaacagtcgcttcttagaggtagcaagtagttggtggttgccgggggcggggggtgaatttggagttagtgttgaatggaaatggagtttcagtttacgaaggtggaaggttctggagatgggtggtggtgatggttgcacaataatgtgaatatacgtggtgtccttagaaatggtaaagatggcaagttttatgttatgtgtattttaccacaattaaaaaaaaattaagagggaagtggcttcaggcccacgcaggaattgaccagaggttcctccctgaggcttctgtggctggtgtcgctcattcttatttctcccaagaggccggcagggcagggcacactcgggtggggaagcaagtgaggctgaggctgggcccacgcggcacctccagaggctctgcacacccgtggtggtaacttgtgttatcacccaggacaagcgcactcctcggatcagcagtggaagaaacttgtgacatctttcgtctacattgagccatctcttgaggccagcgcagcaccacccgaaccatgttggctctcgtgcgtgcacacacacactgttggtcacaggagggatgccaccagagagctgagagggagtgctgaggtacccaggggtcagtagctgcaggaagcagccactattcctaggacttggggggcaggaggaagaggtggcgtcaccaggagggagctgtgaaagtgcccttgtggtgccgctggagctccaggtgggagacaggactgggagtcggggatgggtgctagggtgaggcccccagccagacagtggtggctgagaaggtcctccgtgagaggaagattgaattgaggggcctcggaattccaccctccgcctttgcaggtcatctggttggtggcagaggtggagctctgtgcttgcttccaggttcatccttagagggtttaagaggggaggtttgcctgagtctctcttgtcttgaagcaacctgggcgtcctttagggggtgtttgagacgcgggcggtgcgatgtgcgccatggctgctctccagagcttttgtgtggcttcccgcttctgcatgctcctcctcctgagcttccctcccaaatacgccatctttatagtggagtgaaggcaatcggattttaaaagaaatcttctggatggataagaaccgtgggtctttgcttcctttagaaaggcttggactgtcagaaataatggttataaagtgaggtttatttatcccaggacccagaggaaaatagttggaactgtgaattcacgagccccaggttcacatgctggtggctttgtttgtgagctggcgagatgggctttatttcctccctcatgcagctccccagcttcgtctttgcttctctattgtgtctttgtgtcttgtggttctttctcttccaaggcactggcaaaattagtcactggattccaacattctcaaagcaagtttgaacatgttgtacagacagctcaattgtggtttttagagcattttctataaagttacttagtttaaaaattaatttgaatgaaaacttcagttttgcctgtgatttaagaattatatacttatatagacatgtatacacacgtttagcttaaataattattggcattcatgttcagaatgcctgatgttctaaataattgaactgagcttttactttattttaaacttttattttaaatgtccatgaatggggtcggtattctacagtgtcgatgatccagctggtggacttttcccttctgcgttggttttgatgctgtgtcacagaatcacatattttatgttttatctttaatagatgtaatctcagtttgacacaataggactttgactcctaaagatttaaacctacatatctttatgcccaatcatttgatcatcaagaggtcaatggaaagagtgtttcctattttttacattagtgacgggcgagggactcattttacagaggttggacacttcactgtgtatgatgtgccgtgtgcttaacaagagatggcgtgcgggctgctgtgacggttctcccttgattccctcgtgaagtgcagcagcgctcttcagtttttctcacctttccccaggtgaaagcaggtgagaatggagccttgagtctgaacccagagcggggctttgtgttgtggctgggtgtgttcactgccggagcttggccgtgtgaacccggagccgggctctgtgtcgtggctgggtgtgttcactgctggttctttgtattcctgcggttgcactgagctcctggagccagacgtttgctggtgatgggcggtcagggtcacccttgagctgcgcacactaaatgacgggagggcatcccgcgtcagtcgccagtgtcgaggcgtcagcagccctccctgcagggaggtggccggtctctttgactgccgtgatcggggcctggcagtttgttagtgcggcctttgtgacacgttgtcacttaggcagacaccatattatttacaccataaggcttaatttgtatggttagttgcatcgcctgcagcaggggtgagcagaacatcgctcactccagagccctctgtaaggcgctgcgacaaggcgagccgccgggccggcagcagaggcttgtgttgctggagcgtgtggaacaacctgggcggcgccacacggctcaggcctctgctttaatgtggcttcattttccactaacttcctactgtgtttctggaaatagatcttcaaggaaaagctttacacaatggtcatctgtaactgacagaacctcttgaaaaataaacctttccgaaacatatctgtgagggagagtggtgccctgcctcccactgcgtgtgtgttctctgtgactgtgtggcattgaatgggcctctagtctccagaaatgagtgactttgtgatgagccctgttgctgcttccactctggggcggggacgctgtagaaggagcacaaagtttcaggctgtgccattaagcaggggaaccccaggagcaacatccgaggcagagggttgtgtcatgcttggcggggctggccctccaggaggggacatgcaggtagacccacatccctgggcttagaggcctgctgggggtgtagagttgagttccttccctctacatgcacagatgccggcgctctacttcccatagcttcccggttcttcgtgccttgtcttcctggcacttaatcgttgactgttcccaggggcagctgaaaggggctggctcattacagagtcagaggaaatcaaggcatgtcccctttccaagttcccaaatttgccatcgtgagcatcatcaaatacattatttgccaagccaggatgttttaattgctttttaaaaaacataaattctgtgaaacagagggaatagtctaatgattcccttttcccatgtatccaggcagtcagtttcaacaattaccaaccgaagtagttgtcggaggggccagtctggctcagctcctctaatggttgtcggagtggccagtccggctcagctctgctaatcgttgtcggagtggccagtctggctcagctctgctctgcctctcccccggccccccagcccctggtaatgttgatgtgaatctttgacatcatgttactgagtctaaatttatctgtatgtaagttgacccttgaacaacataggtgtgaactgtgagtccacttaagtggcttctctttcgcctctgccacccctgagacagcaggaccaaccctcccttcctcctcctcagcctgctctacgtgaagatgatgaggatgaagacctttatgacgatccacttccacttaatgaaaagtcagttcattttctcttccttgtgatttccttcattgcattttcttcctctagcttactttattataagaatccaatatataatacttgtaacatgcaaaatatatgttaatcgaccatttatgttattggcaaacattctggtcagcatcaggctatgagtaaattgtgggggagtcaaaaataatatgcagattttcaattgtgttgggggtggttcccccaacccctgagttgttcaaggattaactgtaccttcaaaagatactaacattcagatcttacagggaagtaaaaaaaaaacaaaataacaaaatatattaacatgacaacaatataattatcacaccttaaaaattatactttctttaagttaaatatctaagtggtgttaaatattcttgatcatgcatgtttttaaaaatgttacagtgtgactccgagcccaggtaagttcctacatgcagctgttggtgtctcttatgtctcttttaatctgtaggttcccatcggtctcccactctctttctcattggagaattttatttgttaaagaacctgggtcatttcctctgtagagtcacccacagctggattctactgaccgcatcactgtagtgttgttgaacatgtctcttgtctctgcatgttttgaaattagttggatctcaagacttgatcagattgagggtcagtgttttgttcctggtgagactgctacataggtgatgtatccgtccatcaggaggcacataatataattggttctggttgtagtaagagactttgatcattgtctcttacatctgtgatttcataaggggttgtaaaatgatattatccatcttattaggttgaatacttatatcaaaagaaaccttggtgctgaggtaaagtttctgtaggaaaatcagaagaaatacttgattctttccctatatttaccagtctttaatgggttgattctctagtttctgtttgttttgtgttgctataacagagtacctgagactggataatttataaggaacagagatttatttcttacagtctggaggctgggaaatccaaggttgagggctgtgtctggtgagggtggaaggtggaaggactggagagtgtgcatgaaggggactgaactccttcttctaccaggagcccgctcaccacctgtgagggcagccagaatccttcatgaggcagaaccctcatgacctcagtacctctgaaggccccgccctgtctctcaacactgttgcattgactattcagtttccaacagaggaactttgggggagcacattcaaaccatagtacctggtaaggtaattaatgagtttttaaaatatgtttatgaaatcatgagtgtaaaaatttgtgtttccacattttgcagttataatccccttgtccctccaattccctgtatcccagattatcccatgtggcaaatttccccgggttgactcctcttttaacacaaccttagttgccttaaaaacttccctgacttgtgccacagtagagtgtctgaagttcattctataacatttcctgtcctggacccagaatcagtcatttttgaaagaatccagtcccttcccttcggtgtgaaatggtgtttagagaccaccatgtgggcagcaggggtcctcattgccctgagttaatcatggtcctggggatggagctagaaagggtgtgtgtaggccaggctcagtggctcatgtctgtaatcccagcactttgggaggccgaggcgggcggatcacctaaggtcaggagttcgagaccagcctgaccaacatggtgaaaccctgtctctactaaaaatacaaaaattagtcggacgtggtggcgggtgcctgtaatcccagctactcgggaggctgaggcagagaattggttgaacctaggaggcggaggtggcagtgagccaaaatcgcgccactgcattccagcctgggcgacagagtgagactctgtctcaaaaaaagaaaagaaagggtgtgtgtgaacatcagacatgggatgagtcacactgatccttccaaacttagttcagggttacaagacttctgctgaaccagtgagctgacctctctatttccttccccacactgaaaatcctgatttttcaataataatttcatttgctttggaagcggttttattcttaaggtgtgtcctgttagaaatgttcctgttactctcttaaagtgttgggaattccttaggtccatttgtctcttttaaaagtttagttttctaactttgaaaaatataaaatatagtctcagtcagatttataaaacttggaagaaagtctaacgatcgtgctcgcgtcctccttcctttccacctcacagtagtaactgttcagtgctttctcctttggatttcatgtaaatcagtgaatatgtaggcggacccctggtattccccacatggatgagtggaagcttcctgtccacttacccactgcctggcatctccacgtagtcctgtgtcctccttcaccccatcgcggtattatggagacacttttttcattccgttttgatagtaactgaaagcatcagcacacaagcaggacgtgaagttaccagagtctttcccgcacatgcctatgagtcataaatgaccaggtggaagacacagtggatgaggagacccagtgtacggtagcagcaaacaagagaaaacacttaggaacaacctaaccggcattcaggacctctgtggcccaaggggaaagccggaaggacattgttggtctaacggattgcagagctactggcatttttggcattttagataaatctattccatcggtatcatgtttactgaggtggataactgcatggaggttctgtgagagaatgttcttatgaaacgcacatgggagcctgtgacagacaggcccgagcaatacaaatgtcctcaggtgggacagaacgatgtggtggggagaagagggcgtggcagagcccacggggcacgtgtcagcatttgctgggtccacggggacagaagggaaaggctctgtgctgctgggattcttgcagtgcctctccgcgtttggaactttattccagtgaaaagtagatgtgtgtgtaggccctgaatttaataaggtctacaatgataatagttaaatgaagcatgcaccatagattcgtgctgatggtacatgaatttgtgtgtggtgggttaaattgtatgtagttagcaagtttgtgtatttgtttacgtaagtctttcttcttgttccaggtgaatgaaaactttgccattgatttgatagcagagcagcccgtgagcgaggtggagactcgggtgatagcgtgcgatggcggcgggggagctcttggccacccaaaagtgtatataaacttggtgcgtagctggccacctgtgcacatgttagggcagcctgctcgtcctcatactccccttcactcccagtgcctgttctttctgtcctcttctctacctgctcccgaggcggcccttacggggttcacactgctggcacattcaccctacagcgccacactacagggcctacatagagccgcctgtccgaaaaccccctttcaactgtgaagtggtgggcggcatgtttctcttctcggacgcccaagcgtctttcctctctgggcccttctcggtttggtcatcatctcagctcaggctgccacacacagcaccgcaggctggggtcgaaaacaacaaacacatttcccacagcgctggaggctgcagcccaagaccaccgtgccgctctgtgggttcctcctggggcctcgctccggggcttgcagatgaggtctcctccctgtgtcttcacagggccgtccctctgtgggagactcctcatcccctcttcttataagggcaccaggcagattggctcagggcccctatgtgacctcagtttaccttcatcacctctttaaaggccccatctccaaatacagtcacatcgggggttaggactttggggggcacacggtttattttctaacaatccctatgtaatcttttatgcctgttgatgagtgtcatatacaggaccattgagaaaaaaaagaacacaggaccggagaaagagaccgtgggctgaagctgggatgtggaactggggtgcagggtgggagggaggctgccacagatcactcagggactcgggcggctgctgacctggggtgcagggagagggggaggccaccgacagtggagcactcagggactcaggcggctgctgggcttggtgttctccccaaagcagagtcctggttaagggactttaacttcgttagagctgacatttattaaaagctgtcattatcttgttgcctgtcctgaaaaggggacagtgtaacaggcataaatggttaagcagcctagagtgggactgggcacccggcatgtcccctcctgggctccagccctgaaggccaagcctggttgtgcctcactgtcgtgtgcagcacccaccgcctgctccaggccgctgaggtgtggggagtgaatggagctgcaggctgacagtgatgtccctgggggtcctaggggatggctgcgtagcccggggtgggagcctgaggccaggggcttcggtcagcctggaaccgagatcgacagtctgcattcttacttcagtagtaactgcgtatttttgtttctgacagtctaagttttatacatacattttcaatgcttaatatctagatttgaagtagaatatggaaatatgacatcattccttttgaattttttcaggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgacaatttgtaagtttgtttctttcatagtctgggctttggaagtgaacatccacgtggacatgggtagacatgcgagtggaagcagtgcccgctccagtgagcctgagctgcctcctgccggccgctgcctgccttaccggctgcttctgtgtgtctcctcttatccttggggccacgtgggctgcaggaatgggcggggggcagggaaggagaaggagaagtgcctcttgttttgcagatgcaactgtgcttcagagagccaaggtgggtcttgaggtgcatagtgaaggagggtgcccaggcctcaactggtcctatgggaaggtcagcctctctcctgttgctggcttgcagagctggtctatccgtccgtcctagtccctatgttgaaatgtcagatcttaaaacccaagaatttaagcactggtttgaaggcatcgaaagtcacatactggccacattaaggacagtctatgtttttaaaagagtaaggattataatgtagtgtaacataaaaataaaagtagattttgagggaagagaaaggagtcttgctagaatgatccaggagtctggcctgtgagtaacgggaattccagaggaggaaataccagagcagagggaaggtaagagggaaggtgagacggaaggtgagagggaaggcgagagggaaggcgagtgggaaggcgagagggaaggcgagtgggaaggcgagagggaaggcgagtgggaaggcgagagggaaggcgagtgggaaggcgagagggaaggcgagagggaaggcgagagggaaggcgagtgggaaggcgagagggaaggcgagtgggaaggcgagagggaaggcgagagggaaggtgagagggaaggtgagagggatggtgagagggaaggtgaggcagaaacagcagaaacacatttcccaagccaaagaaaaacccacagatcacagggctcaccaagttcctagcagtattggtgagaaaagacaactaggcatattctggtttaagaaaagaattaagctgtaaactttagagtctagaaaaaagaaaaccttttaagcgcatggatgaaaacaaattgtagtggaaaagtgatcagcgatcaggtatccacctctttgtctttgatgctggaggctggaagagtgaaacattgtccacaatcttcatgcataaccaaagttaaattccttatcctgagaggaagacattcttggatgtgggagagttcagaggtcatcatcctggaccccactggggaagataccttgaggagaaggccttacccagcagacatgatcacagccctcggtgtggggagggaggctgaggcaggagcggctgctagtgggaaccagttcattccagtggcacgctacccagacatgcgtgtgaggccatgctcccgggctgcagggacagtccaatcatgttgcccttggtgctgagttgggaggtctgggagggggagagggaagaaggggatgcaggcatccaggaggtctctgggttgggtgggtggaggtggaaggaggctgaagctccctcttggagtggcgtgaaaacaaaatggagacagatgtgatggagtacattgatgccacctggattcgaaataactgtggcgacatctgtgagctgtccccgtgagggcccagagagggaagagcagcaggccaggaaactgaaaatgtggatgcagaataaccagggatggggagaggtgaaggggtggggccaggggaagggggagagaagggaggagcgaggactcagagccaggagccaggccagcccctgggggagccactggtggagatgaggccccaaagctccaccctgggctacggatgcacccccaccgtctctaatataccacatgcttgtccttcatctgttgggctaccatgctgcttttctttacacgtgttgacatggtgagtgacgttagtcagtcctgcacgttccaaggtggacctgagtgtaggggcaagtcttgcttttaattcccctttaaacactgtcctccttgggtcttcgtgtcagggccgtgctcactttgagttgggaaactgcccacattttctgttctctggaagagaaggtgtaggattgggattcctgtttcttgcctggtggaactcgcaggaaagtcttctgggcctgggtttgttgtgggaaagtgggtatctaagatcaagtctccttgagtagttacaggacgttcagccttcttcttgagccagtgttgtagattgtgttttttctaaaacttggactctcttgccgagactttcagagttttactggcatggagatgaagctcaagtattttcaagatttttcagtgtctcgggttcacagtgacaccctcttttctaatgttcgtctgtgcctttgttttttcctaagtctcaccagaggttgtcagtaacatttgtatttctaagcgaccttcagcttggcgatccactctgttgtatttttggtttctacttaatgtctgctcgttattttcagtttctacattcttgctgtttattttactgttctgtttataactttctgaggtgggttaattattttgttcccagcttttcttcttttcatgtgtatttcatgctctaaatttctttctaatctctgtttcagctgcatttcccctaattttgtaggttattttttcattaccattcagttttaaatatcttacaaaagcgtgtttattaaaacaaagtgtatggggtttacacttttatgctgatttgtattgtggtctgagaacatcctcagatgagttcatttgtgggaagtctgtggagacttgttccatggtccaccacatgcgtttctagaaacgtcttgcgcctgctcagaatgtgagttcttcgggtttcagtgcaggctgacccttgtccagacctcccactgcgggctcccagggcccctcccagagttcttgctctcttcttttgtgcctctttaaagaactacctttgaggctctgctgatagtgtctttcattttaaaatggctttatcttttcactgaatggaatcttttaacaacttgctttcaagtctgttctgccagcatttaactgggctctgctggcttggtctggttacctttgcttactatgtttgttgagtcctttcacctgcatcttaatgtagactttgcttctgttgcatctcctatgaaaatatagctgaatatgtgctaccagtttaaaattctttgtctcttaccttgagattttagtccatttctgtctagtgtaattgctggcctgcttcagtttcaagccgccatctgtcccagctgttccatgctcctgtgtctcctttgtttggcagaattattttatcattctctttccctcctaatactttagaagttattttttcttcaaaacagaaaagccacatacaaactggagaaattgttgacaatgaaaataataaaaaaatttctcatatagcaaaatataggtcataacctatattaatcaacattaaaaagacagctgcctttgagggaaatgggaaaaagcataaagatagtttatgaaagaggaagcacaaaggccagtggtcatgtgtaaaggcaggtgttgcatttccatgatgagctgatgtgaggccccgtgggcaaagcagtataaggagcggctctggatgtctgggctgggggtcagttgtgcatccagaagtggagggagcatcttagtatcttagtattggaaatttatcctaaggagttggttgtcaagtgtgaaaattatacacaaagctgtcataaaaggactgcttatggtaggcaaatgatacagaaatacaggcctgattaaataggtttctttttcttctgcttaattcaatgagatagtatgaatccattggaaataataatatggaccaatattcattgatgtggaatgagtatgttacatacggttgcattaagaaagcaagtaacagaatagttctatagaatgcccactggttgcggctgtagttgtaacttgtttgagcattcatgtataaagaggttcaccaaaacattgactgtgattctgggaatgagatttgggtgatttttactaccctttctgtactttttgagattattataataaatgtgtcacggtaaatatgttttccatacaaaattttacatggggaaataatattcttatcaatgtaatggattgagaatttcagagaagaaaagatctaatattactcatgaagcagaccagtttcagcttctgttgtttacaaaacctacagcagctatgttcacattacagcatccaaaatttgtcattctaatctgtgtccttagacctgttcacagaaacgatatgtcccggctgcaatctctaaggtggatgcacagggcagctggccactctcagagccaattaccctgattggatttctgcagcaccctgaggaacagctgagtcagcagcccagccttcccctgcagagcgtctgcactcgccctgggtcctggaggtagagagcgggcaagctctggtttttcaaccatggtgcttcttgctccgccaggaaatagggcgctggctgcgccaggggaggcggctgctcctgtgccagcttgagggtcccgtctcttccccactcagcctgcctttacctacacatgccagttccaccaccacacattccctctgcgtggctcacttagatattacggaatcttgtcccagacagtcctcctacaaatactaccaactgagttagtgttaggaagttaaaacaagtttcccatggaaaccacattccagctcttgcttttaccttcctgctgggaccggggtgaccaggaagctggagtgagactctggggccctgagggagagccctcaccacagctgctcaccctccatccttttggggctgtaaataaatgtttggctgactgctcaactcccacatagacccgtggtgctgttgctccgagctgacttgaagtgtgggggctcataactctgttctcaatcctgcaggtggagtttagccacaggtggcccatgcattctgaggaagtctctgtgtttcaacttaggacagacccccatggctggcctggcggggaccctgcaatggaacatgaagctccctgagctctccctgcttcttcatctacctggccctgagggtggggggtggtcgccactagtcctagagacatggggggaggagtgcctattgttttggttttttacttgctttgtatgtgcataccaaacacctagttttatggaaaatcagatacatttctccaatcctgtagtaaggctgaagtgtgggtattacacatctggtagtctaggcataaaatgaatttggaaggtgtgtgctgatctcctagggctgcctaacaaactagtgcaaactgggtggcttcaaacaataaatccactccctcacagatgcctaaaatctgagaccaaggtgctgacagtgccctgctcccactgaaggctccaggaaggtcattccagcctctcttccagcttctggtggatgctggtgtgcttcatagtctttggccttccttgactgtcctcaacattccttggctttccttggccattctttgcttttcttggtgttccttggccgtccttggccttctttggcgttctttggtcttattttgccttccttttatttccttggcgatccttcatcatccttggctgtccttgacattccttggccttcctttgctgtcctttgcttttcttggtgctcctgggctgtccttggccattctttgaccatccttggcattcctgggctgtccttggccgtcctcggctgtccttggccatctttggctgtccttgacattccttggccattctttgaccatccttggcattcctgggctgtccttggctgtcctcggctgtccttggccatctttggctgtccttgaccttccttggccattctttggccctccttggcgttcctcggccttcattggccatccttggtgtccttggcctttgttggcctccctcgtccttcctcagtcatccttggacttccttggcattctttgctttgtgtcttcatcgctttattctctgtgttcgtctttatgtggccttcttcctgtgtgtgtctgtcttcatatggctttataatagacaccattcattggatttagggccctccctaacccagtatgacctcgtcttaactaaatctacaaagacctgatttccaaacaacatcacattctgaggttctgagcaggcatgaattttggtgggccgtacttatcccagtgtgggagaccagggtgtatgtctcaacccttctcactagaatgcaaacaagacccccagtttgcaggtatcagacgttcacagacttggagcctgctgaggaagggggactggaagtctggagccaccaacctgtttaaggtacttttaactgttttccagagtaatggtgacctggaaaggagaataattagactcttctatgacggctgaatgttagttctgagctggcactgatgccaggggacccaaaacaccacggtggcctccccttccgtccctggtcatgttctttgctccaaagccttcactatctgattcgaggatagtagctcttgctttctttggttaatgcttgcctgatgtgttattttccaccattttcctctcagcctgtatacatcctcatatttgaagtgagtttcttgtacacagcacatagtttttctaatctactttttctattttttttctattttttttttttctttgagacagagtctcactcttgttgcccaggctggagtgcagtgatgccatctcggctcactgcaacctccacttcccaggttcaagcagttctgcctcagcctcctgagtagctgggattacaggcgtgtgccaccacacccagctaattttttgtatttttagtagagacagggtttcatgttggtcaggcagttctcgaactcctgatctcgtgatccgcccacttcggcctcccaaaaagtgctggaattataggcatgagccaccgcgtcagcccttttctattcttttcattgatgtctttgtactgtttacattgaatgcaattattgatatgttagggcttacatccacctttttgtttttttgttctgtgcttagtgtttcttttaattaattactttaaatggacaaaaaataattgtaaatattcataggatactctgtgatgttttgatgacacacacagggaaggattcatacctgtggtgttctgagcgtctctgtgtgtgggcagctctgggagttatcttacacatgggcatatacggcttcctgatgccaccttagtagggtttgaggtgtggtgttgcggcctggcggaggtggagtccaggctcccccgctggcctttgctggcgtgggtggggtgcagtgtggcccctggtgactggctggatggagcagttcccatccggacatttctcatcctgttatactgctcattccctgggtctccggccagagacagcaggcttttgcaggacatttttgggggttggggggtgcggtttgcatccattggtctttctgtgttgctggcttcttcatctgtcagggatctatgaggaaaaagcccagggctccccagaatgccatttctcaggttccaagcccagcggggctgcctcctcccctcctctcagagtgtctgtcttgtgcttgttttttgtgcagggtccagggttcacggttgcacttagcaagaggcatggggaaagctcatatcctccacattctgtgagcaaaagacctggccattcactgttttggtttttgtttgtttgtttgtttgttttttgcgacaaagtcttgctctgtcacctaggctggagtgcaatggtacgatcttggttcacagcagcctccacccaccgggttcaagtgattctcgtgcctcagcctcccgagtagctgggattacaggcgcgcaccaccacgcccggctaatttttgtatttttagtagagatggggtttcgccatgtcggccaggctggtctcaaactcctgacctcaagtggtctgcctgcctcgacctcccaaagtgttgggattacaggcatgggccgctgctcccggactggccattcacttttaaaggaaggaagcatagacttagactttgctgtgcctggacttcttggggatgatgaaaggtggctggcaggtcaggggcctggtggaggcaagagcagctgacctgggagaaggtctgagagggtgtcctgtgtgggcaggtgcggagcgtgtatgtcagctgctgagggatacatgggaccaacagggaggtattgttcaggtgtgggctctggccccctagcctgcaccgtggcccctgtgcccgggggtcactgaggcaggggagcaagcgacgcatgtcctgatgggggcgcccttcccggcctgatccagctgaaccgcgccacgggtcccagtgcacttgcagcatccccagcactcctgtgaaccgcagaagcctcacctgtctccagggaccacacagcattgctgacgccgagggccccatttcgaggcgacgtgcacactctgcagaagcgtggtcctgcggtgtcccctcccagaggcaggcgggatgacaaaggctcagctgaggtgtctctgccccagacagtggcactgagttgccaaacattggattcaagggcctgagggtggggagggaagcaggacctgcccttcttattgccccatctcgggacacacttggagtttgtgcttctcatttctgcagcctcagctgctggccccctagtcttgcttccgccccgtacttcagtgaggcagccatggagctgcagttgtgagggccgcctggccactttggagcccttgtgctggtgggcagaaggcaaagaagagagctgcttaggtggggcggggcggggtggggggcagtgacagagggtcctgtgaggacctgggcaccgccaggtaaggaggtgcctggagcccagcacgtgtctctgctgccacagtgatgatcatgggtacctggggaccaacagtggccgaggcccagcaacccaactctcaggggtgaagctggttcccccacccggcaggcgatttctccggctgagagtggccatggaagatgaggcacgctactcacaccacatggtaacctgcagccgcatgcactgggaggccctgcagagcctcctctgctagctctctatggtgccgtgacctgggaggggctctgggcagaacagggttagtgccaggcaggaggaaaccaacaagggcagcagtggactccagtggccacagctctctctcgggccccagcttggtactgctgcccttgggcttccccagttgtccccaggcagtgtgtccccctctcccctgccagtgctgggcgctccagctcacggctcggctttgcaaggtcagggcccaagacgtccatgggaacctgcagcacctgcttgcttaccacctgcccgcttgcggccaggaagcgtgtgtgactgtcttggcagtggcattttcctttgtcccagcactggttccgcaatgcattttgtaagggtcctccaggggccacctggggagtggccagggcgatagggtgtcctctgcactctccgttcctgggtgctcagggcatcctgggggtgcctgcctctgcccggctctccttgcggggaagccacactgaggcaccgacactgcccgttgtgaattctgcgaccacttctggtaagttctcaacaagtaggcgtagcacaaagcaagcattcgtgttctcagatcccaagttgtcttttctacaaaagccagtgacaatttagaaacggagaaagtgaccttgctctccaagaagcaaatgaaaatagtgggagcagcatccttgctggccttcttagaaagcagtgtatgaatgtatcttctcatgctttcaacagtcaccacaatttaaaaaatacagtatcaggagaactaaactgacccaggtgattatgttgaagcatcttttttttttttaacttcaagttcttttagcaaagtgaatccatattccacctgattatgatttattccaagaaatcaatcatctacgacggatgagctgagcaggagatgtcgttccagagtgaattaactggtcaacagtcaaccatcgttttccattttgtgtccagacccggacactggtggttcccagccttgggtttcagaggtcagcacaaggaagtcaggaagcaagtttcctcctgtggttgcttctgtggccagggaggggcgtccatctgggattctcatcctgtcacacaagcatggcgtactaagccagcaggcagggacgccattgcttctgaatgacggttattttcagggagggacccttggcagtcctacaccacccttggtcacaggtgtgtttctggttctgccggcagcagcgttcaggagaggggtggggcccttagaaccaccgcccaccccagcaaacctggccccaaggacggcctcgccacatcagcctcacggctccggggctgtctccaccacgagccagtgtccacagtgcccgctgacctggggagtggcttggcttggcctggcctagaaaagaccttgcctggctggaggccccacctcaagggtgacctcctgggtggggaggaggtatgccggggtgctcccagtgcagcatgtgtgactgttcagcctttctcccaagacggagccgcccaacctttagcgtgtctgcttccagatggggaggcccagtccctgtggaagtgactgctctcccgcggcccagcctcgggaccctcccgtcagccctctccattcacgctaaactgcgctgttcctcaggctaatatcaccattacagtactaatttattagacacagggagattttaaatttcattttagtgcagttatttaaaatttaaaacgataacgtctaactcaattaaatttcagttgatttatttaaagaattgtaaatgcacgaagtctaataacatgagtgagtcataagaactctaagaacagcttcatctccatgtaggggacctgctttcgggctggtcttgtcaggaggtaacagtaagaaagattcaaaccaggcagatccgggattgaaaactgatccagcctcaacttcctggactattttttatctacctaaacttctcatgtcttacaataattacgttttcttttttacctttctttttggggatttctggcactttcatcatttagaggctctggtggaagagccagctagctgttcaccactgtggagaggactttgaaggcacgggggccacgcctggcatcccctgccccatcacgctcctcgcgtggagctctgtttcccagcttgactttgtgcctagatgaaccggctgaaggatgcgtgacttgactgcgtagatgaaccggctggtagcacactgcggctcctcttatggaaacatgctcctggccctgtggcctgtggggccccccctccccggatgttcgcatcatctcgccaggtcagctcagcaatgtcgtctaacagccgggactgatgtggtctgcatggctgagccccccagatccgagtgttgaaaccctcggtggggttatgaggaggcgggtatgaagtggtatgaggaggagggtccctcaggaatgggattcgtgcccttataaaagggactccagagagcttcccgccccttccacaaagtgaggacacagcgagaaggggctgtccgtgaactcggagctctcaggggacacgaaacctgccggaggcctgatcctgcgtgtcctggggctctccgtgggcatttcctgtctgcgtggagaggcacagccgcagcgggagccggagcaggtggtgtgcagggagaggcggagccgcgcgcagggaggggcggagccgcgcgcagggaggggcggagccgcgcgctgggaggggcggagccgcgcgctgggaggggcggagccgtgtgcaggaatgagaggggcgggagagcccgatttcactgcttgcgcccttggatgctgcttgagcccggttgtgggttctcattctgttaggcagattgggcttggtgtttatcccattcactggatggaatcctggtggactgaggtctggcccccgcttaggaatgcggagatgggagcaggttagtcctgtgctggctccgaggtcgccctgaggtcgcgccctgggctgtgggctgccccagctgcttgcttccaggagcaccattttcccttgcaaagaaaggacgccactgtggttattgcacgtggctgtcgccagacgttttctgaagccagatgaagtgagcccactactttggggagatcagtcagctctgtttgtcgtcagaacatctgagcattcaaacaaatgctagagtttggggaacgagtatcccccactgtgagtttggcagtttcccaacatgtacagactcctgaggcgctcggtgagaatgaggatgaatgcgacttactcaccttgtgaagtagaatgtgctgacttacggagatctgcttagctaagtgacccagtatctgctaatgaccagtgcaagctgttacaaaattatgcgtggttaaaagagtcaaagtgcactatgaggctgggcacagtggctcacgcctgtaatcctaacactttgggaggccgaggtgggcggatcacctgaggtcaggagtttgagaccggcctggccaacatggtgaaaccctgtctttactaaaaatacaaaaaatagctgggcatggtggtgcgcgcctgtaatcccagctactcgggaggctgaggtgaggcagaagaatcgcttaaacccgggaggtggaggttgcagtgagccgagatcgcgccactgcactccagcctgggcgacaagagtgaaactccgtctcaaaaaaataaacaaagtgcactatagaccagtggagtttaacacaatggaatatgaagttcactggtatgtttcagattttatttttgggaccaagctttaggaaactgtaatttgttgagttttagtgtaatatcaaagaagaatccaaattctcagaaaatactataaaatagatctttcttttccaactagatatctgtgtgaggctggattttctttgcctactccaaccaaagcgacacatcacagcagactggatgcagaagcgtgcgtgggaatgcagctgttttccatggaaccagacgctacagagactgcaacgtgtaaaacactgccattcttttcattcctttgaataatttttttaaaatttgctatttaacacgtaatagttttttattttaaa

SEQ ID NO: 36442 - DNA, 305301 bp, Homo sapiens
gtccgcctgccgcccgctggcctgctccctccggggcaagtcttgcttcttaagcgctcctttcacacacgcgcgcgctcgctgggccgtcccctcctctccggccctcctcctcctcctggtccttgctaacgctgccgtcggggaggattgatgtcccttcagcatcatgcagccgccgccgaggaaggtaagggcgcagctggggggctttggggttcggagagatgcgtacgcggaacgcggctggggcgaccgctgcgccccttccccctcccgcaaggggccgtgaccgccctcgtcttgggcttgtcaccgacttgccgccggctccaggtggggggcgcgcgtgtgagttgcctttccgacagaggggccgccggggctcgtccgtcctctaacgcaggagacccccagacatttcacaagagtttcgggtgtgcatttgtgtgtgtgcgcgcgcatggcaatgctgcccgctgcaaagtgcattctcggggctgcaccgagggggaggcggggacgcccctgcagctttgcagagccttgtgcgtgtgtgattgtttagtctgcaccagctttgagccctccagccgcttgtcgccagccccgcccgtttgcaaatttgcgggggatttgtttctagcctagccttagggtttggcctgcttttcccacggggcggccgaaaagaagttggaatagtcaccgcctccccaccccaagggaaaacaaattaaggattgacgggtcctgcctcgtccccggctgaggggcgaggaggctgtcgtgctgtcttcagaaaagcgaggaccgggcccgggaggtgcgtggggtgtgcactgcgatccggggttggatgaccagggtgggagtgacggatgcacccggcttgtcatcagtctccccgctgcgcccttccccagctttcccaggggccgaggctgtgtccttgtctttttaatcctacagatggatactgaatgtctactctgggcactgggtggatgaggccgttctgtcctcccctcgtgggcaaacatttgcctaacgcctaactcacccgtgtctgctgccgctgctttctctctttcctaatccgggtttctccatttaagtgagtccttttctttcgaacatgtacccccacccctccgggtggtcccactgctgaggccgagattccagactgaccgttaacttcgaaccctggggccccggcctggcgggcgaggctctctggccagcaggcatttgctgttctccgctgtttgaagtggagcctccacggggatcggcttcccggggtagtttaaaagcactgcatatgctggaaggtcacttttgctttctcctttgtgagaaagagattgtgatttgatgcgctgtcagcaagtcgagggcatcattctgagacagtgtgctttttcgcagccattatggagtaatttatgtagtcgattcaggcatattatcatgattgtgtaaatattggtcattgggtatcaggcactcttaggctcccagcccccatccacactctgctcacctctcctggtggttaatgtctttgaatcttttttagaaatagaagacaggctcttttaaaactgtaggaagacctagacgtggattgagcttgtgcatgaaatggaatgactggcagtttattttgcacgtctttagtttgtaatatttatagtcgtgtattttcatttaacctctgttcaggctatttggctttaatttttcattaaataagtatcttcaataaataaaactagatggcgaatattggatttatggccttcaggggagaggcgagcaagagacatattctgacagatgtattttcctgaagcaatttttttgggttaaatttgtaaaaagaccttcataaatatatggtatattttaggtgaaagttacacaagaactgaaaaacattcaagttgagcagatgacaaaacttcaagccaaacatcaagcagaatgtgatttgcttgaagatatgaggtaaggctatagtaaatagttcaaggacttctgtttgtctgtttcaaagaacctttgagttaccaagccccaggaactgatgatggaatttccttttggatttcctgctttaaggctgttagaactttgactcagctggaaattagaactggaactaacacaatacaaactttttccttcagtgggggacctataatgcacacatagtattcagaaaaaacaaggaccttaaaagtcttactagtcaaattataataattaaagattcttgtttaaataatctttccacggaattgtaacaatcattttattgaccttaacggttttacacagttagatttttaaaccaacacttgtggttaatggttaatatctgggggtgagccagtcaaccccagatggttatatgctctcactgggttagaacatgacaaatacaactttgtttttgagtgccaaatttagtgagaagtgtgtttatcatattttattttattattgaggttactcatattcataatcaagttaactttgaatagctaagacatcttgctaatattgtgaaaatcagtatctttcttactagagggatggatgacttattttaatgaaagaaataccacttatttaacaatcttgtaatacagactgacagttcaacaaagattttcgtcaagaatggaagatgatttgcatggtgaagcaagagtggctgcaattcttatttcccttgtataatacatttatcaaattggaattgggtctgtaagcctcatcagttacctagttttctggtggtacactaacttcgtgttggtttcatgaaaaatattaactctggtgttaatgataaaattatgtgtttggattgctgtttatagcccaaagattttagtttcaagaatttccttttttcctctcctatatttaggcactataagcatttctgctgtatacctgtcttcagggtttatgactaaggcatataaatctattctcatccaacctggatatatcaagattgttgttttctgactgaaaattacaattttaattctgtatttgtcttccttcccttatcatagccataagaaaatatttagacttaaaaattcctatgcgaggccgtgcgcagtcactgacacctgtaatcccagcactttggcaggctgaggcaggcagatcacctgaggtcaggagttcgagaccagcctggccaacatgataaaaccctgtctctactaaaaatacaaaaattaaccaggcatggtggcgtgcgcctgtagtcctagctactcaggaggctgaggcagagaattgcttgaacctagtaggcggaggttgcagtgagccgagatggcaccactgctctccagcctgggcaacagagtgagaccctgtctcaaaaaaaaaaaaaaaaaaaaaattcctgtgcaagatatctgaaactcttgacatggttaaaaatgtaaggtttttttaacttattaagcaaactaagaaatatctagatgaagaaagtaatacattttcagaagcagttcaggaaggcagaattagtgtgtaagtgaagatcccgtgtggggtatgggtggtcagtagttgtaataatttctgttggttgtgtcttctaaagacttcttgattgcgttttgtctccatttttcccctgttgtctgtagcttggtgcaggagcttatggtcaagaatatggacactgcagtcagacagtcctgagtttgtgtcctgatatctgtgctgacttgtagaaaatgaattaatctttataaacttaatttttcttatttgtaaaatggggcaataatggcctctgttgcccaaggttgtattgatcaaatgacaatacatatgagatgtggcacacatctaagctaagttgatatagtctgttgctcctgttgctgttgcttagtttgtattattgctgatccatcacattttgcttgcaatatactagtatcctaattattgcagtagtgtccttatatcttccatctcccatctcttcttttaaatatgtcttccacattaccaccagttagctttctaaaaacattattatagatcactcctctgtggccttctggataaaggtcaaacactttgtcatagtatatatggttctctgcaacccagctgcaagcttcctttcctggcttagttactaccgtttcatgcccatgcatccttcctctttcttccccctgctctggtcactcgggacgtcaggttgtctaactgtgcactctacattcatgcccctgtgtatgctgttgtctttgcctgttggtacccttcctcccactttttcacctgacaaattcttgattaccaataactgcaagttctttgttctctgtgatctcaaaggattttgattttgcacatggttctggcatcctccctcagatgaagtctttgaagttatgggctattattcatttttgtatctttatacccttgttgtcgaatgtaactggctatatttaaatgtatcttattttttcttgggtgagatactgtatacactctgtaggggagctataggggcctctgttgagcttgtgttatatactttggttcacgtgatcactttaattacactatcttgtttgttgtagagtatataatatgtaaagacagagattgttggtgctccaaggattaacaggttttttttaaaggagttagtgtgttcttctatctatattaacttaatggaatgaatcctttcattcccatagagttgtaaataggataccgtattacctactaaaacaagagtttaggtttctgatttgcttttttttttcaaagacaatattgaaaaagttgaaacttgcctcctcttggtattcatgataacttcagttgcctgaggaaggaggtgatctggcttctcttgtctgccctagtaagtggaatgattttttaaaaattcactggaaatctctgaacttggatgtttttttgtttgtttttgagacaaagtctcgctctgttggctaggctggagtgcagtggtgcaatctcagcttactgcaacctccgcctcctgggtacaagcagttcacctgcctcagcctccctagtagctgccaccacacctgccaccacgcccggctaatttttttgtattgttagtagagactgggtttcaccatgttggccaggctgcttttgaactcctgacctcaagtgatccacccgcctcggcctcccaaagtgctaggattacaggcatgagccactgcgcctggcccgaacttgggtttttatatgaattaagttgtaaaggatcttacttgcttttcctcttttgagactagtgctccttctcaccagtgccccctgccaactttatgctcaatttaagttagtatgaattcacttagaaaagtacaaatagctttgtgttcttaaagaaattagtagtagataattttttttattattattaaatttgaggcagtctcactctgttgcccaggctggaatgcagtggtgtgatctctgcttactgcaacctctcctctcgggctcaagcgatcctcccatctcatcctccatggtagctgagactccaggtgcgcggctaatttttgtgttttttgtagacatggggtcttaccatgttactcaggctggtcttgaactttgggttcaagcagtcctaccgtcaggccactgtgcccagcttgagaaaatgtcaaaagtttttatatcattgaaaaaagttaaaaaaaaatctacagcacattagactgtaaatagaattttatgctaaattttgtctagttcttccccattacgtcccttcttttttctttctttttttttttttcttaagagacaagagtcttgctctgttgcccaggctggaatgcagtggtgtgatcttagctcactgtgtccttgtcctcctgggttcaggtgatccttctgcctcagcctcccaagtacctaggactataggcacgtgccaccatgcctggcttattttaaagattttgtagagacagggtttgtttgttgcccaggctcgtcttgaactcctgggctcaagtgattctcccactcagcctcccaaagtgctgggattacagaaatgagccactactgctgcaacgcaccccttaatccccagttcttatcttttggaatttcgaggggaggagaccaattatgatacagtttttctcctttgttctcctcccctttttcagttcatttgttctgcgaatggcatttggaagctagtatttgggagtgaagtttgagatgaaaagacaactaatttgttgttaatcagggacattccatgctttgtggaggttttatactgatgtgtttcctgttgacttttgctatcagcagtagacaagtagagtctactttctttttagtttattattatatttttttctctttgctttttaagaccacttacaataagtttctacatactagagtctgtgtacttttcttcttaggattgtttatcctgtgctatgttgagtagagttagttaagaaaaattttttgcagtgacccagaatttaaagaactaccttcttagaggacagtttaaggaggtctataatatggaaaaattattgaattttagtcaggtggatattatcatgtttgttcattttatagatgaaagtgggaactgaggcacagtgaaatgaagtgaattatattgttgaagactctaagctatttgtcctgatttccatactactgtactctcccctgtatctgtgtttcccaagcttttaaccaaggaactcatcatgagtccagttgtaaaaaatattttgcctatcaaaaagtataatatattatcaggaggctgggtgcggtggcttatgcctgtgatcccagcactttgggaggccaaggcgggtggatcacttgaggtcaggagttcgagaccagcctggccaacatggtgaaaccctgtctctactaaaaatacaaaaattaggtgtgcatggtggcgcacacctataatcctagctactctagctacttgggaggctgaggcaggagaatcacttgaacctgggaggtggaggttgcagtgagctgagatagtgccacagcactccagcctgagtgacagagctagactctgtctcaaaaaaaaccaaaaaccaaaaaacaaactcccccccagaaaacagtatattatcagggaataatttgttttcttattttttgatacattgagctgtcgatcagctccaaatcactattttcaaaccgttaacgtgagtttcaccaaagtcaaagacacttaaaaaactttatcccagagaaggctgaatatgtgatttcttatagatgttctgaagaattgaaactggctcaagaagcacctgtcctgcctttgcagacacctggtggtctagagacctcaagtgaggaattactgtactgtatgttactttctctgaactgtagattcccaggagtcatgggagattggattccaaggtctgtttatggatgttctgagactttttttttttgagacagggtctcgccctgtcacccaagctggagcacagtggtgtgatcatggctcactgcagcctcaacctctcagacttaagtgatccttctacctcagcctcctgagtagctgggaccacaggcatgcaccaccatgcctggctaattttgtattttttgtagagagagggtttcactatgttgccccagctggtctcgaactcctgggctcaagtgatcctcccaccttgacctcccaaagtgttggggttacaggcatgagccactgtgcatggtgctgagactttttttcagtgtctcagagactgttgtatctagaaagagatcttagaggtaatctaatctggtctagagtttttttttttaaggctttatttatatacaatgtacatatcatgtaagttacatgatgtgactgtatatcatatatgattacgtatcccatttaaagtgtaccattcaactttttttttataggattgtacaatcgtcacgccaatttaaaatgttttagttacccctaaaagaaacttggtacccattagcagtcgctccccataaccctctccagccttaagcaaccacttatctactttctgtctctatagaagtggaatcttgcgactggtttcttttggcataatggttactttttttttttttttttttttttgagacggagtttctctgtgtcacccatactggagtgcagtggcgcgatgccggctcgttgtaacctccgcctcctgggttcatgcaattctgcctcagcctcctgagtagctgggattataggtgcccgccaccgtacccagctaatttttcaatttttagtagagatggggttttgccatctcaaagcctcagtgatgtttagtagagatggggtttggccatctcctgacctcaagtgatccacctgccttggcctgccaaagtgctgggattacaggcatgagccactgcgcccagcctggtgtaatgttttcaagattcatcaggttgtagtatcattacttcattcctttttattgccaaataataccccattgtatggatatgccacattttattaatcccttcatcagttgacagagatatgggttgtttctactttttactattattaataatgctgctatgaacatttcatgtataagtttttgtatggatatatgtttttcttttggatatatacctaaaaatggaatgtctgggtcatatggtaactctatgtttaactttttgaggaactttcaaactgttttccaaaatagctgctccattttatattcccaccagcaataatacatgatgggtcctatttctccacgtcatggccagtgcatgttattgtctgtctttttgattataggcattctagtggatgtgaagtgatattgtaagtggctttgacgtgcatttttctaacaacttatgatggtgagcattttttcatgtgcttattggccatttgtatatcttctttgaagaaatgtctattcaagtactttgcccatttaaaaaatcatttttattgaattttaagagttctttataacatatatgatttgcaaatatatgcagtatttttttcccattctatggaagaatcacctgaggttttttttttttttttttctgttaccgtttcattctgtcacccagactggagtgcagggggcatggtcatggctcactgcaatctccaccttctgggatcaagcaatcctctcaccccagcctccggagtagctaggactacagttgcacaccaccatgcccagctaatttttgtatttttttgtagagatggggttttgccatgttgtccaggctggtctcaaactcctgggctcaagcaatccacctgactcagcctgccaaagtgctgggattacaggcatgagtcacagtgcctgtcttcacctgagttttttatgtgcacttaattttgagaaccactggtaatggaaacaagagctttgaaggtaggccgtagattgaaacccagctctgctgcttattagctgggtaatcttggacaagtggcttagcttttctgagcttcagtattttgtatgtgtgaaacaagattaatattgacctttttgcttttctgtgaaagtaaaatgagacaggtgaaatgccaagaatggtaggtatttagcattggtagctactgttattagtggaaaattgaagtccaggaagaatgttgtcttattcaaggtacaaaaggaagttatcgtgtttcatgaattataagaagcacattgttttacattcttacatttctgaaatcaagatgcatcttatggctcttttaggctgtgatgcagttgtcattgcctcttcatgcatagaacttgcgggatgggtatcagcaatcttgtaagaaaatcccagagacaatggttggaatacaaatgttggatcacctgggcttttgatagcatggaggatggtaatttgtggaaatatatggatgtcagtgactgattcaaaaaaatgagaagagttcgactctgaatgtgacccatttatgcaccagtttatttcatttatctttttttattatgcatatgctaaactctgactaaataagtttaaaagaactcttttaataagtataaatgaaaattctaagtaacggtattgtgttaattggcagcatttttttcttagcagaatataaaataatgtgtcttgcagttaatggtgttcttattttttaaattttttaatttttttttttttttgagacatagtcttggtttgttgcctagaccggagtgcagtggtgcgatcttggcttactgcaacctctgccttccagactcaagcgatccttgtgcctcagcctcccgagtagctgggattacagctgtatgccaccatgcccagataatttttgtagtaatttttattttttttgagacgaagtctcactctgtcacccaggctggagtgcagtggcgctatcttggctcactgcaaggtccgccttctggtttcacgccattctcctgcctcagcctcctgagtaggtgggactacaggtgcccgccaccatgcctggctaattttttttttttttttttgtacttttagtagagagggggtttcaccgtgttagccaggatggtctcgatctcctgaccttgtgatccacctgcctcggcctcccacagtgctgggattacaggcgtgaaccactgcgcccggcctaatttttgtagtttttatagagatgggatttcgttatttggttagggctggtctccaactcctggtctcaagtgatctgcctgcctcaagctcccaaagtgctgggattacaggcgtgaaccaccatgcccagccctcagtgatgttttagatgtgatgaaaactggaagtagcagatcaggtactggactcaggtatttaaaaattcattcaacaatcatagttgcttctcaattagtattctttcaaattagaacttaaaatgttgtaaatcttgagagggagaatttttgaaaaactgagagctgcaagaaaaaaagatcaagtagggctacacttaaataacatttctttaagagagggaaaaaaagattacctgattttataattaataaaaggtaacatgcaacttcgaatgactaaataaaatttaaatgtaaatatatacttccatattatggtcagttatgttggggagaaaaaggagatgctaactaggcagagaaggaaatatagtttgagagggtctgtttaattaaactttttttgtcacagaccactgtgtacttgaaattgaaagaattagggttttggtaatacctcttcctattggtgactcttggtttattagctcctaagccattattcagaaatctttacctgctcctaaaatttaaagattcttttctgaatgggacagccattgcagcccaaggcaggtgaagatagtttatgattcatagacatgaatagaggatactctcctgaacttgatggtattaaactaaggactaataatgaaagttacttatctctagggttaagaatagaagtgttagtctggcaccatagcacgtgcctgtagtccttgctaaggcaagaggatctgcttgagcccacagtgagctatgatagtacttgtgagtagccactacactccagcctgggcaacttagcaagaccctatctctaagaaaaaagtattgaataatttttatgtatactttaccttcccctggtctttttagccacacccaggtatataaatataagagattatgggccaggcgcggtggctcacacctgtaatcccagcactttgggaggccaaggcgggcggatcacgagatcaggagattgagaccatcctggctaacatggtgaaaccccgtctctactaaaaaaaattagctgggcgtggtggcgggtgcctggagtcccagctactcggtgggggctaaggcaggagaatgacgtgaacccgggaggcagagcttgcagtgagtgagctgagatcacaccactgcactccagcctgggcgacagagcgagactctgtctcaaaaaaaaaaaaaaaaaaaagattatgaaggtaatctgtgtggtagcataggtgtgatatatcggaacaagtgctagtttacagcagtggtccccaaccctttttggcaccagggaccagtttcctggaagacagttttcccatggactgcgggtggggtcagggggatggttttgggatgattcaagtgcattacatttattgtgcactttattcctattattgttacattgtaatatataatgaaaacaattatgcaacccagtatactgtagaatcagtgggaggctgagcttgtttttctgcaactggacggtcccatctggggttggtgggagacagtgacagatcatcaggcattagattctcatgaggagcatgcaacctagatcccttgcatgtgcagttcacaatagggttcgtgccatgagaatctaatgctgctgctgatctgacaggaggcggagctcaggtggcaatgtgagcaatgcgggggcggctgtaagtatggacgaagcttggcctgcttgcccgccactcacctcctgttgtgtgtcccagttcctaacaggccacagaccgttagtggtccgtggcctgggggttggggacccctggtttagagacatgcaacctgggtatcaattctagttcacaaattatggcgcccagctgtaatttgttttgtaattgagaacatcaatttagaaattagagtctctggccaggcgcggtggctcatgcctgtaatcccagcactttgggaggccgaggtgggcagatcaagaagtcaggagatcgagaccatcctggctaacatggtgaaatctcgtctctactaaaaatacaaaaaattagccaggcacggtggcacatgcctgtagtcccagctactggggaggctaaggcaggagaatcgcttgaacccgggagatggaggttgcagtgagctgagatcacaccactacactccagcctgggcaacagagcgagactctgtctcaaaaagaaaataaaaataaaaagaaattatagcctgacttattctttaaagagtaacctgtgggttgaaacgtgaaattaatctcaaagataaactgctccagtgatgctacagaatctttcaccacggttagtagtcctaggtaccttccatctttctgtatgttggtaatgattctcctcgtgattgctggatagtttctgcaactccaagtactatattttcatataacaacttcaggtggaagaagaggagagcaggacaatttctccttatgcaaatttttcctacctttctccctccttcccccatctctgtttccttccttttttcttttgttccaccagggaagaaattttttaccagaaattaactcaacagactttcccttatatttcattatctgtgtttgcgtcatatgcttgaacatgcctagctgcagaggaggctggaaatgtgatcttcttggaggtaggtccttgccaacaaacaaaaaaggtagtggtggcagtaatgtagcttttgccacattattgttttgcctgatttgctgcagggacccatttccagtttactcctagaggttcccataaaagtattaaaaaatgcattggagttagattatgagggctatcactggaactccagttgtcccaagctgactggtaattagagactccatagaaattatttgtattccctcttcccaattccttttgaattaagtatgtcaggttaggagtaggtttttgtattttggcctcttaggattctcctcccaatcttaccacttcagtcttctgataatttggagaaatggtggtcaaagggcccgcaggcaattgtgttctcagtgaaccttttttttttttttttttgagatggtcttattctgttgcccaggctggagtacagtggtgtgatctcacaacgcctggctaattttttgtatttttagtagagacggtgcttcactatgttggccaggctggtctcaaactcttgaccttgacctcaggtgattcccacccccgccccccaacccaaagtgttgggattacagcttgagccactgcacccagctgtgaacttctttttacttctcaggtgaaggcattagtgaagtgcctaaatttaaaggagggaaggccatataaagagttttaatcacccttagctgaataatttgccccttaataattgatgattggcaatttactcttgagagtatcaagtctgaagctgtttatctgaggaggcctgtaagttgatggttttctttgtaaattctccagatgttcatttgagccccacagatgccattctatgttgttggtatcagtcttcaggggtgatctgatgcataagcaggggttagttttgtaagtctggctcgtgttcttggcttttcagtaactaattagggatctaggcacagaaacttgtaaccctgtcctttgtcccactgctgcagatgttctgtcagtgttgatcgggagtaatttatggaaccttagctggtatttttgttaatttcattttgttaggtcctttcaatattccttgatcgtgctttgttttaacattccatttgatctttttggcattcatgtgggaatcctttgtcatccagatgttttctgttttgtgagcttggaaataatcccaatttaataagaaaatgttatttctggtgttatgaaaagtgttaccatgtctgtggttccacagaaacaagttggagtatatattatatatgtctcctgattgtattttagtgataattgtttttcctcttactggtgattggaggatgggagcaagggacagagactctttttgttgtttgcttttgagacagagtcttattccatcccaggctggagcacagtggtgcaatctcggctcactgcaacctctgcctcccgtgttccagcaattcttgtgccttggcctcctgagtagctaggattacaggtgtgcaacacgatgctcggcaaatttttttatttttcataaagatagggttttgccatgttggtcaggctggtcttggacttctgacctcaagtgatccacctgccttggcctcccaaagtgctgggattacagacgtgagccactgcacccagtctaagctttttattgtatgttcttttttgtgtattttgaattttaaactatgtgaatattatgctcaaaactaaaatttaatgattcagtaatattggtaaacattttattgcatgtctgttaagcataacagatatttaacagatattataaaagttcgtattagttgatgctaaaatgccatttttggcttttaattagtttttagtgaagctattttcattattaatagactttaaaatttatttctaatatgtacaagtattaagaatacttgatttacaaacttttcttcataaagtgattggtttccagttggttgtagcacaaagttgggaaaacaagctttatgtactactgtattcctttctttctgtattgtggaatttttttttttttttttttttttttttttttaagatggaatcttgccctgttgcccaggctggagtgcagtggcgtgatctcagctcactgcaacctctgcctcccaggttcaagcgattctcctgcctcagcctcccaagtagctgggattactggtacccatgactatgcctggctaatttttgtatttttagtagagatgggatttcaccatgttggccagcctggtctcgaacttctgaccttgtgatccgcccacctcggcctcccaaagtgctgggattacaggtgtgagccaccgcacctggccgtggaattcttttgtcttgaaacaagcaaacatattagatagagtcttgcctaatgtcaaatttcattttagctgcctttatccaaaggttttatatcatagccatcaattaaaacattgtttctgttgtgaaatgtagttttgcattagccagctctctccatggaagaatggtttgctctgttttactaaaagaagtgttttatataatagtttttcttagttacattgaatcaattgaaattgttagtattccattttctttctttcttttttctttttctttttgcatttgttagctattcctctgtttttaaagtggtcattctaagatatgacattgtgtttttttttgtcttgagacagggtctctgttgtctgggctaggttatagtggtgcggtcatggctcactgcagccttaaccccttgagctcaaacagtcctcttgcctcagcctcctgagtagctcagactacagatgtgtgccactatgcctggctaattttttaaattcttagtagagacagggtcttactatgtctcccaggcatcattgaactgtggagctcaagcagtcccccttctttggcctcccaaagtgctgggattataggcatgagccaccacactcgatctacaccatgcattcttaatttatcactgtctacttagagttaatattgtaccattccacatacgaccttacaatggtctaattacagttattccatcccagactttgtgctgcttataaacctcgtaatataatgttagttttctttaaacaggtatcttttaaaaagattaagagaaggaaaaaagtcttatatttactaatcctgactcttctttccttcctgaaaccaacatacaggtttgagtttccatctgttatcattttctttcagcttaaggaacttccttcagcatttctggtgcaattctgcagcttttgacacttctcttagctttcatatgtctgaaaatgtctttatttcaccctcactttgggaagatatttttgctggatatagaattctgagttggtcactccagtgtcttctggctttcattatttctgatgagaagttagctcttacttatagacttgttcacatctatggaatgtgctttcccttgctctaatagcttttttctctttatctttggtttcctacagtttgagtgtaatgtgactagtatagtgtctgtaattatcttgtttggggttcatcattcaatggttgatgcttttcatgaaacctgggaaacttctggccattgtttcctttttttttttttgagacagagtctcactctgttgcccaggctggagtgcagtggcgtaatctcagctcactgcaacctccgcccccttggttcaagtgattctcctgcctcagcctcctgagtagctgggattagaggcacacgccatcatgcccagctaatttttgtattttcagtagaggcggggtttcaccatgttggccaggctggtctcgaactcctgacctctggtgatccacctaccttggcctcccaaagtgctgggattacaggtgtgagccactgcgcctggcccattatttcttcaaatattttttttctgccccattctctctcttctttttttaaaattattattattatactttaagttctagggtacatgtgcacaatgtgcaggtttgttatatatgtatacatgtgccatattagtgtgctgcacccattaactcgtcatttacattaggtatgtctcctaatgttatcccttccccgtccccccatcccacaataggccctggtgtgtgatgttccccatcctgtgtccaggtgttctcattgttcaattcccatccatgagtgagaacatgcggtgtttggttttctgtccttgcaatagtttgctcagagtgatggtttccagcttcatccatgtccctacaaaggacgtgaacgcatccttttttatggctgcatagtattccatggtgtgtatgtgccacattttcttaatccagtctatcattgatggacatttgggttgccatatgcagaaagctgaaactggatccctttcttacaccttatacaatattaaggcctgttcatgacaaatttaaactttaattttatgataagattatctcttttcaggtaactcagtttgaccaccttgttttgatttatagtggatcaagggctgaaaggcaaagaagtttaaagattcccttttaagtaagagtcagttggccagcacctgtaactagagaaaaggcagctctgtttagactgcatttgatcagtctgagaggtgatatactctccagcctctgtgatgttttgaagtggtggagggggatggttatgcaattaagaagatcgtatagtttattcaaattcctgaatattgccattatagtgtgatgacattgtctttgaaatattttgaattcccagaattaaacatagcttattcaaatatagatgccaagaacgcattataaaagcaagagtcacctgtgcactttacattacagatgcctaggccctattcctaagattctgcgttggtagattttgggagaggcctgcgcatatataaaaagccatagcatatgattctcatttgtaattaaggatgagcgctacttttccaggagttaccaccgtttaatatgcattgtttgatatgcatttcagatacttttcctgacctcagggattccaggaaatactggcttggctaggagatactgcaggagaggtggaattccaagatgtataaaattatcaattggatagtcaacattgaatttgtcataggtcaaaaatgtcagtgaaataattggtgatttaacacatttattttattgtgtaccccaatagatgatagataaagagagtggcggtttggcttgtttataaagtgtttttctcccttctttaatgtatatatagttcatgttaattaattacagatttatccttcacctatgtatcttttaaaattaattattttgtggttttttttgatgggacaaggaaggatgaggttccttacagttgtataaatgttcaatgattaagataaactatgtgtactctaaatgtaactgcgttgtagagtatgaaaacattcagcaatgagactaaatgacatttacttaatctgcatatcttgtagattctttgtaaatgtagtagaacagccacactataaagctattgtttgtgctcttttgaaaaatataatccactttgggatggcaaattcattctttatgaatttcacagagtccaatagagactttttttctaagtgtctaataagtaccatctccaaggcatctgagtaatatatatcctaaatcttgccatgccttcattggactgtattaattctcttaataaactgtccccttctttttccctcattaacactagttttctacttttgcctatttgatttaacaaaggaaatttaagtctctattccttagccatgcatctctacttcaggccatttcttacaagtagccattcctgtgttctgaagagcagatcaagaaagaagatggttaagtggtgttacctttgtgcaggatagtgcagtctgccactgaggggatgcctgtatacctgctttcctggtggggtggttttctctggggctatcagggtgcattcagctgcagcagagtctatgtcttgatgtttcttctggtagtctgagtctctaatacggggaagtttttgtacttgtaagaggttggagtcagttattatcagcgtcattatttttctttgatgaaaacataaaatttgaatcactttcttattgatttggctttgagctacattttttttttttgccttttaagttagcaacaacaacaaaaaactctggtattaaagaaaacctaaaggagaaaaccccactatcctaaacagataactgtttcttacttggttttgctttatgtttgtctatattgattatgtgtgtttttacatagttgcagtcatattgtagatagcattttgtgttcaattttttaatgaaacattatatcctaagtacttttcaggttaagtactatcataattataactgtgtggttttccaagtgtatttcctagaccagtggtatcaacaccatctggaacttgttaaaaatgcagttttgtaggcttatccctaatctcctgcatcaggaactctgagagtggagcccagcaatccatgttttaataatcacttttaggtgattctcatatatattaaagtttgtggaccactgttataaattatagctattgtttacagtggcatttttattgtttacttaccttaccttacaatatctaaggatgtagactttttttttttttggcccttaacaattactgattctttgttaagactttattgtcttaagctttacaggttgattttctgtttataaaatgttaaacatctattatttcatttaaatcttagcaacccaagaggcagatatcattatttgtataggtgagggaacttaagcacagaaggatttactaatttgtctaagatcacaacttttaattttttattcttttaaagttatatatttataatgctttatgaggccttttctggtatcctcccttctctttttcctttttaagtgtccttcatctgtgtagagtgggaataatggactatctggtttactagggtgtaacaaaacagtatttgaaatatgagatggggataaaattgcatttaccagagctccttctgggataagtatgagaggaataagcagaagcaaataatcttcttgggaggtgtgtgtgtgcgtgcatgcgtgtgtgtgtgtgtgtgtatgtgtatgtgtataagagagagagtgagaccccaaagggtatgcttaattgctttttaaggaagttgagtaaattaggaatacatttttataggatatgcaagtttggagacagagctaaattgctgagaaagagaagaggtgtaagctctgcaactagtagctctctgcctcttgtctaaacaaacgttgaacaataacaaaaatattgacttgaggggtgccagattagatttcgtggggagcctatgtttttgactctgcctgtgtgttcccataacatccagtgctgttagagcattcatcacattatatgttaatcatctattttttttttttttttggtatatcttcacctccagactgtgagctttttcggagcaagactgtcttttatcttcatatgtttctttttttaatttttgttttattattattatttttttagacacaattttgctgttgttgcccaggctggagtgcagtggcatgatctcagctcactgcagcctccgccttccaagatgaaatgattctccagcctcagcctcctgagtagctgggattataggcatgcaccaccacgcccggctaattttgtatttttagtagagacggggtttcaccatgttggtcaggctggtctcgaacccctgacctcaggtgatccacctgccttggtttcccaaagtgccaggattacgggtgtgagccactgctcctggcctatcttcatatgtttctgagcctggtatacacttactgaagaaatgtttgctaccaaatgagacattgttggccaattaatacttaatagacttttaaaatgtacattgttcttaaaagtcaagttttattttcctttgtttacataaagaccatatgctacattataatatgtaatcttccatagttcaataaatatacaaggatgtaaacaagtgtcagatgtggcctgggtctgtgtccccacccaaatctcatcctgaattcccataattcccacgtgttgtgggagggagctggtgggagataattgaatcatgggggtggtttccaccgtgctgttcttggtggtagtgaataagtctcatgagatctgatggttttatcaggggtttctgcttttgcatcttcctcattccctctttgccttctgccatccatgtaagaggggacttgctcctcctcgccatgattgtgaggcttccccagccatgtggaactgtaagtccaattaaacttctttcttttgtaaattgcccagtcttaggtatgtctttatcagcagcatgaaagcagactaatacagtgttcttatttacatccttgtatatttatggtactaatttttaggataaataaggataaatttctagaagtagaattgatgggtcaaatattgtatactctttaaatggctgtctaggccaggtatgctagtttacacctgtaatcccagcactttgggaggccaaggtgggaggatcacttgaagccaggagtgagaccaacctgggcaacacagtgaaatcccatctctacaaaaaaataaaaaaaattagccaggtatggtggcatgtgcctgtagtcccagctacttgggaggctgcacccaggaggttgaggttatagtgagctataattgtgccactgccttccagtttaggtgacagagtgagaccccatatgtattaaaaaacaaatctgtcatcatagtaggagattttaacacacctctctgaagtggatatattaagcacataaaaattttaaagtatatagatttgaatttaatgattaatacactagttacataatacagaattctatatcccatattagagaatatgcattcttttttttttttttgaggcagagtctcgctctgttgtgcaggctggaatgcaatggcatgatcttggctcactacaacctctgcctcccagactcaaagcaatcttccctcttcagtctcccgagtagctgggactacaggcatgtgccactatgcctggctaatttttgtattttatgtagagacaggatctcatcatgttgcccaggatagccccgaactcccaagcttgagctatccatctgccttggcctcccaaagtggtaggattacagacgtgagtcaccgcgcctggcctttagagaatatgcattcttttcaaacaaaaattaattatttatttattagcccataaaaagagtctcaaataattctgtggaattgatatcatacatgttgtgtagtatgtgtctaagagagggctcaggaaccaaatgtggttttcccctagttgtatgaccttgggtaagttacttatgtgcttcaattttctcatctgtaaaacagaaatggtaatagtggtctctcagagttgtgagggctggcattcagaacaatgcattacacgtggtaagggctcagttagtgtttgccatcatcattatagtatcatcatattctctgatcacatgcaatgaaaatagaaatcagtaatgaagagataaacatcctcttccttacaccaaaaagaaaaacctccaaatataccattcagcaataaaaatgagtgaattatggatacacacatcaatgtgggtgaatctcagaaacattcttagtgaaagaattcagatacaagaatatatactgtatactatactccagaattatatactgaaaagttctaaaacaggcagaactaatttgtggtggtggagaagtcagtacagtggtttcctctggtgtttaagggtaggaattgactaagatggggcatgaggaaactttttgggatgatagtgccattctgtgtcctttgtttttgtttttgtttttttgagatggagtcttgctctgtcacccaggctggagtgcagtggcacagtctcggctcaccgcagtctctgcctgctgagtccaagcaattttcctgcctcagcctcccaagttgctgggattatatgcacctgccaccataccctactaatttttatatttttagtagagatggggtgttaccatgttggccaggctggtctcgggaatgcgtgacctccagtgatctgcccaccttggcctcccaaagtgctgggattacaggtgtgagccactgggcctggccccattctatgtcttgatagggatttgggtttcataggtatgtacatttgtcaaaactcagaaaatgtatatataatatgtgtgcatatgattttaagtagttttacataaaaagataagcaaatattggatgctggttaacactaagcatgctgaaatatttagagggaagagtattattgtctacaatttgctttaaagacaccaaaaataaggtggattaattaatggctagggagatggataaatggatagatatgtgataaagcaagtctaatagaattttgtggcagaatctaatggcggctatatggatgttagctgtaaaattctttacaatgtgattgaaaaattttgcaataatctgttgaagctttcttcccattcccctacttgtgcttgcaaactaaaaacaaacaaaaccactactaactgagttaaagtagaaattataatgagaattactaaataccacacaatgaaaatgaatgccctatataaacaaacttgtagggtatgattcaaaaggaaatttatagctcttaatgaatttgttagaaaataggacagattgaaaggtagtgggttcatctcaataaattaggaaaaaacccaaaatatgcctaaaagcctaataggatggaaaaataataaaatataaatcatgcattattatgtagtatttaagagtgtggactcttgaaccagattgcctgattgtgaattcttagttctccacttcctgcttgtccaaacttggttacttaacccgtctgtgtcttcttagcttccttatctacaaaatgaagataataatagaatcaaattcataggtttgtgaagattgaataagttaatatgttagtacatgtagaatgtatttgttataagtaccagcttataaataccagcttctgttattgataagtagaaagatgaatggaaaacaaaaatacgtataatcaataggccaacagctagttttttgaaaagaccaatatgatacagaaaactcaggaaaaaggagtaataaaaatcaatatgctaaaaatgaaacagagatataacaatagtgattttttttggggaaaaatggaaaggttttacatgaaaaaatataattactcttaccgaagaataaagaggaacttgaattgaccatgaaacaatttgagttcataactaaaaaaagagatatgggccaggcgctgtggctcatgcctgtaatccgtgcactttgagaggccaagttgggagattgcttgaggccaggagttcgagactagcctgggcaacatggcgagatcctgtccctaataaaaataaaaagcaattagctgggcatggtggtgtatgcctgtagtccccgctacttgggaggctgacgcgggagcttgtgcccaggatttaaaggctttagtgagttatgaccacacaactgcactccagcatgggtggcagagtagtgggaccccatctcaaagaaaaaaaaacaaaaacgaaagaaggaattatgacttttgataatgcactaggcccagaaaagacatttttgcaattaagttttatcaagtcagataatacttattttatggaatgtttcacagaatgagaaaaacacccagctcattttattaatcttgtataactgtgatgccacaatctaacaggacagtacaagcaatcaaattatatgccagtctgccttaggagcataagtaaaaatatcgtcaacaaaaatttactaaatagaatctagtggtatataagaaaattaagtaataatgaaattgggtttttataaaaacttcaaggacaatttaatattagaaaatctaacattaacagattgaaggagtagaaccataagatcatctcagtaaagattcagtatccaatcagaataaaaactcttattagcaaactagaaatagaaaggaaagtcttcaatctgaaaagaaggatatttatttaaaaatctgcagtcatcatatttagtggtgatgttttaagagtcttctcattaaactcgtggataacacagttgtgcccctgtgatggttacttttatgtatcaacttgcttatgctgtagtacccagctatttaatcaaatgttaatctacatgttgccatgaaggcattttgtggatgttggtaacatctacagtcagttgactttaagtaaaggaggctaccctcaataatgtggatatgtctcacaattagttgaaaggccttaggaacaaaactgaggtatctggaagaagaagaaattttgcctcaagactgcagcatcaactcctatctcagtttggcagcctgatggcctgccctacagattttggacttgtcagctcctacaattgcatgaaccaatttcttaaaataaatatctttatgtctgtctgtgtctagctatctgccttctctctcgtgttttctctcttccctattcactctgtttctctgaagaaccttgatgcatgcaccctccagtgccagaagacatgaaaacgacacgaaagtatagagttggaaaagatatataagattgttttcatttaaaaacagtgagatagggcgggcgcagtggctcacagcactttgggaggccaaacgtcaggagaacgagactatcctagctaacacagtgaaaccccatctctgctaaaaatacaaaagaggcactgaagaaggtaggaaagagagtcttgaattgccaacgccacccctcttccataccctggcactggctgcatggtgtggagattctgcatgtcagggagggagagtgctgtgattgagaccctccattgaactcagtgctgttctgtcgaaggggaaagcaaaactgggctaaacttagccaatgaccactcatggagggagcatttaggccagccatagtcagaggggaatctcccagcccagttgttggaacttgaatttcagcacgccttgccactgcaggctaaattgctgtaggccctacataaacttgaaaggcagtctaagacactaggactccaattcttaggcaagtctttgtgctgagctgggctcagagccagtgaacatggtggggcacatgacctagtgagacaccagccatggcgtccgagggagtacttgtgccacccctccctcagttttgggcgcacagcttgtagcttcaaaaaagaccccctccttccgcttgagaagaggagaggtaagagtaaagaggacttttatcttacatcttggataccagctcaaccactggaggatagggcactgggcggagtcatcaggccctagcttctggatgacatatgtagacacaccctgggccagaagggaaactcctgccttgaagagaaggatccagtcctggtggcattctttacctgctgactaaagtgcccttgggccctgaggaaccagcagcaatacctagttagtacgctgtgggtcttgggtgagcttctgtgatgtgctggcttcaggtgagacccagcatatttccagctatggtggctacagtgagaaactcctgcttgagaaaaggggagggaaaagtgaaggagatttagttttgcacctcaggtatcagcttggccacagttgggtagagcaccaagcaggctcttggggcctctgattccaggatttggcccttggacagcgtttctggacctgccctgggccagatgggagcctactgcgctgaagggttagtcccaggtctggaagaattcaccacaagatgactgaagagcacttgagcctgaagtgaacattggcagtagccttgcagtaccctctgtggttctggggtggtgatgaccttggggagaagctcttctgcttgtggaaagagaagggaagaataggaaggacttttgtcttatagtttgagtgccagcttagctgcagtagaatagagcatcaagtagatttcaaaggtttttgactccagtacctggctactggcatctctggacctgcctggggtatgggggaaattgccaccctaaagggaaggacagaggcccagcttgctttatcacctgctgattgtagagccctaggcccttgagcaaagagaccaagtgttgtgagaaagtaaggaaagagaacaagaatctctgcctagtaatatagagaattcttctggatcttaaccaagaccactaaggcagtaccactacaagttttcaagaaacatagcattactgggcttggggtgccccctaatgcagatgtggcttagattacaacacccaagtttcttcagatacctgacaaactttcccaagaaggatgggtacaaatgggtgtttcttcaaatgcctggaaaactttcccaagaaggacgggtacaaacaagcccagactatgacgactacaataaataccaaactcttcaatgcctggacaccgacaaatatccacaagcatcaaggccaagtcttggcaacatggcgaaaccccgtttctactaaaaatagagaaactagctgggcgtggtggcacatgcttgtagtcccagctactcaggaggctgaggtgggaggatcacttaagcccaggatgcagaggttgcagtgagccaagatcacatcactgcactccaatctaggtgacagagtgagaccttgtctcagaaaaaaaaaaaaaaaaaaaaaaaaaaaaaaagaccatcttgggaagcatgatgatcaaccaaactaaggtaccagggaacagtcctggagaaacagagctatgtgacctttcagacagataattcgaaatagctattttgaggaaactctaagaaattcgagataacacagagaaggacttcagaattctatcagataagcttagcaaagagattgaaatacttacaaaaaatcaagcagaaattctggagttgaataatgcatcataatttcttaacagcagaatttatcaagcagaataaagaattagtgagcttgaagataaactctttggaaatgcacagagaagacagaagaaaaaagaataaaaatgaagcacgcctaccagatctagaaagtagctgcaaaagggcatatctggccgagggcagtggctcatgcctgtaatcccagcattttgggaggccgaggtgggtggattatttgaggtcaggagttcaagacgagcttggctaacatggtgaaaccccatctctactaaaaatactaaataagtaaataaataaatgttagccaggcatgatagtgtatgcctgtaaccccagctactcaggaggctgaggcaggagaattgcttgaacttgggaggcagaggttgtagtgagctgagatcatgccactgcactccagcctgggcgacagagcgagacaccgtctcaacaacaccaacaccaccaccaacaacaaaaaggcaaatctaagagttattgaccttaaagaggaggcagggagagagatcagagtagaaagtttattcacggggataacaacagagaacttcccaaacctagggaaagctatcagtattcaagtataagaagcatatagaacaccaagcagattcagcccaaagaagactaccttaaggcatttaataatgaaactcccaaatgtcaaggataaagaacagatcctaaaagcagcaagagaaaagaaacaaaaacacataatggagctccaatatgtccagcagcagacttttctgtggaaaccttacagaccaggaaagagtgacatgacatgtttaaagtgccaaaggggaaatcttttaccctagagtggtatgtctggtgaaaatatccttcaaacattaaggaaaaataaaggcttttccagacaaacaaaagctggggaatttcatcaacaccagacctgtcctataagaaatgctaaagggagttctttaatcagaaagaaaaggacattaatgggcaataagaaattatctaaaggtacaaaactcactggtaatagtaagtacacagaaaaacaattttataacactgtaattgtgatgtataagttattcttaagtagaaagactaaaagatgaacaaattaaaaatattaactacaacagcttttaaagacatatccagtataatatgatataaatagtaacaaccaaaagttaaaaatagggggacaaagttaaaagtgtaggtttttattagttttctttttgcttgtttgtttatgcaatcagtgttgtcatcagtttaaaataattgggttttatggtagtatttgcaagccttgtggtaacctcaaatcaaaaatcatataacagatacacaaaaaataaaaagcaagaaattaaaacaccccaccagagaaaatcaccttcactaaaaggaagacaggaaggaaggaaagaaggaagagatgaccacacacccaaaaataaaataacaggagtaagtctttatcagtaacaacattgaatgtaaatggattaaactcttcaatcaaaagacatagagtggctgactggattgaaaaaaacaagatccagtgacctgttgcctacaggaaacacacttcacctataaagacacacatagactgaaaaaaaaaaaaaggatggagaaagatattccatgctaatggaagccaaaaaagaacaggagtagctatgcatatatcagacaaaaacttttagaagagacaaagaaggtcattgtataatgataaagaggtcaatttagcaagaagatataacagttgtaaatatatatgtacccaatactggagcacccagatatgtaaagcaaatattagagctaaaaagagagataggatcttccaaacagaaaatcagcgaagaaacatcactcttaatctgtactatagaccgaatggacctggtagttacagaacatttcatccagtggctccagaatacacattcctttcctcagcacatggatcattctcaagcatagaccatatgtcaggtgacaaagcaagtcttaaaacattaaaaaaaacccctgaaataatagcatgtatcttctctgatcacaatggaataaaactagaaatcaataacaagaataattttggaaactatataaccacatggaaattaaacaatgtgctccacaatgactagtgggttaatgaagaaattaaggaggaaattgaaaaatttattaaaacaaatgataatggaaacatgacataccaacaacccatgagatacaacgacagcagtacgaagtgggaagttcatagctataagtacctacatcaaacaagaaaaaaaaatcttcagctagataacctaatgatgtaccttatgcagctgacaaagcaagagcaaaccaaacccacaattagtagaataaaagaaataataaagatcggagcagaaataaattgaaatgaagaaaacaatacaaaagaccaacaaaatgaaaagttggttttgtgaaaagataatcaacaaacattagatagacttaggaaaaaatagaaaagactcaaaatcaaagatgaaaaaggagacattacagctaatactgaaaaaattaaaaagattattcatgggtactatgaacaactatataccaataaattgaaaaatctagaaggaatgcataattcatagacacatacaacttatcaagattgaaccttgaagaaatccaaaacctgaacagagcaataacaaataacaggattgaagccgtaataaaatatcgcctagcaaagccaagtccaagacctaatggctttgctgcagaattccaccaaacacttaaagaagaactgataccactgctgtcaaactattctgaaaaatagaggaggagggaatattcctaaactcattctgtgaggccagcagtaccctgataccaaagaccaaagacacatcaaaaaaaaaaagaagaaaactacagaccagtattcctgatgaatactgatgcaaaaatcctccacaaaatactagcaaactgaactcaataatacattaaaggaaaattgatcatgatcaaatgagatatatcccagggatgcaaggatggttcaacatatgcaaatcagtcagtatgatacatcgtatcaagaatgaaaaaccatatgatcatttcaattgatgctcaaaaagcatttaataaaatttaatattccttcatgataaaaactcaataaactgggtatagaaggaacatacctcaacacaataaaagccatttaagacagacccacagctagtatcacactgaatggggaagactgaaagcctttcctctaagatctggaacatggcaaggatgcccactgtcactactgttactcagtgtattactggaagtcctagcaagagcagtcagacaagagaaagaaagagcatccaaagtggaaagggaaaaagtcaaattatgcttgtttgcagatgatttgatcttatatttggggaaacataaagaccccactaaaaaaccattaaattcagtaaatttgcaggatatgaaattagcatacagaaatcagtaagatttctgtatgccaacagtgaacaatctgaaaaagaaattgagaaagtaatctcatttacagtagctacaaataaaatgcctatgaattaactgatgaagtgaaagatctctgcaatgaaaactataaaacattgatgaaagaaattgaagaggacacaaacaaatggaaagatattccatgttcatggattgggagaatcaatattgttaaaatgtccatagtttctatagcaatctacagattcaatgcaatccctatcaaaataccaatgacattcttcacagaaatagaaaaagcaattctaaaatatatatggaaccacaaaagacccagaatagctagccaaagctatcctgagcaaaaataacaaaattggaggaatcacattacctgacttcaaattatactacaaaacagcatggtactggcataaaaacagacacacaggtcaatggaacagaatagagaacccaaaagcaaatccatacatctacagtgaactcattttcgacaaaggtgcaaagaacatacattgaggaaaggacagtctcttcaataaatggtgctggaaaaactgaatatccgtatgcagaagaatgaaaccagacccatgtctcttgccatatataaaaaccaaatcaaattgtgttaaaaacttaaatctaggctgggcgcggtggctcacgcctgtaatcccagcactttgggaggccgaagcgggtggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaacaaaaaacaaacaaaaaaaaaaacttaaatctaaaatctcaatctatgaaactgctaaaagaaaacattaggtaacctcttcatggcattggactgggcaaagatttcttgagtaatactacacaagcacaggcaacctagcaaaagtgaacaaataggattacatgaagtgaaaaagcttatgtacagcaaaggaaacaatcaacaaagtgaagagataacccacagaatgggagaaagtgtttgcaaactctttatcttaccagggattagtaactagaatatgtaatgagcttaaacaacttcataggaaaagatctaataatctgattaagaaatgggcaaaagatctgagtggacatttttcaaaagaagtcattgacaaacaggcatttgaacaggtgcaacatcattgatcatcagagaaatgcatatcaaaactacaatgagatattaccccagttcaaatggcgtttatccaaaagacagacagtaacaaacaccggcaaggatgtggagaaaaggggaccctcagacagtgttggtgggaatgtaaattagtacaacaactatggagaataatttggagttcactcagaaaactaaagatacacttgccatacaatccatcaatcacagtgctgggtatatatccaaaagatacccatgtcgattgcagtactgttcatagtagccaagatttggaagcaacctgagtgtccatcagcagataaatggataaagaaaacatggtacatacacacagtggagtactattcagccataaaaaagaatgagattctgtcctttgcaacaacatggatggaactggagatcattatgttagtgtaataagccagacacagaaaagataaatttgcacgttgtcatttatttgtaggagctaaaaatgaaaacatttgaactcatggaactcgagagtagaaggaagtttactggaggctgggaagggtagtgagggtgtgtgtttgtgggaagtgaggatggttaatgggtataaacaattagaataagaagtagtatttgatagcacaacagggtgacaattggattgtttgtaacacaaagcgtaaatgcttgaggcgatggataccccatttactctaatgtgattattacgcattgcatgcctgtatcaaaatatctcatgtcctcatctatatatacacctgctgtatacctacaaaaattaaaaataaaaaaaatggccaggtgtggtagctcatgcctgtaatctcagcactttgggaggccgagctgggcagatcacaaggtcagatcgactatcctggccaacatggtgaaaccctgtctctactaaaaatacaaaacttagctgggtatggtggcgcatgcctgtaatcccagctactcagaaggctgaggctcaagaattgcggagagtcttgagaatcaagaaacccaggaggcggaggttgcagtgagccgatattgcgccactgcactgcagcctggtgacagagtgagactccatttaaaaatatatatatatatatagcttttctaacaaaaaataatagagatgtgaagtgggctttaaaaagtcgagtccaggatatctggtggtagagttttaattttccacaatacaggtatgtgttgcttaatgtcagggatatattctgagaaatgcatcattaggtaatttcatccttgtatcaacatcatagaatgtacttacacaaacttagagtgcgtagcctactgcacatggaggctctggtctgttgttcctaggctacaaacctgtccagcatgttactgtactgaatactttaagcaattgtgatacaatggtaagtttttgtgattctgaacgtagaaaaaacacagcataaatatggtattctaatttttggggaccccacttgtatatgtggtccattttttatggaaatgttatgttactgtatttatttatcaataagtttcatgaccctgcaacaatgttaaattcttatctactgttttgcttaaagttgtagtattcagacctgttgcagggattctttcacttcctgtaacagtttgcacttcagggttctttaacaagcagaatactgatttaagagcctaactggaggaaattcttgtttcttttttctttttcttttttttttttttttggagacagagtctcattctgtcacccagggtggagtgtagtggtgccatcacagctcactgcagccttgacttcatgggctcaagcaatcctcctgccttagcctcccgaatgctggggatataggtttatgtcaccatgtccagctaattcatgtgctttttgtagagatgggttctcactatgttcccaggctggtctcgaactccttggccaaagcagtcctccttttatgtttctcccctcaactcctccgaggtccaataagggaaatttcaagattttgtaaaattaattatttacttttggcctcagttactttttctgtgaaccacagatgttctccacataatttctaaagttcatcccagttctctgattttatgattctgaataattctggaaatccttggatgcaaatattagcttgtatacagacctgtgaagatagaggccttgcttctgccaggtatcttctataggtatcttatttaccagatactttgtcagatttattagagacctgaaatacaatgctttttcttcattcagacttaatagattcaaatattatggttaattctgccatagaccatttattcaaatattttaaaatctcattttttgtatgattatgtaaaacttaaaaataattagtataatttgaatttattaacacaattatgtaagacacctattgtgagtttttgtaccacatatttgtagcctaataataaatatttattgagttctttatgtttttcaaaggacttttatatccatttattttacttaatcttcagaactgcctagtaagtatattttgtagatgtaaaaattgaggcttagagtagtaaagatacttatccaatgttaggattagaaagatttagatcttatgatttcttctctattcccttttcacttcccaagttatctttcttttggagttcttccctaggaaagtaatgttaccaaataaagagcctggtagattctggggcatggtggtgtcttatatagagggtgtactgtagacagtggaagggaaggtgtgataaagcatggagctaatgtaaatgattattatcctgtttcattgtccttattctctttatctttggcttcatttttatcaccaccttttatagcacattattgtggaaagagtcttagatgaaattgatactaggttcttttcctaagtcttccccccacctaaccagagctacttagtagcaattttatgtgtgtcttttaattgccctgatttgtactttcctcatttatggaatgggaataacctattctggttaccttatagagttattgtcaagtcaggtaggataagatgggaaaggactttgaaaaacttgaagtactttactagcagggattattattgtttttacatgacagcctctgtggcttggtctgttgataggctgctttgaaataaatgcattcatttaaacgtgtaaaactatattgtaaaatatagattttcaccatttggtactatagctctcttgctttcaattagtaaagttggccaggcacggtgactcaggcctgtaatcccagcactttgggaggccggatcactgaggtcaggagtttgagaccagcctggcctggtggtgaaaccccgtctctactaaaaatacaaaaattagccgggtgcggtggcacgtgcctgtggtcccagctacttgggaggctgaggcaggagaatggcttgaacccgggaggtgaaggttgcagtgagatgagattgcggtactgcactccagcctgggtgacagagcgagagtctgtctcaaaaataaataagtaagtaaagttttggccaggtgtggtggctcactcctgtaatcccaacactttgggaggctggatcacttgaggtcaagagtttgagaccaccctggccaacatggtgaaaccccatctctactgaaaatccaaaaattagccaggcatggtggtgtgcgtctgtaatcccagctactctggaggaggctgaggcaagagaagtgcttgaacctgggaggcagaggttgcagtgagctgagatcgcaccactgcgctccagcctgggcaacagagtgagactctgtctccataaataaataagtaaagtttgtaccatcttttctgtttaggagaagcaaagtaaatgatactatatgtgctatttaattataccagttgcagtgtacatagtgtttctcactaatgccaagtggcaggccaagtgagctggactggaattacactgttagccgccagcaactatatgatagcctgcatttaagatgagttctgtgcacaatggggatggctgacattcaggtacttgggagctgtttaaagggtttaataacagaaaacatttatttgtatttttgtattagtatttgcaccaggcatatttattaggacgttaggcaccttgtttcagacattgcaaaagaaaaggatacaggagtgcttttaaaaaatttaaaggctgttacaaaacttctctggaggagagtttgcttggttcatgggacttttagaagaataccacatcaagttaatgtggcttgctataattagatttaatgaatatctagaaaaatttacataaatttaaaatgacatgaagaatgctgattgataatcctcttttctttttttgcatttcttttttcttgaaagtacatattttttcacttggcagtaataatatctgtattttatgtgtaggttttacataggttcattttagtttaattgaactgtgtgttggcataaagctaatgcttggggctacagacttgtttgagaaagacagacacaattgtagatatattcaatgtaatatagttagcaataagacagatatgtgctttgggagtacagaaggcggcagatatttggttcaccctagggattcaggtaatgatttctgaaagagaggatacctaaactaagtctaattaaatcttataaaaatggaagcaggttaagttttcagaaacaatgaagtaattttttttatttcagtgttttgcgggttctgaagtagtacttaaaaggttaatattaatacttgtaatttgggatttacaacttttattatgttttattttttcttaatcttactgagacaatttgcatacaataaaatccatctaccttaagtgtacagagtttgatacattttagtaattatatgtagttgactaaacactactacactcaatatatagaacatttccatcatcctaaaaaggtttcttgtgccctttgatgcttcagcctcaaataactgctgatttactttttgtgattatagttgtgtttcctagaatttcatataaatggaatcatacagtagatacacttatgtttgacattttctacttaatagtgtaatttgcttttttagtgtaatgtttttgagattcatccatgttgtgtatattaatatttagttttcttttttattgctaaatagtttttcttaataagagtatgtcttagtccactttgtgctgctataacagaatacctgagactggataatttataaagaacagaaatttattggcttatagttctggaggctgggaagtccaaaatcaaggcaccagcatctggtgaggaagctcttgatgcattatcacatggcagaaaggtagaagggcaaaaagagagagaagggggctgaactcacccttttataatggcattaatctcacccctatgagggcagagccctcatggcctaatcatctcttaaaagtctcagcttgtaatactgttataatggcaattaaacttcaacatgagttttagaggagacattcaaaccatggcagagtacaactgcaatttgtttattcattcatcagttgatggatgtttcgtttcattgctttcagtttttggctattataaataatgctgctgtacacattttgtacacatttgtgtatgggtccttctgtggacatatgtttttatttctcttggataagtacttaggagtgtaattgcagggttctttgacaaatgtgtgttaaatttaaaagaaactgccaaaaatttccccagagtctatctatattatttagcattcctcccaacagtgtatgagcattttagttgtaccaaatccttatcagcacttggaattgttaattttcttaactttagtcattctagtgggtgttcagtggtatctcattttaatttgcatttccctgatgagtagtgatgttaagcatcttttcactgttaccaattatttggataagtttttaatgaagtgccaattcaaatcatttgttcatatttaaaaatatggtcttcagcctgatggccttcaaacttcaattgtagcattggattttatctgggtctgcagcttctggcctaccctgcagattttggacttgctagccttcataatcttgtgagccaattccttgaaagcaaatctgttttcatacatagacacaatatattctgtttttctggagaaccctgctaatacattggcctttggtgactggcttcttctacttagtatagtgcttttgaggttcatctatgttggaataggtatcagtgtttttatttttgttttgctttgttgtgttgtgtttttttcgggggcggggggtgcagtggctcacacctataatcccagcactttgggaggccaaagtgggaggatcgtttgaagtcaggagttccagactaccctgggcaacatagtaagatcctgtctctacaaaaaatacaaaaattagctgggcatggtatgtgcatctgtagccccagctactcgggaggctgaggtgggaggatcttgagcccaggagatggagactgcagtgagccatgatcataccactgcactccagcctaggtgacagagtgagaccctgtctctaaaacagcaacaacaacaacaacaataacaacaagagtacagcctttacctccctcagtagttcccacctcagtacagagttatcactcctttctctgaacttagatttacaatgttttagtgatgtagcctaaccttaacattctacagatgaataaacaaatctagcacttatctgatttgcccaaagttgctcttatgcaatctattttctgtgcaactgagatggcatttatctgctattttatgtggcctttttatgaataaatgtcatgtttctccttcaggtcggaactaaacctcagggttctttgaaaccccaattatctcagatgtttgctgggaacagtgataatgataatgagcatcatattgaggtagaggaagaggactggttagtgggtactggtttagaggtactttttaaaggaagcataagcacattttgggcatgcaaaatattaagctcagagcttagacacttggtaaaaaacaagggtctgtgtgaggagagctctgagaaaagggttgtcagacagaagccaaatttctcaagaaggacctctaaacagcattaaggaaaaaaaaaaaaatcccacgtagaagcatctaaaaaaaggaatgcccagtatttgggaaagagaaacgaatgataatagcaccagatttagagtcagctacccaatagattcgaatttcaacattaccacatccaagctgcgtttctgtgcctcagttttttcatttctgcctacctaaggactgtcataggaagattagataaaatgtatgtaggccgatcacggtggctcacacctgtaatcccaccactttgggaggctaaggtgggcggatcacctgaggtcgagagttccagaccagcctgaccaacatggagaaaccccatctctactaaaaacacaaaattagccaggcgtggtggcgcatgcctgtaatcccagctacttgggaggctgaggcgggagaatcgcttgaacccaggaggtggaggttgcggtgaaccgagattgcaccattgcactccagcctgggcaacaagagtgaaactccatctcaaaacaacaacaacaacaacaacaacaacaacaacaacaacaacaaaagcatgtaaagcgcttaggtcagtgccttccttttaaggcactctgttaattgttgttgttaataggagaagggttttcttgagaagggaggaagggacgcgaagaggaatggtccttggtacattttggtgacaaggaggtgggattctgaaacagagggtgtgttcacaaagagagctggagtgagaagagtggtgggggcagcacatgtttccagtgaggattagcggggtgtcacagccactgtaggaagcggaagggctgagaagtgtcaagccaagaacacgccttccggggtgcgtcagggaaggcagcggttgaagattagcacttaaatgctgtgagtgcttctatgacaaacggcacatcttctggggaaacttagagctcgggaaaggcctcattagtgggggatagggacgggcagaggcaagtgccgaaagtcccctcggagtgaccgagaggccagtgaaggaaggtgaggtgggaagaaaatggtggtgccgcctctcctggcttcccttcgcactctttctagccacagccccgctggagcagtcactctctggaaaccacggggaaacagcctttttggtccggcttgacagccccaaccagaccgagggtgcagaagaaccagggtggtgagcgccgctaagcctaacgcctgactgctcaggggtgcctgggcggtatcagtgttttactgcatttgtgactggataatactcggttgtatgtatataccacattttatttatccattcatcagttgatggacatttggttttgtttttttcccacttcttgactgttatgagtaatgctgttatgaacatttgtgtgccaatttttgtttagcatttgttttctctcgagtatataccttggggtggaattgtgtcatgtagtaattcagtgtttaactttttgaggaactgccaagctgttttctgtagcaggtacataattttatgttctcaccagcaatgcatgagggttctaatttcttcacatcctggccaatgcttattattttctgtttttgttttgttttgtgttgttttacagccatcctagtgggtaggaagtagtacctcattgtgtgtttatttttggaagcagggtcttgctccattgctgaggctggagtgcagtggcacagtcatagcttactgcaacctggaacgcctgggctcggtgattcttctacctcagcctcctgagtagctgggacaataggcatgtaccactacctccgactaattaatttttttattttgtagagatggtgtcttactatgtgggccaggctggctttgaactcctgagctcaggtgatcctcctgcttcagtctcccaaagtgttgagattatagggatgagccactggcacctggatttaaattttgatgaagttcattttacctgttttttcttcgttgtttgtgcttttggtttcccatctaggaatgcattgcaaaatccaaggtcatgaagaattgcccctgtgttttcctttaagagttttatagttttagctgttacatttaggtctttgagccattttaaattttatatttgaaatgagatagggatccactttcattttttgtatgtagaaatcttgtcttggcaccatttgttgaagagactattctttctcagtttagtgctcttggcacccttgttgaaaatcagctgatcatagatgtttgttttttttttcctggactatcaattctattccaactaaccatactgtaaacaaactagacccaacaggtgtatatagaacactccacccaatgaagtagagtgtatatttttctcaagtacacataaaacattttccaggatagatcatatgttagattataagcaattatcagttaattttaaaagatcaaaatcatataaagtattttctttacccatagaggaatgaagctagaaatcaattaatagaaggggacagaaaatatgcaaatatgtagaaattaaacatattcttaaacaacgagtagatcaaagaagtcactagggagattagaaaatactttgagacaaatgagaacaaaaatatacaataccaaaacttacgctgtgaaactagtattcagggaaaacttaacagttgtaaatgcctgtgttaaaaaagaagaaagatttcaagttaacaacctagctttataccctaagaattaggaaaagagcatgctaaacccaaaaggaaaaataataaaggttagatcagagaaaaatgatatagaatagaaaaatgatgaagagaatcaatgaaactaaagttggtactttgaaaagataacttattggcaaaccttagattagaagaagagctgggcaccatgggctatgcaagtctagtcctagccagttggaggccgaggcaggaggatcgcttgagcccaggagtttaagcccaactgggataacatagcaagactctgtctctaaaatagatagacagagtaaatatgtacaaacagaaaatacagtggggatactactaccttacagaaactaaaaggattatgataacatgaataataattcttcaaaaattagataattcaggtgaaatagataaatcttagaaacacacaaattactaaaactgattacagaaaaaaatagaaattctcaataacaagtgaagggattgaatcagtaattagaaaaaaaaaaaaaaaaaagaacacctcacaagaaataataggactagacggttccactagtgaattctaccaaacagttaatgatgaattaacaccaatcctactaaaactattccaaaaaaacagaagaaaagggaatgtttctaacatattctgaggccgtctttacccttatacaaaaatcaaacagataccagaagaaaactatagactactatttcttgtgaagagagatgcaaaaaaaaaaaataaataaataaaataaaccaaacaaacaaacctaggaaactgaatccaacagcaaatcattaaaaggattatccaccacgaccaagtgggattacacgcctgcaatcccagggagccacttgggaggttgaggcaggtggatagcttgagctcagaagtttaagaccagcctgggcagcatggtgaaaccccatctctacgaaaaaatacaaaaatcagccaggcctggtggtgcatacctgtagttctagctatttgggaggctgaggtgggaggattgcttgagcctgggaggtcgaggctgcagtgagctgagattgtgccactatactccagcttggatgaccagagtgagaccctgtctcatcaaaaaaaaaaaaaaaaaaaaaaaaaaaaatccatcaatgaaatacatcacattagtaagaggaaggacagaaccacatgattatctcagtagaggcagaaaaagcatttcacataatttaacactctttcatgataaaaagactcagaaaactaggaatggaaggaaatttccttttttttttttgttttgagacaaggtctcatgctgtcccccaagccagagtgtagtgacacggtctaggctggggaaacatggaaacgtccttaacatgttaaagggcacatatgacaagctcacagtaacatcgtactcagtggtgaaagactgaacactttccctataagttcaggaagaacacaaggatgcacctttttaccattgctattctcttgtgtttgacattctataattctatctggaagtggtatatgctttctttcatcctgtcctgtcctttcctttcctttcctttcctttgctctgccacccaggctggagtgcagcagcacaatctcggctcactgcaacctctgcctcctgtgttcaggtgattctcctgcctcagccttaccggtagctggaattacaggcgcccgccaccacatctggctaattttttttttttttttttttttttgtagaggcagggtttcaacatgttggccaggctggtctcgaactcctgacctcaagtgatccacctgccttggcctccctaagtgctgggattacagacgtgagccactgttccctgcctgctttcttttttaaatacaagaagtttaaaaattcattttaaatatttggttacatattatctctttcatgacagcatttttttgctcatgggtgtccttctgctaccatgtttttcctgttctgtttcttcttctcttaaaaattttacgtctgtttagatacctcgttccttcttcctttatggtggtttatttttgaatgagaaggtttttttgttttgttttgttttttgtttttttctatagcactttaggatattagatgttggtagctcagggttgtgtctttcaaatttacagcaattttgtttgtgagcaggttttgtgcataactttttttttttttaatcctcagccagtcagtgaagattgctgctgcagggctgttcatagtgtaggctctctcactatctttttgccacaccagcaactcagtttctgccagcgtggcttgtttgtgtgattccttatttagttctgtctcctctacttcttcaaactatgaacaggaaagcttcctctgccagcccatgttccctgcttttgttgttgcaaatgcagaatttaagtttactacctcaggaagtatgcttgtacaaaggtactcccgctttgagttttggagccttatgccttacctttctcctcttattccaagttgtctctccttatagcatatcattcccttatatgtccatacatatgtttcctagttttattggagatcatatttccagttatgtttcttactctctttgtttcttttgggtgatttctgactggaggagaggggagagtctgactttgttatttaagatgagaagtagttaagatgtatttttcgttagtgttttgcacattcatttactgaaaatgttaaaactgaattagatttcatatttataagctgtggaatgtgatattgtcacttatttagcaaatactttaatacatttgctgtgtgccaagtttatcccaagtcctttataaatatgtacttaattaatcctcataatacctatgaggtaggttttctttttattcttattttattgataggaaactgaagcacagtcaggaaagttaactcgctcaaggtcacctaattaataagaaataagaacacttctaattttcattctatgactatagcatttgtgggccttggcatcatctgtttatactgtattcaaatgaatcccttgagagcagggtctgtgtttcattcatctttatattctcattgcatatttagtagaattcctgaaatccagaagatattcaatggatgttagagaattaatattttttattaggagccaaataatttgctttctgccagacttacaacatagcttcagttgttcgttccgcttgcctcgttaaaaaatatttttgtttgtattctcaggtcatcattttagtgctattgcagtatttactgtaataatacctttacaaacagccactgtattccagaacaaaattaagatatttctttattaaacaattatcaatttgctgataataaaagcactagttcccttacacaagtttgctgcccatgctataaatatttttatatactaatatgaggtatatttaagcagtgtcatttataaaataacaggggtcaagtatcgtagcaaaaatgaagtggtcatcttgttcatttgtttttgttactgagctttactccatttaagaataaatatgttactgtttatccatgatcccattgatggacaactggactgtttttggctatttatgactaaagatggtataaatatttttgtaaaagtgtttttgtggacacgttttcatttttcttggtatataactagtattggaattgttatatcaaaataaatgtaagtttaattatgtaagaccagacttttccccaagtggttgtaccattttacattcccaccaatggcatgttagagttccattgccctttatcctcattgctatagttcagtctaatttttaccattctggtagatttgtttatctttattctttttttttggtgcagggagacaagagtcttgctctgtagcccaggctggagtgcattggcgtggtcttggctcattgtaacctctgcctcccgggttcaagtgattctcttgcctcagcctcccgggtagctgggattacagatgtgcgccaccacacctggctaagttttgtatttttagtagagacggggttttaccatgttggccaggctgggcttgaactcctgacctcaagttgtccgcctgactcggccttccaaagtattgggattacaggcatgagccaccacacccagtcctatctttattcttaacattcatcagctggatgtggtggctcacgcctgtaatcccaacactttgggaggccgaggtgggcagatcacctgaggtcgggagttcgagatcagcctgaccaacgtggaagaaccctgtctctactaaaaatacaaaaaaaattagctcggcatggtggtgcatgcctgtaatcccagctacttgggaggctgaggcaggagaatcgcttgaacccgggaggcggaggttgtggtgagccaagaccgcgtcattgcactccagcctgggcaacaagagcgaaactcggtctcaaaaaaaaaagaaatcatcaataccccatcctcactaccaccattggtaatttgaacattcttagggattttgcttatcttggtgatgaatttaaatgggtgcattacagctcttctaagacagctctcaattctgacaccagctgtaagttcgagaatccctaatacctccttcactttgacaccaacttcaaggttggaggtctccaagaccacctttacttctgacacgacttgcaattttgtgggtcccaagaccaccttagattcaataatttgccaggactctcagagctcactgaaagtttactcagtaaggttatgatttattatagctaaagagtagagtttaaaatcagccaagggaagaggtgtacagggcagggtctaagagagttccagtcagagcttcccattgtcctctgtggaactgtacagtgttcacttcttctgcaatgatgtgtgacagtatgcacagagtcttgccaattaggaaagcctacctgagtcttggtatgcagtttttattgcggttcagtcacttagacatgattactactcatgcggctggccttagcctccagcctctccagaggttgagatgatactgagtgacccaaggctcatcatcccacccacccctgatgaaatcacattgttagcatagactatttggtgtggcacaaggtccccaggtagacagaaacacttgtgtcaggcaagatattccaagggcttagagattacctcccagaagccaaagacaaaggtaagacctgtctttgggtagggttaatcctttactgtatactccgatgccctccttgatttgatatacacaaaatgcttgttttaactgatataatgtgaccaaagtcaagaaacttgattggtccatgtggatgtagattgtgatcttggttctgtgtgtctcaggagctaacctactgagctattaatcaaatttatgaagagtctgaaaactgattatgtagtttttgtctattgtttcagtcattcattcagcaaacattttttgaactttttacaatgttcagtcactgtgccaaacatataaatactaagatacagagtatacttaaatgctctcaaggagctccatagtcaattcatagacagtcacaatacttaaagcagatgctatgttagaagatgccgggccaggtatggtggcttgtgcctgtaatcccagcactttgggaggctgaggtggaagaatcactggaagccaggagtttgagatcagcctcagcaacatagcaagaccccatctctacaaaaaaaaaaacaaaaacttaaaaaattagccgggtgtggtggtgtacacctatagtcccagctacttgggaggctaaggagggaggatgacttcatctcatgagttagagactgctgtgagctatgatcgcaccaatgtactccagccttagtgatggagcaagaccctacctctaaaaaagaagatgctggaggatctcagaggaggtgtatctgaatcacaagaggaattcaggaaggcttctcagatgagatcatactttcagctaggttttgtttttttttgagagtgagtctcattctgtcgcccaggctggagtgcagtggcacaatttcagctcactgcaacctctgtctccccggtacaaacaattctcctgcctcagcctcctgagtagctgggattacaggtgcacgctaccagctaattttttgtatttttagtagagatggggtttcaccatgttggccaggctagtcacgaacttctgacctcaagtcatccacctgcctcggcctcccaaagtactgggattacaggcatgagccaccacgcccagcatcagctaggttttaaagaatgaggaagagttaggccaaataacgggaggaaattccaagtggaaaagaccacatttgctagaacatgaaagcatgagcctactggtccttttaagaaacttagctggggcataacatgtgaatgtggtttgacattctataattctgtctggaagtgatatttgctttcttttcttttttcttttttttgagatggagtctcactctgtggcccaggctggagtgcagtggcatgatctcggctcactgcaacctctgcctcccgggttcaagtgattctcctgcctcagcctcccatgtagctgggattacaggcacccaccaccacacctggctaattttttttgttgtttgtatttttagtagagatggggtttcaccatgttggccaggctggtctcgaactcctgacctcaagtgatctgcccgccttggcctcccaaagtgctgagattacaggcgtgagccaccatgcctggtctaaaacgtgtctttacatacagatttatacatgaatgtggatagcagcattatccataatactcaggatgtggaaacccaaatgtctatcaataaatgaatgaataaacaaattgtggtatactcatagaatggaacattattcagccataaaaacaaatgaagtattgatacatactacaacttggataaaccttacaaatgtatgctaagtgcaagaagtcagacacaaaaggtcacatataatttttttcatatgaaatatccagaataggcaaatttgtagagacaaaaaattagattagtagttgacaggggaggagaagaaaggggaatgaagcgtgattacttaatgggtctggagtgttctggggtgatgaaaaagtttgaaattagaggtggtggtggttgtacaacatttgtgaatgcactaaatgtcactgaattgtttactttaaaacagttgattgtatattatgtgaatttcatctcaataaaaacatgcattatatatatgcacatagtttacattcaaatagtacaaacaggaatgtagtaaaaggtctttcttctactaatactgccagtttctccatgtggagcccttgttaggctagtctcatgtaatattttagggagttctgtcacagtgatttctaagggaaccagagtaggcatttttgcacaggacagtttttgacgtgaggaaatgctgtaattaagaagtattgtaggccgcgcgcggtggctcacgcctgtaatcccagcactttgggaggccgaggcgggcggatcacgaggtcagcagatcgagaccatcccggctaaaacggtgaaaccccgtctctactaaaaatacaaaaaattagctgggcgtagtggcgggcgtctgtagtcccagctacttgggaggctgaggcaggagaatggcgtgaacccggaaggtggagcttgcagtgagccgagatcccgccactgcactccagcctgggcgacagagcgagactccgtctcaaaaaaaaaaaaaaaaaaaaaaaagaagtattgtaattaccataaatatatatttgtaaacatttttatatgaaaagatggtttacattattctgtacattttttgtttacttaacattagatcttcctatcaagttatcccaacacaatttactgataattcatcttttttccctgagaattttcagttactaaatttgtagatatatttaggtatattcctgattactaacttttgttttattatctctgtctacttatgttccattaccaagctattttaattactgttactttaaaattaatttttaacatctggtaagggtaggctttttaaaaaaatattactctttctcggaatttttatggctatttttacatgttcatttttctgtatgaaaatgcttatctagttaaataaaaatactgtacttttggattaatggcaaagtttttctcaatctcccaggccttggcaaccactaatttactttttgtctctctggacttgcttattctagacactttgtataaatgaaattctaaaatatatggccttttgcatccgttttctttcacttagcgtaatgttattgaggttcatccatattgtagcatgtatcagtacttcattctttcttatggctgaataacattccattatataaatataccacatcttgtttatacattcatcagttgatggacatgtgggttgtttgtactgtttggatattatgaataatgctgctgtgaacattcatttaccagtttttgtgtggacatgtgttttaagttttcatggatatacacctaggaatagaattgttggatcatatgctaatgatgtgtttaaccagtttgggaattcccagattgttttccacagaacctgcaccatttacttttccactaacgctatgagagttctgatttcttcacatacttaccaatacttgttactgtctgttttattatagcatccattaatatcatttaaaagttttatgagacattgattcagaattttagcaaatgccttttcatcttacatggagattatcaggtttcttctgctgtgctctcttgatatatatatgatacattataatgaatagatttccaaatatttattatgtgaattttgagtagttgttatcccagatttgtcttttgctttaaaacaggaaattagttggtagacaagtaactttttactaacaactaaaaatgccactgagaatatttaaattagttgatatgcacatcaagggtacaaaagctattcctttttcttgtggacttcacgtgaatgtccttattttaaaatgagttatgtataaacttaaaagggtaaaaaatacataatttaaatatttccttttatcttttgtgaaatataaaaaaatccaaccttctacaaaatatatagataggctttttagaggtttttaaatggtgaaagtgtgaactagttcattttagttagtctcttttgcttgggtatttgtagtgggtagggagataacatttggtagtgctggtcataataatttcttagtccaattttagaaaaacaacatgagtgtaaaaaaagtgtgtgtacatgtttatgaatgtgcattttttttaaaaaggacttttttttcaaacattatatgtttactaaaacaccagaaattatggaaagcaaaagaagaaagtaaaggaagcctataataccatgacccagagaaaactttcattactattttagtacacacacacaaacgcacacacacacacgtatgtatacaatcatgcattgcttaatgatggggatacattctaagaagtgcattgttaggcaatttcgtcattgtgtgaacatcatggagtacacttacacaaaccatagcctactacacacctaagctatatgatatagcctattgctcctaggctacaaacctgtacaacatgttactgtactgaatactgtaggcagttgtaacatgatggtatttatatatcaaaacatatctaaatgtaggaaagatacaacaaaaatatggtatgaaagattaaaaaatgggctgggcagtgtggctcatgtctgtaatcctagcactgggagggcaaggcagaaggattgcttgaggccaggagttcaggaccagcctagggaacatagcaaggaatggaacaacaacaataattagccacatgtggtggcatgtgcctgtagtcctagctatttaagaggctgaggtgagaggatcacttgagtacaggaattgaaagttgagagtaagctatgattgcatcactgcactccagcttgggagacagacggaaaaagatgaaaaatggtattactgtgtagggcacttgccatgaatggagcttaggagactggaagttgctctgggtgagtcagtgagtgccatgtgaatgtaaaggcctaggaaactaatgtatactgctgtaggctgtttatttattacactatacacttaggctgcactaaatttattttaaaaattttttttttttttttgagacaaagcctcgctctgttgcccaggctggagtgcagtggtgtgatctcggcccactgcaacctctgcctcccgggttcaagcaattctcctgcctcagccttccgagtagctgggactacaggcacacgccaccatgcctggctaatttttgtatgtttagtagagatggggtttcaccatgttggcagactggtctcaaactcctgacctcaagtgatccacctgccttggcctcccaaaatgctgggattacagggtgagccaccacacctggcccaaaaacttttctttcttcagtaataaataaattaaccttagctcactgtaacttttttactttataaacttgtaaattaaaaaaaaaacttttttgacttttgaaatagcatttagcttaaaacacatattgtacaactgtataaaaatattttctttatatctttataagcttttgactatttttacaaatttttatttttttgtacttttaaaatttttttgtcaaaaacaaagacacacatacattaacctaggcctacacactgtcagaatcatcaatattattgtcttctgccttcacctcttgtcccataggaggtcttcaggggcagtaacatgcatggagctgtcatctcctatgatacaatgcctttttctggtatacctcctgaaggaactgcctgaggctgttttacagttagctgtaggacctcatataattggaatcatacaatatttgtgtgtttttgattgacttatttcaccttgcataatattcttaaggttcatccatattgtagcatatatcagatttgtcttcctttttaaagctgaataatatttcattgtatataccacattgtatttatctattcatttctgggacacttggattaatttcctgttttcatttaatttatctaatttgctggtgtacagttgcttataatactctgtacagtctttttacttctatagaacagtagtagtgttcaccactttcatttctgattttggtaattagtgttttcccttttttcctaagtccacctaagtcctaggtaaagtttgtcaattttgttgatctttctgaagaaccaacttttggtttcattgattttctgtgttatttttctactgtctttgtttatctcttttctaatctttattattaatatttccttctttctgctaactttgggtttaatttgttctttttctagttccttaagttgtaaagttaggctgttgatttgagattgatcttttgttttttgtttgtttgtttgttttgagatggagtctcactctctttcccaggctggagtgcagtggtcctatcttggttcactgctacccccacctctgggttcaagcaattctcctgcctcagcctcccgagtagctgggaccacaggcacgcaccaccacgcccagctaatttttgtatttttagtagagacggagttttgccatgttggccaggcctgtcttaaactcctggcctcaagtgatccacccacctctatctctcaaaagtgctgggattacaggcgtgagccactgagcccagcctcatcttgtaaaataatgtaagtatttgaagctataaatttcccccgtagcactgctttcttttcatatttacattttgcccgcacatagttttctttagttttaccattttgccctttaattctttgaacatctttaaaaccattgttttagtatctttgtttagtagatctgccatcaattctttttcagggacaatttgtattggcttgttttcccctttgaatgggccatacttctccccttcttagcatgccttgtgatttttgttgaaaactggagatttgaatgtaataatgtggtaactctgctctcatttttttttaaacatcaacttgaaccagaataccagatttgtggtaactctgctaatcagattcccctccttgcccagggatttttttttttaatagttaaaaagtttttaaatgttgtaggtagtctgtactgagctgtgcctgaagtgttaaaatcaggtcttctgaagtcttttgtgaacctgcaccttcccgtgggtttgtgtggtgacttttcaatttctcccttaaatgtggttgcgttagaatgtcttactcttcaagatctggctctcaaaaggggaaaaagagaaaaattaagggagaaggaagaggcatcagttctttaaatcctccgaaagtcatttcagtcaggagaggaacttgcatcaatgttgagggaagtgcaacaacagtggtcatcccctctctttcagttgactcctagttccaaaatggttacatgattcattctgccagtgcaattgttacctagcctgggagtcagattcctggtgtttactaagctgccatctcccagaatcctctctcattgcttaaccttgaatgcactggagactttttttgaataaacatttaaaaaaaaatcttagtcttcgttttattgtattggccatttgaagcactcttgaataagcatgagtctttaggtttaaggtgaaacttcttccgtttgttattttgaaattaagaaattatttactcaaaacaaatatagtaagatcttaaacagttatatttttatataagaaatcaagtcatttggtgaatttaaatgatttttaagatgagaattttggtttcttgactttttctttatttcagtgctttcctttttttttttttttcctccttcttactcttatgtctttggtctttgcactggtgcagtgattttaagagcaccgattcctggcacataacggtaaagtctttaaactcaggatattcaaggtaaattgtcagtagtaccacattttgttgactctacaatgcctatgtttgtaaggtacactgttattttatataccattaagatggaggaaaatactgccaatcatcattaaaagatgcattccagtatcataaatgttaatacaggtgaaggatgtactggctaagcacgttggcccatgccagtaatcccaatgctttgggaggccaaggcaggaggattgctttgaggccaggagttcgagaccagtctgggaaacatatcaagactccatctctacaagaagtatttaaaaattaaccagatgtggtggtgtgcacctgtagtcccagctacttaggaggctgaggtgggaagatctcttgagcccaggaattaaaggctgcagtgggctaggacctcaccgccgcactcaagcctaggcaacagaacaagaccctatctctaaaaaaagaaaaaagaaaagaaaagggtataccttagaatctttgaaatataatacatgtatggaaagtgtgctctcatcataccacaatttgtagtggccttgtacattgttttgtaatgcttataaaaaactggagtgaaggaaacattttgagcatttttcatattcagaagccaatcaaaatttgattttcacattgttttcattagttccctcttacattggttaagtccagtaaacatctttagtgcctaatatatagtagctattcttataacagtagccaacatttatataggttttactgtgtggtaggcactattttgagtgctttatgtatttcaagtaactaaattttataatatccctatgaggtgagtactgttattatccccattttagcaaggaggaaactgaggaagagagaagtcaaatgacttggccaaggtcatacagctagtaagtggtacagctggggtttgaatgtagatcctctgactgtagagaccaggctgttagcagtattcctaagcacataaagatgaataaaatattgtcctttccctcacatatcttaaccaggcagtatttgaaggtgtgttgatagatttacattaaattattaagttatccttctggtaattaatttttctttgtatttttaggacattcagtcagaagaaggctgctattgaaagagagtatgcacaggtaagcttgaaattggaggtcccattctaggtatacttcttttccgtggcttaaggacagagatggtttttggagagaagccatattatccctatgccttccttttcttgttatttctttcttgtttttttttttttctttttttctgagatggagtctcgctttgttgcgaggctggagtacagtggcgcaatcttggctcactgcaacctccgcctctcaggttcaagcgattctcctgtgtcagcctcctgagtagctgggactacaggtgtgtgccaccacacccagctaatttttgtatttttagtagagacagggtttcaccatgttggccgggatggtctcgatctcttgaccttatgatccgtccgccttggcctcccaaagtgttgggattacaggcatgagccactgtgcccagcccttttcttgttatttctgtctcattttgatcccccactttgctgcctttgaatcattataaagaaggttgtaaacctggaggagacattatttactatatttgtaaagtatttacaagtatgaataataatactttttacaagtttgttgatttattcttctttatatgccccattctctgcagtttatgaaaggttaatttttcatcacgcatttagttctcattatgactgtgttgataaagagtaataatgcttttagtggatgacatggagcttttcctagggaaattgaagcatttccttctttaattttacttagacctttagtggagtccagattacaaaatgtgacaagaaaaaattatgttgatgtatcattttatggttgtataagaattaataactattctttcatgtacaaagataatttgatacagtttgaaaattttgaccctttaagcaattactttatatgtgggggagtattctaaaattgttatttccttctgcaaattgtaaaagttgtctttgtagcaaaaattttaaaatatgggagattgttagaaggaaaaattaacatacagtaaattttctacatggtaaccactattgctgctactgtttttattctcattataaataatgagagattggggcatgactcttttaggctttgtcagattttttaatgaaattctgatttcattatagttaattttgtagctgtttgcctttatttttgatttgataatcttagaagaaaatcacctattccttgaaagctagacagaactaattaattcattggttcaatcagtagttgttgagtgcttattgtgtatcaggtgctttacataatgaatagcatcagttttaatatttctgttgaatgctttttcttttctttttttttttttttttttttttttttgggacaagtctcactctgtgatccaggctagagtgcagtggtgcgatctcggctcactgcaacttccacctcccagattcaagcgattctcctgcctcagcctcctgagtagctgggatgacaggcacacgccatcacgcccagctaattttttgtatttttagtagagactgggtttcaccctgttggccaggatggtctcaatctcttgaccacgtgatccgcctacctcggcctcccaaagtgctgggattacaggcatgagccaccgcgcccagccgatttttgtatttttagtagagacgggattttgccatgttggccaggctggtctcgaactgctgaccttaggtgatccgcccacctcagcctccctaagtgctgggattacaggcgtgagtcaccgcgcccgatcttgaatgctttttctatgcctgtataataaatactagtaatgatagctgacatttattgaatccttactttgtaccatgctctgagtattttatatatgttatctggtttgatcctttcaaacctgtgaaatagcaacagttatgatgccctttacaaatacactttcatacatgtacactacatatatatttataaaattgagatgaaagtctgtgatacgctattttagccaagtgcagtggcacatgcttgtaatcccagctagtggggaggctgaggcaggagagttgcttgatccctggagccggagattgcagtgagctcagatagtgccattggactccagcctgggcaatgggagtgaaaccctgtctaaaaaaaaaatagaaaaaaagtctatgatatgctttaaaaatttttaatacaaaatcaaaatttttatatgatacagtcttctgtaacaagatttatttatttatttaattgagatggagtctcactctgtcacccaggctggagtccagtggcgccatcttggctcactgcaccctccacctcccaagttcaagcaattctcctacctcatcctcccgaatagctgggactacaggtgcgtgccaccatgcccttctaatttttgtatttttagtagagttggggtttcaccatagtgggcaagatgatctcgatctcttgaccttgtgatccacctgcctcggcctcccaaagtgttgggatttcaggcatgagccacagtgcctggtcgatttaaagttttaatcaagtaaataggacatgtttattatttaaaatgtaaaatactacattaaattttatgaaaagtgagtcctctgctccaatcccagtctttttccacaaagattaaaagtggatgtctactttggttctcctggtgattatttctatttctttattttattttattttattttatttttgttgtttttttgagacagagtcttgctctgtcacccaggaaaaactagagtgcagtagtacagtcttggctcactgcaacttccgcctcctgggttcaagtgattctcctgcctcagcttcctgagtagctgggattacaggtgcctgccatcacacctggctaatttttgtctttttagtagagatggggtttcacaatgttgtccaggctggttttgaactgctgacctcagatcatccgcccacctcagcctccgaaagtgctgagattacaggtgtgagccaccatgcccagcctctatatctttaaataatatgcttataactcactctttgtcaattctagacattatcacttgattacctataataaatgagaaacttactaagccattcctctccagcctactcttttcaatataattgtggcactactttagtacctttgttacttttgtaactctaaatgatatatttaaacttggtcttttttttgttaaatacatatatgcacatagatatttatgctgtgtatctgtgtgtaaatatgaatgtatgcaggtacagtggaattacattttacagagtggtcaaagttaaagtcaaatttacccttgaaaaatttcttttctttctttctttttttttttttttttttttttgagacagggtcttgctctatcacccagactggattgcagtggcacaatcatagcttagtgtaatcttgaactcctgggatcatgtgatccttctgcctcagcctactgagtggctgggactacaggtgcatgccaccatacccgtctagtatttttattttgtagggacagggtcttactatgttgcccaggctggtctcgaactcctgggttcaagtaattctcctgtctcagcctctcaaagcactggggattagaggcatgagctaccgcgcctggctgaaaaatttctttaaatgtctctcaaatagattataactagttttgtttatacaatcctatataataatgtatgtaaactatgtaacgtatctaataatgcatttttaaaatttttataaagtaatcatatgcagaaattaaaatactccagtgtgtctctgcttgggaaaatcgagcccatttatagagagccagtttactgcctgtttctgttacttatcacatttgccctttagatgatccttctgagttcttcttactctttaatgttctcccaattaattttcaacttattttctgagtatatagacaaagatatttctatcctctctttttgattgtgtaaacattgtttttacttcttgtcaatagtagagaaacctctgaaataattagcatattctttctatagattttgccagtatgcattgattatttcaggcttatttgcatttcctgtatggggacaggatgtggtcagagaggacagttgcattatttaaattatttacttctaggccaggcaaagtggctcatgcctgtaatcccagcactttgggaggctgaagcgggcggatcacgacatcaggagttcgagaccagcctgaccaacatggtgaaaccccgtctctactaaaaatacaaaaaaaattagccaggcgtcgtggcgggtacctgtaatcccagctactcaggaggctgaggcaggagaatcacttgaaaccagaaggcagaggtttcagggagccaagatcaggccaccacactccagcctgggcaacagagcaagactgtctcaaaaaaaaaaaaaaaattatttctcttaactcttttggcttagtgtagacttgaaattttggggaatacattttaaaaagttgaaatatagcctatttatagtaagatggacaagtccttagtacactgtttgataaatttttgtgaacacactcatgtaaactattatccagattaaggtatagaacattaccagcaggccaggtgcggtagcgcacgcctgtaatcccaacacttggtgaggccagatcatattgatcactttagatcaggagtttcagaccggcctgacaacataatgaggccccatctctataaaaaataaaaaaaaattagccaggcgaggtgacgcatgcctctagtcgtaactacttggagactgaagcaggagaatcacgtgagtccaggatttcaaggctgcagtgagctgtgatcgcaccactgtgcttcagacttggtgacagagtgagaccttgtctctaaaaaagaacaatcccctatcccccaagaacattatcagggccccagaagcagttaatattcatacctttcaatggcaaccagtactttttttttttttatcagaatagttgttatttttggatttctaatttttgaacttaaatggcatcatagaatatgtacccttctgtgtctgatttctttcattcagtattcagcttttaagcttcatgcatgttgttgcatgtagtagtagttcattctttattgtgtccactgaatgaatatatcacaatttatactgatagagaaaattcctattcttgttttgtatgacttttgactagggcttctaaacaaaggttttatacgtgtctttaagtggacatatgaacatatctttctttggtatatgtctgggggtagaactgctagggcatcgggcatgtggtatgttctactttagtagatacagccagttttccaaagtgactgtaccagttgacattctcaccagcaatgtatgagagttccaggtgcttcatatctttgctaaagtttagtattctctaaaattaaaaagactgacattttggtgagtatatagtagtatctcattttctttttaataagctttagaaaaattgacatatacgtacagagaagagtacaagtcataattatgtagcttcaggaattttcaaggcaaacacatccatataactagcacccaggtaaagaaacacattaacagcatcccagaaattcctcttgttccctgccattactgccctcactcttactcaaggaatctactatactgacttaaaaaaatagctttattgttatgtagttgatacacaataagccacacaatttataatttgataaattttggcatgagtatgtacctgtgaaactagcatcacaagcaagataatgaacacatctgtaagcccccagagttttcctgtgtgtccttataatccctctctcccagctggcttcttcatttagcattaactattttgtagtttatgttgttgtgtgcatcagtatttcatttctttttattgctgtgtagtattccattgtatggatataccacagtttatccattttcctgttgatggacatgtgagttatttctgttttttgagtattataaataaagttgctataaacatttgtgtatggataagtggtttcattcctcttgggtaagtggaatggaatggctgaatcatttttaactttttaaataactgccaaactgtattccaaggagattgttcccaccagctgtgtatgtgagttctaggtgctacatgtcttcctcaacactagatatagtcttcttaatttttgatattgtgatagatgtgtagtagtatttattgtggttttaatttgtatttacctaatatctaatgatgctaagcatcattttcatgtgtttatttgccatctgtatatattctgtggtgaggtgtttgttcaaatattttattgatttttttttaaattgggttgtttggtttcttaatttttaaagaaacattattattaaagttttcaaacatatgtgaaagtagaacgaatgagcgtaacaaacttttttttttcttttttttctttttcttttttttttttttttgagacagagtctcaggctggagtgcaatggcataatcttgtctcactgtaagctccgcctcccgggttcatgccattctcctgcctcagcctcctgagtagctgggactacaggtgcccgccaccatgcctggctaattttttgtatttttagtagagacggggtttcaccatgttagccaggttggtctcgatctcctgacctcgtgatccacccatcttggcctcccaaagtgttgggattacaggcgtgaggcactgcgccgggcctagcataacaaactcttattagctatcacccagcttctagtagtatcaatacattacaaaatttgttcatttatagcttcccacctgctatcccttgctggttactttaaaaaatacttttatgtatacttttaatttacataccattaatgattcatcaatcttaagtatgtaattaaatgatttttagcaaacatacaaagttatgccataatcagcacaattcagttttagaacattgccattattccagttcatctcctgtggctgtttgaagtcagtctctacttttatcctgagcccaaagtaaccatcagctttatgtctctctaaaattgcctcttctggacgtatcatacaaatgtaatcatatggtatgtctcctttcttgtctgtcttctttcgcttagcagatatttttgaggttcttacatgttttactatgcatcattaatttattcctttttattggtgagtagtgtttcttggcacagatatataacattttgtttatccattcaccaactggtgaacattagattgcttcccattttcccatgtttcaaatttggttattaggtataatgctgcctaataaccatattagtctttatttagacatgttttcatatttcttgggtatgtactaagagtagaattttcacatcatttggtgattttatgtttaacatttttttgtttgtttttgagatgggttctcactctgttgcccaggctggaataaagtggtatgatcatggctcactgcagcctcgacctcccgggggctcaggtgattctcctatgtcagactcccaagtagctgggactacaggtgtgcaccaccatgcctggctaatttttgtgtttttagtagagatgaggttttgccacgttgcccaggctggtctcgaactcctggactcaagcgatccgactgcgttggcctcccattgtgatgggattacaggcgtgagccaccatgcctggcccccgtgtttaatgattttttctttgttgatttttttttttcttttgagacagtcttgtcagtggtatgatcttggctcactgcaaactctgccccctgggttcaagaaattctcatgcgtcagtctcctgagtagctgggattacaggcacgcaccaccactcccagctaatttttgtatttttagtagagatgggttttgctatgttggtcaggctggtctcgaactcctgacctcaagtgatccgtcctccttggcctcccaccatgtttaactttttaacaaatgatcaaactgttttccaaattgactgtatcattttgcatttctgctttgcattgtgtttgcattctcgttttgcaatgcatgaaggttctagttctagtaatgtcctagcaaatacctgtcattgtctgttgtttctgataataacaattgtagtggctataatcaatcattatgaatggtgccactgtgaacattcttatatgtatcttttggtgactatatgaatgtgttctattgggtatttacctaaggaatggaattgttgtgtcataggttatgtgttgttcagctttaggaaatatcatgaaatggttttctcaggtgattattgcaatttacaatcctgtgagcagtgaatgagagttgttattgctttaaatcctcacctatacttggttttgtctgtggttttcattttagcctttctggtgaatatatgatggtaaagaattgtgggtttgatttgcactttcctgatgattaatgaattagaggaacttttcatatcttgattgggcatctaaatattttgtgttattaagtgcctgttaaagtctcttgttggcttttctcttattgatttatggtctttctttccctgcctccctccctccccactgtctgtccgtccatccttgggacagggtctcactctgtcgcctaggctggagtgcagtggcgtgatcctagttcactacagcctcgaactcctgagctcaagtgatcctcctacctcagcctcccaaagtgctgggattacaggcatgagccactgtgcctggccagttttactatctctttatacgttccaaatttgactcctttgtcagatgtatgtattacagatatctctgtaatctcatgtggaaatgttttgtttgatagctttttatctgttaatggtttcttttgatgaaaacaagtttttaattttaaggaaatatattttttttcttttatattcagtgctctctttatgtcctacttaagggtatattgctatcctaaagtccaccttgaggtgtgttatgcaatgttctggaatttttattgtttaatatttcacatttagttctatggtctttctgaagtaaattttcgtatgtgatattgtattggggtgaggatttcattttctatgtggatattcagttgaagcatattttatgcttgcacatatgcttgcacatattttatacttgcacacataagtccttgcacatacagagttttattctatgatattatgtagtcttgcaagcatattttgtgcttcctcaactgaaaatccatatagaaaagtttatttttctatatggattgaaaagtttattccccctgactgcactccagcactgtattgaagtgatattttgtggcacattagttaactgtgtatgtaagtctgtttctggactttttattctagtcaactgacctatctttgaaatatttttttcccgatatcacactgttttaagtactttgtctttataacaataaatcttgatatctgttcgtttaagatcttatactattattgccctttatattttcttataaattttagaatcagtttgttaatttctcccatatgctgcctgatattttgattggacttggtttgaatctttaagtcaatttagggggaactgatatcttaacaagtcttctaggtactgtgattacagcaatgctcaaaaaagaaaaaaaaatccttgcacatgtacagtttttattatttgattttatgtggtcttccagttaaatatattaacttctttctcttcaaagccacttatatggcattatggccaactggaaaagaatgacttttatagaaaaagaataattttatagaattattacgaggaatgtatattgttatcctctgtgcaaaggattgattgactaaaaagattgagcgtttgtgaggtttacagagcatacaggtgagccatcctaaaagaaaaatattgtgaaggaaattaattcaagtgggattgatcgtatgacagcaatttggaaaattttatctcaagcacatgcaaagtaaacttgtattacctctttagggcgatgttagaagaaagaaagaaaataatattgcaaaaccttgcttatataattggaggaattcaagcagtgaactttttcaagttgcttggtagtttcagtttcctacaagagtattaatgttttatttttaagtatggtttgtgaagttcactttgtaattctccagaagtaacagatgtattgcatatctgtttctacaaatgacaaatgtatctgtgaaaacagaagtcatgtaagaataactgagcaacattaaatattagggaacaatcaagtctagcttctgactgcaattagctaaccactgaggtgttggtaaaatcatttgcagtactcaaactgaaattgctacaggcaagtgctgtgtattaaagtacttcctgtagtctttggcagaatgctgctagtgaaggaaggatacagaaggttactgtggctggagagaaggagcaggaaaacattgtggactttaagggcggctccttgcttaaagacaaacacagagtaaacacagacatgttggcaaataccctgtggtatttatactgttgcacctaaaattttttgctatttttactcttttaagaaataaaattatgaagacttgggcatactatacaagaagttagtgttatgtgcatgtggtgggggttcttttttggtgaatttcatctgcatagaaacttaaaaatgtagcttaatttagcggtgtgtggttacttttctgtctaatgctattagagattaatggtgaatatatttggagcttttctttctgccaatcttgtcctatagaacaaataaggagacaggataactatcacaataggacgtccaccagggcaaaattgagtattattttctgtgtcctgttttgtaaattactttttaaaatcttactgtttatttttatttcatttttccttatcttataacagtgtttagaaattcatatagaaggaagagcagatggagtcctctcctgaaatagttggtacagtttgatttttaagtttttaaaaacttcattaaaggaagttttaaaaaacttcattaaaaatttaattaagtttttaaacttcattaaagaaatggtggctataattaaatgttagtactcttggggacatagatttgctagtaagtttcactttttcatggctattcggtagcacatctcgtaaaggtgttgagaggaaatcattgttgatgctgatccccattattttcctccccaaaccttctgtttctattaattaatttagtggttaggccaggataaaacagagtggagagaggggagaattcatactagatctgtgattttgaaccttttgtgtgtgaacatgcccgtttttattttggctccttttatacaggacatagtggtctgcgtatgtcttcactcatttgttgtttacctggtcccactggttgagtttgagtcccctgccctgaccgctgatcaaaaaataagattttttataggcacctctgtcttaacctctctatatcagtttatgctgtggactctttctctgtattttgggttaaagaacatatattaagatcatgtgtcaggcactgttctaagcactttacatagattaactcatttatgttttccctataacctttgagggatacagtagttactgttattcccattttataattgtggacaccaagacaagaaacctgtgtttcactctgtccatttccctcccttcaaataatctactactggacacttttttttgtctttttgttgagatggagtctcattctgtcgccaggctggagtgcagtgacatgatctcggctcactgcagcctctgcctctcaggttcaagcgattctcctgcctcagccccccgagtagttgggactacgggcacacaccaccatgcccagctaattttttttttttttttgtatttttagtagaaacagggtttcaccatgttggccaggatggtctcaatctcctgacctcgtgatctgcccgcctcgacctctcaaggtgctgggattacaggcgtgagccactgcgcccagtcctggacacattttaagagagacattggcagtctgaggtgcatccaaaagatgaccaaagttggtggtggggttggaaatcatgctttttgggaaaatggtcaaagaagctgcattattttcaacagcctccattatagatttcatgtgtatgcacgtgaattgaatttgactagtttttgtaactctgaagtgcaaaactaggaagagggagtagagagatcaggatgacagaaggtattagctagttagagcagctccagaatggaagagactgtgtcttccaaaagtgttcttgtaaaataattggtagaccatcttttagtaatattgtaggaggcatttatggaaaacatttttctccttaaaagattttgtttaatgtttccaattgcttgtggaattggacaaataaaacatgtgtaaaggcccttcccatctgaaggatgccagtttgcaacttctgctttaattgttctaggttttacttctgaatcaaactaaattcttagttttcagaccacattatttcacttccagcagactgcttttactgaggtatgcttaaacctcacttaactaaccactgaggtgttggttagttattaagtgaatggtgacgctctaaggtcaccattcacttaataacttgttcaatttcttttttttttttaatttgacatttaggccgggtatggtggctcacgcctgtaataccagcactttgggaggccaaggtgggcagatcacttgaggccaggagttcgagaccagcctggccagcatggtgaaaccccatctctactaaaaatacaaaaaaattagccagacatggtggcaggcgcctgtaataccagctactcaggaggctgaggcaggagaatcgcttgaacccgggaggtggaggttgcagtgagccaaggtcgtgccactgcactccagcctgggcgacagaacgagactgtatctcaaaaataaaaataaaaataaaaaaccctgacatttatcaagtatctactttacgactggcgtgatgctaggttctagggatgtcaagagaaggttgggatatataggctgtttagtgctggaatgttatcagtaaaacagagtggtatgagatgaagctgaggagcagacagggcctatgccatataagaggcttgttagaaatagccttatgaaatagactacacttatagggatattgttctggagattgctttccatgtcattaatagaccattatatgaaggctaggaacatctttgtttaccctatattttcttcttgggacaatgaaattcttgttactgataagtttccttttttacttttgccagaagttcttgtgactgataagtttccctttttactttcgccacctggaaattcagttgaaaattcaagcccatgtatgtgcattctaactttctacctggtcttgatctattacttcatgtaattttctgtgactctgtttttttacatatttagttattgttttatatataatctgataagtgatttagattctttgtggaatgagaccaatgtatcatttatgaatctagatgttttatttgccttgctggtacccagagtcatttgttatttgttaacctgggtctcttgcttttcttcaattctggaaagaatttagtcatttctgtaaatattgcttcttcaacattatttgtatctatctctttttaaagttttaattgttgtatcttggatcctcttaatctattttccatgtctcttggttttttcacatatttttaattctttgctctttgtgctatgttctggatgaattaaccagtttgaacttccaactcaccaattgtctatttaactgtgtctatttgagggttttatcttatccattgctttgttagtgatcatattctttctaggatttttggttctttttagagatgtgtgtatatatgtatgtatgtatatatgttcttataccagttttttttcagttctgtgtgtttttgtaatttcttattcttttaaaattagaaatgatttttaaatttctctttggatagttattttgtagtcttttttttttttttttttttttgagacagagttttgctctgtcacccaggctggagtgcagtggtgtgatctctgctcacagcaacctctgcctccatggttcaagtgattttcctgcctcagcctcccgagtggctgggactacaggtgcatgccaccacgcctggctaatttttgtacttttagtagagatggggtttcaccattttggccagactggtctcaaactcctgacctcaggtgattagcccaccttggcttcctaaagttctgggattacaggcatgagccaccattcctggcctttttttttgttttttggagatggttttgctctgtcatcaggctagagtgcagtggcgaagtcatgactcactgcagcctcgaccttctttacttaagccatcctcctacctcagcctcccaagtagctgggactacaggcacatgccaccacacctggctgatttttttgtttttttaatttttttttctttttctttttttttttttttttttactttttgtagagatgaggtctcactatgttgcccaggctggttttgaactcctgggctcaagcagtcctcttgcctcggcctcccaaagtgttgggattacagacatgagccagtgcacctggcctgaagtctttataaagagttttatgtataattaacttcatctgtaccaaatgtgtgttccaattgttaattttgttaactgtataaaaactgataaaactttaaaccaaaaatatataaaggaatctaattttagttcaccttgtgttttcataataactttttttttctcaacttttttttaacttcaggagtatatatgcaagatgtgcaggtttgttacataggtaaattttgtgtgccatggtggtttactgtacagatcatccaggtattaagctcagcatccattagttattcttcctgatgctctctctccgcccccccaaccccaccctaccccaccctccctccaccacccaccgcacaggtgttcagtgtgtgttgttcccccaccatgtgttctcattgatcagctcccactcacaagcgagaacatgcacataatggcatatttttaaagaagaaattatttcttcatttatttggggtactgatatggtttgcctgtgcccccacccaaatctcatcttgaattgtagttcccataattcccatgtgttgtgcgagggacctggtgggagttaactgaatcatgggggcagtttcttccatactgttctcgtggtagtgaataagtctcacgagatctgatggttttataaggggaaacccctttcacttggttcttattctctcgtgtctgtcaccatgtaagacatggctttagccttctgccatgattgtgaggcctcccaagccacatggaactatcagtccattaatcctctttttctttataaattacccagtcttgagtatgtctttatcagcagtgtgaaaatggactaatgcaggtacctcataaaggtccttgtaagactgttctcaatgatttcatgtgaaatgattttgtatttcaattgctggaatattggtttaaagcctcattttgagaggtaggggtttttgttttttttcattccgctcattttctctgtgcttatccttctctgtctgatgattttgcacttgttccttttcagctcctaagtctttaatgtagaaccaggtcttataaatgcttcagggatcttgaacatgatgatattggggatatggcagacctaccactgaaccagaggggaagttcaaattgttttttattcaatttaagagcatatctattttctttctttcttttttttttattatactttaagttctgggatacatgtgcagaacgcgcagttttgttacataggtgtaatgtgccatggtggtttgttgcacccaacaacccgtcacctatgttaggtatttctcctaatgttatccaccctctagcccccaacccccaacaggccctggtgtgtgatattcccctccctatgtccatgagttctcattgttcaactcccacttatgagtgagaacatgcagtgtttcgttttctgttgtgatagtttgctgagaatgatggtttccagcttcatccatgtccctgcaaaggacatgaactcatccttttttatggctgcatggtattccatggtgtatatgtgccacattttctttatccagtctataattgatagacatttgggttggttccaagtctttgctattgtgaatagtgccggaataaacatacgtgtgcatgtgtctttatagtagaatgatttataatcctttgggtatatacctggtaaaggggatctctgggtcaaatgatatttctggttctggatccttgaggaatcgctacactgtcttccacaatggttgaagtaatttacactcccaccaacagtgtaagagcgttcctatttctccacatcctctccagcatctgttgtttcctgactttttaatgatcgccattctaactggcgtgagataatatctcattgtggttttgatttgcatttctttaatgaccaatgatgatgagcattttttcatgtctgttggctacataaatgtcttcttttgagaactgtctgttcatatcctttgcctactttttgatggttttttttttcttgtaaatttgtttaagttctttgtagattctggatattagccctttgtcagatagattgcaaaaattttctcccattctgtaggttgcctgttcactctgatgatagtttcttttgctgtgcaaaagctctttagtttaattagatcccattagttttggcttttgttgccattgcttttggtgttttagacatgaagtctttgcccatgcctatgtcctgaatggtattgcctaggttttcttctaggatttttatggtcctaggtcttatgtttaagtctttgatccatctcgagctgatttttgtataaggtgtaaggaagggatccggtttcaattttctgcatatggctagccagttttcccaacaacatttattaaataggtaatcttttccccattgcttgtttgtgtcaggtttgtcaaagatcagttggttgtaggtgtgtggtgttatttctgaggcttctgttctgttccattggtctatgtatctgttttggtaccagtaccatgctgttttggttactgtagccctagtttgaagtcaggtagcgtgatgcctccagctttgttcttcttgcccaggattgttttggcaatgcaggctcttttttggttccatatgaactttaaagtagtttttttccaattctgtgaagaaagtcagtggtagcttgatggggatagcattgaatctataaattactttgggtggtatggccattttcatgatattgattcttcctagccgtaagcatggaatatttttccatttgtttgtgtcctctcttatttccttgagcagtggtttgtagtgctccttgaagaggtccttcacatcccttgtaagttggattcctaggtattttattatctttgtagcgattgtgaatgggagttcactcatgatttttctctgtctgttattgatgtataggaatgcttatgatttttgcacattgattttttggatcctgagactttgctgaagttgcttatcagcttaaggagattttggactgagacgatggggttttctaaatatgcaatcatgtcatctgcaaacagagacaatttgacttcctctcttcctatttgaataccttttatttctttctctttcttgattgctctggccagaacttccaatactatgttgaataggagggatgagagagggcatccttgtcttgtgccggttttcaaagggaatgtttccagtttttgcccattcagtatgatattggctgtgggtttgtcataaatagctcttattattttgagatacattccattgatacccagtttattgagagtttttagcatgaagcgctgtttaattttgtcaaaggccttttctgcatctattgagataatcgtgtttttttgtgattgattctgtttacgtgatagattacatttatcgatttgcatatgttgatccagccttacatcccaggtatgaagctgatttgatcatggtggataagctttttgatgtgctgctggatttggtttgccagtgttttattgaggattttcgcattgatgttcctcagggatattggccttaaattttctttttttgttgtgtctctgtcaggctttggtatcaggatgatgctggcctcatgaaaggagttagggaggattccctctttttctattgtttggaatagtttcagaaggaatggtaccaactcccctttgtacctctggtagaatttggctgtgaatcggtctggtcctggactttttttagttggtaggctattaattactgcctcaatttcagaacttgttattggtttattcaaggattcgacttctttctggtttagacttcggagggtgtatgtgtcaaggaatttatccatttcttctagattttctagtttatttgcatgcaggtgcttaaagtattctctggtggtagtttgtatttctatgggatcagtggtgatataagaatatcccacaggatatcaccactgatataaggatatcaccactgatcccacagaatcagtgatatcccttatatcattttttattgcgtctgtttgattcttctctcttttcttctttattagtctggcaagcagtctattttgttgatcttctcaaaaaaactgctcctggattcattgatttttttttttgaagggtttttcttgtttctatctccttcagttctgctctgatcttagttatttcttgtcttctgctagattttgaatttgtttgctgttgcttctctagttcttctaattttgatgttagggtatcaattttagatctttcctgctttcttttgtgggcatttagtgctataaatttccctctacagactactttaaatgtgtcccagagattctggcacgttgtgtctttgttctcattggtttcaaagaacatctttatttctgtcttcatttcattatatacccggtagtcatttaggaacaggttgttcaatttccatgtagttgtgtggttttgagtgagtgtcttaatcctgagttctagtttgattgcactgtggcctgagagactgttatgatttccattcttttgcatttgctgaggagtgttttactttcaattatgtggtcaattttagaataagtgtgatgtggtgctaagaagagtgtatattctgttgttttggggtggagagttctgtaggtgcctattaggtctgcttggcccagagctgagtttaggtcctgaatatccttgttaattttctgtctcattaatctgtttaatattgacagtggggtgttaaagtctcccattattattgtgtgggagtctaagtctctttgtaagtctctaagaacttgctttatgaatctggatgctcctgtattgggtgcatgtatatttaggatagttagctcttcttgctgcattgatcactttaccaatatgtaataccgttctttgtctctttcaatctttgttggtttaaagtctgttttatcagagattaggattgcaactcctgctttttttttgctttccatttgcttggtaaatattcctccatccctttattttgaacctatgtgtgtctttgcacatgagatgggtctcctgaatacagcacactgatgggtcttgactctttatccaatttgccagtctgtgtcttttaattggggcatttagcccatttacatttaaggttaatattgttatgtgtgaatttgatcctgtcattatgatgctagctggttgttttgaccattagttgatgcagtttcttcatagtgttgatgttctttacaatttggcatgtttttgcagtggctggtaccggttgttcctttccatgtttagtgcttccttcaggagcccttcaaaggcaggcctggtggtgacaaaatccctcagcatttgcttgtctgtaaaggattttatttctcctttgcttatgaagcttagttaggctggatatgaaattctgggttgaaaattcttttctttaagaatgttgactattggcccccactctcttctggcttgtagggtttctgccgagacatccactgttagtctgatgggcttccctttgtgggtaacctgacctttctctctggctacccttaacattttttccttcatttcagccttggtgaatctgacgattatgtgtcttagggttgctcttcttgaggagtatctttgtggtgttctatgtatttcctgaatttgaatattggcctgtcttgctaggttggggaagttctcctggataatacgctgaagtgtgttttccaactgggttccattctccttgtccctttcagatacaccaatcagatgtagatttggtcttttcacatagtctcatatttcttggaagctttgttcgtcctttttattcttttttctgtaatcttgtcttctttctttatttcattaagtttatcttcaatcactggtatcctttcttcctcttgatcgatttggctattgaaacggtgtatgcttcatgaagttctcgtgctgtgtatttcagctccatcgggtcatttatgttctcctctacactggttattctagttagcaattcgtctaacgttttttcaaggttcttagcttccttgcattgggttagaacatgctcctttagcttggaggtgttggttattacccaccttctgaagcctatttctgtcaatttgtcaaactcgttctccatccagttttgttcccttgctggtgaggaattgtgatcctttggaggagaagaggcattttggcttttggaattttcagcctttttgcactgctttctccccatctttgtggatttgtgtacctttggtctttgatgttggtgaccttccattggtgtgtttgagtgcacatgctattcctttctgtttgttagttttccttctgacaggcccctctgctgcaggtctgctgaagtttgctggaggtccactcctgaccctgtttgcctgggtatcatcagcagaggctgcagaacatcaaagattgctgccgatctttcctctgaaagcttcgtcccagacaggcacctgccagatgccagtcagagctctcctgtatgaggtgtctgttggcccctactgggaggtgtctcccagtcaggaggaacaggggtcagggacccacttgaggaggcagtctgacccttcacagagctcgaacacagtgctgggaggtccactactctcttcagagccaccaggcagggatgtttaagtctgctgaagctgtgcccacagctgcccctttccccaagtgctctgtcccagggagatgggggttttatctgtaagcccctgactggggctgctgcctttttttcagagataccctgtccagagaagggaaatctggcagtctggccacagcagccttgctgagctgcagtgggctccacccagttcgaacttcccagaggctttgtttatactgtgagcataaaaccaccctactcaagcctcagcaatggcggacgtctctccccacaccaagctcgagcgtcccaggtcgatctcagactgctgctgtgctggcagtgagaatttcaagccagtggatcttagtttgctgggctccgtgggggtgggacccgcagacccataccacttggctccctggcttcagcacccctttccaggggaagtgaatcgttctgtctcactggtattcccggtgccactggggtatggaaaaaaagaattcctgcagctagtttggtgtttgcccaaatggccacccaggtttgtacttgaaacccagggctctggtggggtaggcactggagggaatctcctggtctgcagtttgcgaaaaccatgcgacaagcacagtatctgttccagagttcttcaggctcagtccctcatggcttcccctgggtagggggaaacattccctgaccctttgtgcttcccaggtgaggtgaccccccaccctgcttcggctcgccttccatgggctgcacccactgtccaaccagtcccaatgagatgaaccaggtacctcagttggacatgcagaaatcatctgccttctgcgaggatcttgctgggagctgcagaccagagctgttcctatttggccatcttgccagcaatccttgcctgttttcttttgcttctatttatcaacagttctatataagttcttgttcctggcagctgttggtagcattttttcagccttccttcatgaacacgggaatctcactatagtgcctggtttcaagctatgaacctggctcctgatccctgtcccactgtgagcccttttagtttcctttactttgcaggagccaaactctccattgccttcttcttaacctagagttttgtgtatttctaacttcaatcttgcccacagctttgcttttctggcccaggggaaatagttatcttattttcatgcccatttttgtcttatagttttttcctttttattttttaaatctctcattcataagtgttttcagtgggatgagtggacaatccatcaaagcatgaaataattacatggtcttcatgcaaagtctttcttagatagcctttatggctccttctggctctgacattgtatgatatactattgattatttcccctggaaaactttctcactgtaatgtgttccttcattgcctgtgagaaggagcacaagacaaataaaactttttttttatcctggtatttttccaggctcctggtattagaatgtttgaaatgaaattatacaaaatgtcttcagataaattatgagttcttgggaaattatgtttgaatttgctggtgacagataataataataaataggtagaaatgaagatatgaataatgcttcaatttcctaaatgccaaaatatggtacaattagacatttgtttaaacttccttgaatgggtgttactttcctgaggtttaactttaaattagtggctgcatttgcattcattcaatgaatctattgggtgactaactccttatacagtaacagagtcacagaggttaaggctaggcttctagaggtgttagtcatctctgatagcagtgtatcctacctgcttttaaaaagaacattttagtaaggataggaggtatacgttagaggaatatataatttgctttgtttgtaacaggaatacctgagaatgtactgatgaccatgtaaacaaggtacagtttagggtagaatttctgcagatataagcaaagttttggtacaacaaatggttaatttatcaagtcttctattagtcaaggattgtttgagagtatgctaaaactgttgtctgttccttaaccgtgggttttcattgtcttgggatgagaatccatgctttcagattgccagaattctggaagtgttcacagctaggggaaaaaaagaaaaaaaaagaaagaaaacctcacagaaaatttttagtaaaattcattattagccggtttctcaggacttcatttggtaccaggatacataaaacttgaattttcatagactaattttgcttttcctcttaccatggaaagaagattagaagtattggttgaccttcagcaaaataaacttagtacaaggcagaagaagttagagtgaagggtagggagcattcctcgtttttagggatagtcacatctgacatttatgtttatgatttatgaactctttgaagtgcagtctgatggctaacacttatctgacacaatgttttctttagcccgtcctacaacttcttaatcctagaaaacctagaaattaatttttaaaattccttttttaaaaaggaaacaactttatagtgtaaaaatccttttctggtatgggggttaaaaaaaaaacccacggagggtaaataaaccgtagttcacacagtgtaatgtaaagtcttcagccattgtcaatagactctgtattttgaaatcattttgctttcatcccaaatggttgacttttcagtatttgagctagacttaccttatgaattatagtgtgcattctcactgaaagtagtctcattttcttgtttacatttatatccatgtttgttgaattgagtacagttcaacaatggtatttcttagcttagcttaaaaactaaaatgggatgattcattgagtctatttcaccttatgttatagaggctagcctatcaatgtaaggactgtggaaactcatatgcaattatatttctggttggtaagtgatccaaaaaagatgtaaaagattatttatcccgttagaaaatgaaagtctaggtgggatggctcacacgtgtaatcccagcactttgggatgctgaggcaggcggatcacctgaggtcagaagttcaagaccagcctggccaacatggtaaaaccccatctcgactaaaaattcaaaaattagccaggtactcgggaggctgaggcaggagaattgcttgaacctgggaggcagaggttgcagtgagctgagatcacaccactgaactccagcctgggcgacagagcaagactctgtcttaaaaaaaaaaaaaaaaggaaaatgaaataaacctaaaaaacaagtaatcattatcagagaatgattatatagccaagaagttttgttaaaaataaagatcttgaagcctttccctaatttaactatgtatctttctatcatgtgttatactagtagtattcaaatcaagaagttagtcagtttgttgtttagataattgatgggcaaattgtgatgacatctagccataccatgtcacactgagtatgttacaactggaattgtcctttgttgttagaatattggtatatatactataccatttaatgtctgattttcatagctctctgtgctgtaataacctcaagtgttaatgccaggttgctgtagcatcagcctggctgattttatgacataaaacaataatggtccaatacctttaaagaatacagaattggccaggcacagtggctcacgcctgtaatcccagcactttgggaggctgaggcaggcggagcacgaggtcaggagatcgagaccatcctggctaacacggtgaaaccctgtctctactaaaaatacaaaaaattagccaggcgtggtcgtgggcgcctgtagtcccagctactcgggaagctgaggcaggaggatggcgtgaacccgggaggcggagcttgcagtgagccaagatcgtgccactgcactccagcctgggcgacagagcgagactctgtctcaaaaaaaaaaaaaaaaagaataccgaattggcagtcctggaggcttatgtgtcccaggctcctcttagatccctcaagaactgaggggaactcattccctgtatagctgtggggcgcaatacattgtttgggaagctctgatttaaagggttagggactgagcttgattaatagatgtacagaacactttgagaataagggttttgttgatgatgaataaactgggagtcttggcatatctcgtggtgactgatgttgaaagggaaatggagcctaatggaatagtcctgatggccacctagaaggaggtagaatattccttatatagatgttttctcctccctccctcccttcctctcttcttcccttctgtcctttccattcacctatatcctttttaatatagttttctggagaaggcctacctctgttggctgtgagggcaggaagcagacaagtaagctgggaacccccataattaccacagtaaggaaatcctggtggaatgctttaagtttctcttctgaaggagattacctggctgttttttttcttccttgtgattctttagcttctgttttgcttctcctagtggcctcagtgcccatgcttcgaacctgtgtactgtgtcctaggtactatgccggtcacttaaagacatgatttcatttaatctttaattgtggggtattcatttgtttactacaaaggtccttctgcattttcctaggttgtttccttatgtacttcacgatgcaaatcaattgtcaacctatggattttatttatttattttattttattttttagtttttgagtcggagtcttgctctgtcgcccaggctagagtgcagtggtgtgatctcggctcactgcaagctccgcctcctgggttcacgccattctcctgcctcagtttcccaagtagctgggactacaggcgcctgccaccatgcccggctaatttttttgtatttttagtagagatggggtttcactgtgttagccaggatggtctcaatctcctgaccctgtgatccacccaccttggcctcccaaagtgctgggattacaggcgtgagccaccgcgcccggccttgtcaatctatggattttattccctcatctgttgctgctcagtctgaatttgatggctctcatgtgctctcctgtagtaccttttgtttctgtcatatgacttattgttctgttatgctctcttctctacctattttgcatagtctctggtatgtgttaaatgcatggtgaatgtttatttaatgaatgaatgaatgaggaaatatagtttcaagttctgagaatgataataaatccttaggtgaaatttaccccatttgaaagattaaattgattcattttagcaaagttgaagagacaaatgtacctaaacagtcctttttcattgtgaacatgtatgacttttagaatctagggagacaaaaaataatttttaaaaagattacattttgggggtatgagcagtgttctttactaataccggtattccctagcagtaaaaaataactcctgtacatcaattagcaatttgtttgcatcaaagagattttaaagatggagaccatctctttactttaggcacagttgcacaggacccctaccttggctcgtaagcccagaaactcaatttcagtttacccagaagacatgtcctgataaaactaacaagacgcttaacctattaatgtataatggacatctgctggtccagataagtaagacacttagggaagcaaggttgtaggtcaaagatagtaagcatttaatttgaactgagagaatgagtttagttttttttatggggtggggcttgtgatcagattttttttattgtggtaaaatatacataacataaaatttatcattttaactatttttaagggtaaaattcattggcattcacagtgttgtgcaactatcaccactatttccagaacattttcatcaacccaaatagatattctgtaatcattaagcagtaattcccctttgtctcctcccacagcccctgaatctactttctgtttctataaatttgcctagtctagatacttcatataaatggaatcacgatgtttgtccttttggacttcagtattcttaaaggatatttctgcttttctactctacagattgtctgtttaaataatggttttcaaatatcttttgatggtatgttttatctattaaaaaatttaagtgatatatatatttgtaacatacatgtactctgtactaatatattgtatacattataaaatatgcataaaatcttaatgaaataaatattattttgaaatatcagtatcttttgatgactttctgctatcattagcttgtatctcaaggtttaaaactttgtcttatttcttatcagattttattggatggtcattgtatacttctcctgataaagagctctgtatgggtagaaagtggcagctctgccatttgtttgtatttgaattattagtatttacttcagtgtttctttatcagaattttttttttttttcgagacagggtctcactctgttgcccaggctggagtccagtggggtgatcatggctaatacggtttggctgtgtccccacccaaatctcatcttgaattgtagctcccataatccccacacatgttgtaggaggcaccctgtgggaggtaattgaatcatgggggtggttttccccctgttgttctcatgatagtgagttctttcgagatctgatggtttttataagtgcctggcattttccctcctggcactcattctcttgcctaccgccaggtaggatgagcctttgttcctccttttgccttcccccatgattttgaggcctccccagccacgtggaaccacagtccattaaacctctttttataaactacccagtctcaagtatgtctttatttagcagcgtgagaatggactaatacaacagcccactggagcttcaacctcttggtctcaagcagtcctcccacctctgcctccccagtagctgagattacaggcacatgccaccaggcccacatgtctgtagtcctagctactctagaggccgaggtgggggggatcacttaagaccaggaggtcaaggctgcagtgagccatgattgtgccactgcacttcagcctgggtgacaaagccaagactctgtctgaaaaaaaaaattataacaggaaaaggtcctttctctctttcctccaccccctctgtttgtttcccccacctccatccctccctcccctcctgtagttggaatacttgttatgtgtctgggattctttagggtcttccagatttagtgcttcttcccctatctggatcagactatacttcgattctttttaaatccaaaatagacaggaattttaggataccaagagacagagactacattgaagggtttacatgcccatcattccctatcacaggaaatacctaaatggtatttaaatttcttttttttttctagccccctgtctgcgtgttggaatgtttaatcgttttaagggtctgggcagtcctgtctttgcttactgaatgattgggaaggaaaatagagaagtaattccagtgggttatgttcaaccatccagagcagagattggcaaacttttttttttttttctgcaaaggaccagatagtaaatattttatgctttgagggccatatggtctctgtcaaatttcccaacattgctgttgtagagtgtaagcagccatagacaattggcaaacaaatggatgtgactgtcttccagtcaaactttatttagtgaaacagacagcaggctagaatttgccaacctgtgcactcaaactatctgttgtgaggactcttccccccttttcccttaaaatttgtagatggacatttttgtaaaatacaataaaagtgaattattggatgagtaaaaaatacatggttaaaatttttagattacagacaacaagttacatttcaatctataatttaaatggtcatacatagggaaaaagaaaacaattagaagaaccataaatgttgttacttgaagatatcttctattaatatagagaatcgctgctatagtcataacttttttgtcattctgtaatactaactaaacacaaagccaagcaaaattgcagctctccatttattaaatgcccatactgtaaacaaacattgtatatatggatatttaacaattttaatatgacatagatttgctttttgctattagtttatctaatctaggttggattgacgacagtactactcacaagagataacgtatttgtatactactcctatattttgttttaacaacactcagtttagagaaaccagatttaaaaatatgttgctgtgaactgaagacatttagatttaaaagaaattttagcaagctcaggatattcatgtctaacttttttccaaggtgaagcaagtgatttttttcagaattcattttctatctttcattagtagtcaattccaataatttatcctgtggaattacagttaaatttaaattatctctcaatgaataggttgtagatccacacatttcttttgtatgaatcttcttttggtggaaaaaatttgaaaatgtttttatcaaatttgtaaggttagtgataatttttcaacaaatataccatacctgattatacctacttcattgaaaattatggaccaaaaaaaaaaaaaaaaaaaaaggctgggtgcagtggctcactcctgtaatcccagcactttgggaggctgaggtgggcagatcacttgaggccaggagtttgagactagtctggccaacatggtgaaaccccatcttactaaaaatacaaaaattagctaggtgtggtggcgggcatctgtaatcccagctacttgggaggctgaggcaggagaatcacctgaacctaggaggcggtggttgcagtgagctgacaccacaccactgctctccagtctgggcaacagagtgagactccatctcaaaaagaaaaaaagagaaaattatggaatatgtcctaaatatctgtagaaactgatcttttcatgctattagcatctttttttgccctttgatcttattggtcattgagaaatacttgtatccctttcttacaagtatgaagattattaaaaataccgaatatataagatgaataaatccaattgtccaattcacacctttaaaacattaggaccaaacttttttatcttgcagaaacactaagaatttgtttcattgtttattttcgacagtgtttctccttgacaaccatggaacttcagtatgtagtaacagtagtgtacaattagttttcatatcctctctcagtgaagagagtactctctaatacactgcattagcctttaagtaattcacaattacactattaattgtcactaaacgtactgtttagacaggtgtctttttttaaaaaaaaaattataccaagagtttctcaatgatggaaacaatgcattgatttacactctggagtaaacggcttaatctggataactgctccagaatactttcttgtcattacaattgcaccatcagaatataccgttacacaaaatttaaactcaaatcatgtttattgacttataatttttcatagatttgtacagtttagaaatcgttatgtttggcagtgaagcagaaaaataattcttccttcacagcaccatcatgttcagatcacatatataccaaaggaaatgccatactatctttgcatttattaagtttcaattaaaaacatgtcactaaatttctttgttctgtgaattggtcttccatgtcattaaccagttcctgaattcatcagactatggtgtcattggaaattggttctttattgcagattcactgaatatttccaagcaaacatctttggtggaatttttccctgatgtcagtgtgtgtggggtgtgtgtgtgtgtgtgtgtgtgtgtgtgtgtgtgtgtgtgtgtgtgtttatataccgtgttagcatcctgaaggtctattatataaaaagcctgaaaacactaatacttatttgaaatagcagacatttgcttctgttggctttgcaattcactactatttatttcaaattttttttgttgttttgaatgtctatatggtttttgcataaatactacttaggttttgagggttttattgttgcatagccagtacatctctgcagataacccatagtggttttaaactttgctgtcagtcatacttttgtgtaaaatagtataaagtcgttggtctttatttctttgaaattactttcattgttgtttggtttactacctctgcctcattcagagacattttatctttttttgccaaggaaagcccattaaactttttctgtttgtaaattaggtgtaaaaatacctatttacttccttaatttagctaaaaatattaaattataaattataggctgattaaaatttaaatgacacaatgacagattatgaaaatatgcttacattttctcagatttaaattttttatttttttattttttagagctagagtcttactctgtcacccaatctgaagtgcaataatgcaatcttggctcaccgtagcctcaatcccctgggttcaactgattttccctcctcagcatgcaacaccactggcagcaccatgtgtgacaccacgtcctgctaatttttaaagtttggtagagacagggtctcactttgttagcccagactagtcttgaactcttggattcaagcgatcctcccaccttggcctcccaaaatgttgggattacaggcatgagccactgtgcccagcaagatttttaaaatatttccattatagataacaaactaactgatgtcaaattgcttaaaactttctaaatgcttactctcaatttctgtacttgcctgttatgtatcagtaacaaacagttggaggacctttgttctaatctagagactaatagaaggccattgtagcaagaaggggtgttctgagtcttatattatttttcttagagtagatattctcggcctttggtaaaacttaattatagttttcatttgctgtatttgagattcagtgagacggttttttcctcatgttagtgaatggagacataacgttcaaccaatataaagggactttaagcaggcaatttgcagatgttcccattatctccccatgtggatatggaaaggcttgtttaaggacagcagtcttagtttatgtcttatttgttcacctgttactgaaaaaccattgtgggggcctgggttcctatgtctattttctgattactccaatgttgtcccacgaaaggaactatttaagagccttatatattcagcagctatagctcaaatccattgtgataaaggtgacccgtcccatatatgtttatagtaatattctttctatatggtttataaatgtacatatatgtctgcatatgatatgtctctatatcaatctaaatacgtctttttcacttatttctacatattgttgaattgcttaatgactttttatggaaacttggagctagaagtggtgtgaaggtcatatggtccagccctctttttaatatagaggctggcaaactagggctgtctggtctgacacctgtttttgtaagtaaagttttgttagaccacggacatacctatttgtttacatattgtctatggctgctttctcactacaatagtatattagggtagttgccctggagatcttatggcctgcagagccaaaaatatttactctctggccttttacagaaaagtttactgacttcttatatagagaggcctggcaacttctacctgaattcattcagtgacagtatttcactctctctcaaagcattcagcttatagttagtttctatttatcttgagcaaaacttttttaagaaaccttccttgtacacatgatagacttttaggaatttgaaaacaattttttttttatggtccttttgtgcttttaataaccataatattgatttcacaaaattttatcctctccttaaaaagttggtaagaacgtaccctctaaaaatggtagccctttaaaatatgccttacatagtataaaagaattatccaactcttcaggtgtctctctttccccctttttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgataaaaacaatttttatacttcttatctctttctagtagtctacatcccattcccagtctttccaatcataaaaatttgtagtttatttagttcacacttgaacgtcctatgaaactgttttaaaccttttacctatcttgtttcttgtcattattcttaagccattgatacagaaatcagaaccaaatttaatattgttgtgggtatgagacagtttctgtcatgttttaattttttccttaaagttttactatgtacttcatatatactgggcactcaactgtgttattattactttaaatatgtgctaagtggcattattttttaaacagtgatatcacattaaaggttcttaatgagctcaaactcaaaaaccactacgtctttttacatatcttgctattaaatcagatcttcaccatcctacgctgaacccatggcaggactttttactcctttgagattctattgtattaggtttattccactgtgtcagtatgttgagaagttttagcatcttgattctgttatttaaatatttactgttcttcatagctctttgtcatgtgagaatttgatagcaatgagttactcgatcaacatcttgctatgtttgtgtggtcgttattgaatccaagtgaaattgttctgggaatttttcttagagtttatggtagattgaattattgctcagcaaatattcattccccaccctttctcttgaggtgaactatacatacatccctgtcttactgattttagacttggtcatacggcttgcttggactagtagaatggagatggaattgactgtaaagccatttctaaaatgaggctttaagaggcatggcaagttatttccagctttttcgtacttccggcacttactgtaagaagaacttgccccaggtaactacttcagatggggtcccagaatgaaagatatgtgaaggatacctgaacttgaccctgcaacctgaagcagagatgctctagccaacctgcagattcatgagcagaagttagcatttattgttttaatccatttccactttttgagttgttacagagtattgattcagcaatagctggtccatacacagctaaccaagccattctgttttgcaggaattatctctgaaatgcctagtacctgtaaataacaagccagtactagactatcatgaaccttggcttaagggagatcagaggtaacttttgggtcccatatgtgtgtcggtacatggcatgagctgagggatgccgctgaagaaaggaactacagttggctaaacaggatatacagaaatatcctgctgctctagctatgcctcaaatgctttgggtcagatttttactttttgcagtttgatatgctaacattgtcaagtttttctattactttctgttctgttttcttgttcctcctgtattttttttttaacttcctgcctttttagaaataactcatgttttcacagtatgtactacttaaagaaacaatatagaataagaccattagagttctaattatggctccaccatttgttaacataatcactctacataaattacttaagccatttccccctctgcatattgggattaataaataactcacagttgttgctaagcttaaatgagataacaaagtcattagctcaccatcatttgtatatacagtcattagcaaatatttactgagtaaattctgagggatacagtgctttgcacattataaaaaagtcaatacattttatagcattttgatagtcctagacctagaaagtacttgttggggtcacattgatgccaaatgaaaggaaaagagaagggggttctaatcccatttctgaaagaaagagcataaatatttgccgttagaaatcatggaacagtttttagatgtgttttatgttatttgataggttaatactttatttcaggatttctttttgcattatccttggcagtggctaggtactgtcaatgaccagtattttttgttctatctggggatgtgaatccaaaacaaaggatagaattgcttgtgctctgtttttctctcagttaattttttcaaaatataatcccaagtacaaatcatgcttttgagtattataggggatcatatttttttcttataaccttgaataagatgcagtaaaaacagtgaagctgaccacttttcttccctatcatttaggtatgtagcttctaccagatattttgacatcctgtttcataagaatctttttctttaattaaaaaaaaaatggtagttttaacaattcaaataatatgggtggtacatgaaatatttgcctttttttttcaaatttacagtcatgtttggtataaatcttttccttttatgtgtactcatttaatatgtagtttttcctttataaaaaagtagaattatattcacatttattctgcatcttgtcttttatatttaatagtattttttatcattgataaaaatatcattgatattttcccaaagtgaatacagaaagacctcattttattgacagcatcatagttcgtattgtggatataaattatttaacatccacatattttgatctacatcctattgatttaagttgtttaaagcaatactgtgactgggcatggtagcttacgattgtaatctcaagattttgggaggcagaggtaggaggatcgtttttggccaggagttcaagaccagcctgggcaacatggtgaaatccctgtcttaatcaatcaatcaataaacaaacaaatacacatactacaataaatgtacttatttatcttgttatacttgtgcttttattttagcagttctgaaaatggcttccttgtaagcgaagtctatctatatttaaaattttaatagatattagtaggtaaaaacatttttaaaaacttgattactaataaaaatttaaaatgctacaccaatttatatttctaccaataatttatagtaatgtggtgcatcctatcttaccaggagtggatgctgccagtcattaaatttttgccatcctgggccaaaaatgatatctaattttgtttcctttctatgaaaattggtattcagacatattccaatgtttgtagctatttacaatgcattcttgctgtattggccattcatatcttttttattattaattgttttctttttaaaatcagttcataaggcttttcaaaaattcttacagaggctggggatggtggcttgcacctgtaatcccagtgctttgggaggccaaggtgggagaattgcttgagcacaggaattcgattgtagcctgggcaagatggcaagacccctgtctttacaaaacattaaaaaatcagcatggcatcatggtgtgtgtctttagtcccagctacttcagaggctgaggccacagtatcccttgagtccagtaattcgaagtggcagtgagctatgatcctgccactgcacttcagcctaggtgacaaaatgagaccctgtctctaaaaaaaaaaaaaaaaaaattactgaaattattgtagaaatataagcaagagatgttttttgctttccttccatttttttttcttttattattatactttaagttttagggtacatgtgcacattgtgcaggttagttacatatgtatacatgtgccatgctggtggctgcacccactaactcatcatctagcattaggtatatctcccaatgctatccctccccgctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccattctatcattgttggacatctgggttggttccaagtctctgctatggtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttaatttgcatttctctgatggccagtgatgatgagcattttttcatgtgttttttggctgcataaatgtcttcttttgagaagtgtctgttcatgacctttgcccacttttaccccattctttttttttttttttgagatggagtcttgctctgtcgcccaggctggagtgcagtggagcgatctcggctcactgcaacctccgcctcccaggttcaagtgattctcttgcctcagcctgctgagtaaccaggattacaggcacgtgtcaccacacccggctaattttttgtatttttagtagagatggggtttcactgtgttagtcaggatggtctcgatctcctgacctcgtgatccacctgcctcggcctcccaaagtactgggattacaggcgtgagccactgtgcccagccccatccttagtgttagatgatttttatataacatgctagaatgttaaattattgcatgtactatgtgcactgttttctatatagtatttacccagcatttgcctaattttaatgttgtatctagcacatgtatgcttaatctcttaaggacagagtttgaattctattattgtagattaatagaattaagatttatgagtgacttttttaagggactggggtctcactctgtcacccaggctggagtgcaatggcatgatcatagctcgctgcagcctcaaactcctgggcacaagtgatctcacttcagcctcctgagtagctaggactataggtgtgtgccaccatgcccatctaatttttaaattttgtgtagagatagagggcctcactgtgttgcccaggctggtctcaaactcctgggctcaagcgatactcctaccttggcttcccaaagcattgggattacagatataagacaccacactcagcctctgactttggaaatattcataagtttttttttaattgaggaattcagcgttaataagtgaggcaataatcatagaattttacagttcagtttaagagtaaaatgtatctattaaaatggtctctttgtttgatttatacaaaggtgacatatagtagcaggccttggatgtatcagtggtaacaaatttggaatccgttgtaaatataggatctcactggtaaatatactgtgttcatttggataggctaattgtttaaccaacaactcccaaatcactgaggcttataaaaagaaatttatttctcactcacctaatagtttgttgccaaaattggtgaatggccttccaagggatgatgattcaatgatccaggctcctttaatcttgaggttcctagatcctttagtccaggctcctttgatcttgagatttctagatcctttagggcctcaagtcctcaatggatcctctacatctagctagcagagaggaaggaaaaaaaagatggtacgtggaggttatggtggatcagaactgaatgtaacacatatcatatctcttaatatttccttggccaaaactcagtcacatagtcacatctaattttaaaggaggctggaaaatttcttctatgtatatgccttggaaaagaggagaatggggatactggtaaagcaagctatctctgacatatatttaatttaaaagtaccaaaatgggtttctaaatctgaatatattttatctatactgtgtacattgggtcagtttttaaagacaacaataaaagttgtatgtaatttaactgattaattcctttaattacacaaatagttggtggatctgcttaccaaaatggaaaagaacaattaagcaaatagaaaatttaaattatacattacttgacaggttgcccagaaaagtggataggatgataaatacttgcttatggaaactgataatatttatcttcactacttgaccgagccttttagtgatttaatctgtgatgaagagaagtaaaaattccttcatgataaaatctctcaacagactgggcatagaaagaacatacctcagcaaaataaaggctatgtatgacagacgcacagctaacatcatactgaatagggaaaggctgaaagcctttcctttaagaagtggagtaagacaaggatgcccactttcaccactcctattcagcgttgtggcagaagttctagccagagcatcagtcaagagaaagaaattcaaggcatctaaataggaaaagagaaagtcaaattgtccttctttgcagatgacatgacctcatatatagaaaagcctaaagattccaacaaaaaactctttgaactgaaaaatgaattcagtagaattgcaggatacaaaatcaccatacaaaaatcagtagcatttctatataccaataatgaactagcagaaaaagaaatcaagaaagcctcaaatttataatagctagaaaaaagtaaaattcctaggaataaatttaaccaaggagatgaaagacctacaacaaaaaaccgcaaaacactgatgaaaaaaattaaagagaacacacaaaatggaaaggtatctcatgcttatggactggaagaatgaacattgttaacatgaccattctacccaaagcaatcaacagattcaatgcagtctctatcaagatactagtgacattcttcatagaaatagaaaaaacaattctaaaaattgtatggaaccgcagaagacctcaatagccaaagcaatcctgagcaaaaggaacaaagctggaatcgtcacagtacctgacttcaaaatattctacaaagctattgtaaccaaaacagcatggtattgatataaatacagacacatagaacaatgggatggattaagtaacctagaaataaactcacatattttactgccaactgatttttgacaaaggtgccaataacttatattggggaaaggataccatctttaataaatgctactgggaaagctgaatatccatatgcggaagaatgacccctgtctttcaccagagtttaaaaataatctcagccgggtgcagtggcgcatgcctgtagtcccaacactgggaggctgaggtgggtggatcacctgaagtcaggagttgaagaccagcctggccaacacagtgaaaccctgtctctactaaaaataaaaaaattagctgggtgtgatggtgggcacctgtaatcccagctacttgggaggtcaaggcaggagaatcacttgaacccaggaagcagaggttgcagtgagctgagatcgcgccactgcactccaacctgggtgacgagtgagactctgtctcaaaaacataaataaataataataatctcaaagtggattagacttaaacctaggacccaaaactataaaactactgacataaaacatagaggaaatactccaggacattggcctaggcaaaaattttatggctaaaacctcacaaaccaaacacaaaactgtgaacaaaccaaaacacaaaattgaaaaataggactatattaaattaaaaagcttctgcacatcaaagaaacagtcaacatagtgaagagacaacctgtagaatgggagaaggtatttgcaagtattcgtttaataaaggactaatatccagaatatataagaaactcaactcagtagcaaacaaacaaacaaaaaaactccataaattatcccattaacaagttgggaaaggatatgaatagacatttctcaaaaaaagacatatacatggccagtaggtatatgaaaaaatgctcagcatcactaatcatcagggaaatgaaaatcaaaaccacaatgagatatcatcttacctcagtcagaatggtgattattaaaaagaacaacaacaaaaaactgttggcaaggatgcagataaaaggtaactcttatacattgttggtaggaatgtaaattagtatagctactatggaaaacagtatggaagtttctcaaaaaactaaaaatagaactaccgtatgatccagcaatctcattactggatatttatccaaagaaaggaaatcagtatatcgaagggatatctgcacccccaagtttgttgcagcactattcatagtagccaagttatggaatcaacctacgtgtccatcaacagatgaatggataaagaaaatatggtttatatacacaatggaatactatttagccataaaaaagaatgaaattctgtcatttatagcaacatggatggaactggaggtcattatgttaagcgaaataagccaggcacagaaagacaaatatcacatgttctcactcactgatatgtgggagctaaaaaagttgctgtcatggagattgagagtagaatgatagttaccaaagaggggggggagcagtttgtgggaaggttgaagggaagattggttaatgggtacaaatatacagttaaatagaaggaatacgttttagtattttatagcacagtcggattagtgtaatcaacaacaatatgtctttcaaaataattagaatacatgatttgaaatatttccaacatgaagaaatgataaatgtttgagatgataaatatcctaaataccttgatttgatcattacatattgaatatgtgtatcaaaatatcatgtgtgccccttaaatgtgtacaattattatgtaacaaaaaattgtaaaaccgaaagtttgttcatttctttatatatcttattgacaagggaaggtatcaccaacagaatggacttgatattgataagaggtagatctgctcaacaagacttgggaaggaggatggaataaactgtatggtgtttgagaaatatacaccagacacatacaaatgtgtatctgtgtgtatgtgtttatacatctcacatgtattgtaatagtgcccttaatgaaaacactctgcctctggcaaaaaacaaaaaacaaaacacccctctttttgtttttccacatgactgcgaaacaattacagcttctagtaggagggcttctcctgttcctgggaaaagagctgggttggttggcatttgcataatcgtctttggggccattgtgggtgggtttgggctgctgacacagagctgcagactggccacctgtccaaaacaaatgaactcagcctttgtgtaacattatctggttatccacagtgttatttctgagtaatggataatttggttaaaataatatgaaactattatttaggaaacattgtgttcaacgtaagtcctccattttgctgggagaaaaattttcttctttttccactggcacaactatgtatttccatatcatctttggtatagttttataactgcttttgtgatatcctcatgaatattaattagggatatgaaaatttaaaaagaaacttcaaaatgatttgcattcgttattctataaattataaattaattgttgtctttttctagcagtctgttttacttatgtggaataattaaacacttaaagtcatcaaaaaagaagacacatctaagatcttgatgtaagaacaagtcctgcatcattcgttatccttgataatgaatccagtgactcacctgtgaatttaggaagtttttgtcctaataatgcatatattgctgtgttgagtaattttattaatcagctacatttaacctataatgaatacatacttacacatttttaaaattcacctgtgacaaacttacatgtgacatattaatatttcttttctttctttctttttttttttggagacggagtctctctctgttgcccaggctggaatgcattggcatgtctcggctcactgctacctccatctcccgggttcaagcgagtctctcacctctgcctctggagtagctaggactacaggcacgccccaccatgcccagctaattttcgtatttttagtagagatgggatttcaccattttgtctaggctggtctccaactcctgacctcaagtgatccgcccacctctgcttcccaaagtgctgggcttacaggtgtgagcactgcaccctgcagaaagttaggttctgttatggaggtaggtttatgaggaatcctaaaggaattgcttactcccagtgagacagtcttgaactagactcttaggaatagataggatttggaatacacggatattccagtttgaaactggttgcagataaaaataaacagtgattctgcaattattatggagacttaagtaatattagaaagaagtaaggagatacacttggaagatactaagttgatacaacttgatagaagattatgaatactaggctgggggtcattacagaagtcaagccaaaaaaatgtactggaaaaagaacactaaagtgggaggcatgtcataatttatatggatattggccttattacttggtgacagatcttttttttcaacttttattttagaatcaggggaatacatgtacaggtttgttacaaaaatatattgcatgatgccgaggtttggagtatgaatgaatctatcacccaggtagtgagcatgcctaattattttttcaacccttgcccctgcctcactccctgctcttggattccctagtgtttattattcccatgtttatgtccatttgtattcaatgtttagctcccacttagatatgagaacatgtggtatttggttttctgtttctgtgttagtttgcttaggataatcgttgccagctacattcatgttgctacaaaggacaagatttcattcttttcatggctgcatagtatccacgctgtatatgtaccacaggtgcccatcagtggtgagtgatcttgagtcactgcccatttttcttgatctgagaggattcgactggataaattataaggtccctttaagaatcaatcagtcatcagaatttcttttcctttttttttttttttcttaaagagacagggtcttactctgtcacccaggctggagtgcagtggcacaatcatagctcactgcagcttcaaactcctgggctcaagcgatcttcccatttcagcctcctgagtagttgagactagaggcatgcactaccacgcccagttaatttttaaattttttaatagagacagatctccttgttgcctaggcttggcttgaactcctggcctcaagcaatcttcccacctcgtcataagaattttttagtgatagatggttttgtttttaatatttcagctggaaaactattttagcatctagcagaagacttgtttgtggaaaaagcttgacttggtgaatcttttcatcagagtaatccctatgtttcacatatttcatataaaaataaaataagtttcccactctttagtgtgaaattggtgagggattggatataaaaggttatgctctggatatcccagagaactgccttcttcttttcctaaagttgtccactatgtttgaggttctgctctatgcataacaagtgtgattgcttttggagggttacaaggtaatgaggactcctatattcagaatgtaaaacccatttgacaaagtaagataggtatgcataaaagttacaaatatatactatcaatagggctatatctgacttatatgattaaatggccacattcataacataatcagtatgggccctaagtttttaggaaaacatggtaagtgggattagaatatctaaagacgacaagaatattgtgtggatatggagaaagaatgcattctataccagagaaaggctgctatcaaaaactcagaggcaaaaaataattttgggcataattatgagatagtaaaaagatcagtagttgccagaagttgaggatgaaggggaagggacaaatagcagagcacaggggatttttagggcagtgaaaataactccctatgatactgtaatgatggatatgtcactatatgtttgtccagacacatagactgtacagcactaagaatcctagtgtaaaccatggacttcagatgactgtgttatgtgtcagtgtaggttcatccattgtaaatgtaccactgtggtgggggatgttgttaatggggaggctatgcatgtgtgggggcaagtgatacatgggaactctctgtacctttctctcaattttgccatgaacctaaaactgttctaaaaaatatgaagtctgtaatttttaaaaaatgtgagtatcaagagaagaatataatagaattctataaatatcttccaggtgatgaatatgctcaaagtcatatgctcttgaattgatatcagtatttggcagtccctatctgtgtgaagacatttgcaaagatgaaatatttaaaatctaattacagatccgcgttaacagatgaacgtttgtaatggattttgatggtagggaacactaactttgaatttcaattaagcagaatatgtgtattacagaaaattgtactcagtttttaaaattttatcaataaaaagtttgaggaaaaaattatgagtgaacacaatatttgtggaggaagacttcttgagggttgaaatgttagtaccttgtatatagtagaagttaggctttgttacacggatgaataaatacacaaataaaattacctattactcattggactcagtaagatacccaaagtagaactaaaatttatagacttgattctacatttaataatgacattgaaagtttttaatcacagtaatcatgattataatttatcagggacttgcagtatgctagtcattgtactcatcattaaatttaggtttcattattatgcccattttacagttgaggaaactaaagctcaaagtgactaatgaaattattttcagtgtcaatttataaataaatagtagagcttggatttgaacccacatttatttgactccaaagaccgatataacgttgtgaaatattgtacaaaatagtgattatgaagcttgggttttttttttttgtcttttatttcctatacttctttggttgtttcttacccttcacacatttcaaaattattatgttggctccaatactttaatgtttctaattgtatatttttcttcctttaaaacctgcccacaggtcaactccactgggaagcttggaagtcaaatgacccatgttctaatcccagttttactactggttcactttgagccctgtccaagccagtctactcttagcctttagttttttcaactaaaagtaagaagtttgcttaaatatttgatcattcttgttttaacaacattaataaaaactgggcgaggagtggtggctcacgcttgtaatcccagcactttgggaggctgaggtaggcggatcacaaggtcaagagattgagaccatcttggccaacatggtgaaaccctgtctctattaaaaatacaaaaattagctgggtgtggtggtgcacgcctgtagtctcagctactcgggaggctgaggcaggagaattgcttgaatctgggaggcagaggttgcagtgagccaagatcgcgccactgtactccagcctggtgacagagcgagactccatctcaaataaataaataaataaataaataaataaataaataaataaaaactgaacatttcagtactgttcagtacttaaaatagcatttggcatattgtagaaaattctcagtaagtacttattgaatagatgaaggtattaagcacttaatgtatgccatacattgggccaagtgctttataaacactgactcatttgcttagcaacaatgaagtaggtactataactatctttatttctgagatgaggacatccaagataaaaacaagttaatggccaggcgcagtggctcatgcctgtaatcccagcacttcgggaggccaaaggtgggtggattgcttgagcttaggagttcgagaacagccgggcaacatgatgagacccccgtctctacaaaaaatacaagccaggagtagtggtgcgtgcctgtagtgccagctactctcttgagcctggtgggtgtggaggttgcaagtgagccaagatcgcgccactgcgctccaacctgggtgacagagcgagaccttgtcttagtacgtacatacatacatacatacatacatacatacatacatacatacatacatacataaaaataaaaactaaaaacaagttaaataacttgtcaaggtccaggagttaaacctgagaatgtgtgtctgtgctcttaaccagtatactagttgttcccaatagtggctgcatatcagaatcacctgtgaagtttgttaaactatcagtgtctcagccccacctctagagtctgactcagcaggtgacatttatcctatagtactttagctgcctgtggagtgacctttttaaaggtactactttgcacccagaggattttcagttgtgttgttgacagacagattgacagtcttggttcttttgacttttagtccttctataatttattttcttttgctgcttcgaagttctggtcaaaattcacctgatccttaataagtaaattgcaatgctctatttacttttactttaaaatttgcaggtcattttgtgcaaataagtttattgaagttgaaaaaaattgggaaacttcaacaatgtaggcgatgtagtatcaagagttaaagcttactttgactgactttttctttactatgagtataaatttgctgagttctgagtattgtgttttattgatgtggttcctaacttgagatgttttcacaagagtggaaactttgatctctatttccttggtacaggctcagcctctggtaccgaattttaacattagtaacagtttctggtgtgtaatcatttgtgttttaggttagacagctggaaattgcttctttcaggaagaggaacgtttttgcatgtttgtgtgctaccaaagtcaaatcagacaggctacatgagaatttctagcttcatgttttgaagtaggtgtgagcacttggtcttaaaaggcttttaaaaaattccactttaacgtatctgtaaatatatttaaagaaaaaccttaaaggggagggagagcattaggacaaatacctaatgcatgtagggcttaaaacctagatgatgggtggatgggtgcagcaaaccaccacggcacatgtatacatatgtaacaaacctccacattctgcacatgtatcccagaacttaaagtataataaaaataattttttaaaaaagaaaaactttagaaagaaaaaagcaactcttaaaaaaagatgatatatttgctatcggtattaaaattgtctattatattttcatgatttctattcgtaataacatgataaataaaatttctttaaaacaacattattgaatgtttctgtgtcataagcgttgtttaccatcatgtttcaacttcaagtcacgtcatcaaataggtaaatacagtatactagttgttaactgggatgtgggaaaaaacctacttaacctagttagcttggtgtcttatccaagaatactcataactaattcacagcaaaggcagtacagtactcaaactcaagtgttgacttcaaagtcctggtctttttactattgccaataaccataaattatataaatttgtatagaattccatagtttgagtatttaattaacatagttttatcctggtttgggagtgtggatatgcttgtagttgcttcatatcttttaatgttagaggaatattcttgtggaagatgtcttgtgtagcgccctataattcctccatttctgtgctacatctagtagatctaaaatgtgaggggtcagagtatgtttataagcggagaccttagagattacctgtttctgtctcttctgttcataattctaaaattctttgcactaaaacttgtcccatttacatctctttgcctccatactgtgcatatcatctttggacaggactagagtggtagcctcctatgggtctccctgactgtagtctaactactttttttttttttttgagtcggaatctcgctctgttgcccaggctggagtgcagtggcgcgatctcagctcactgcaacctccgcctcccgggtttatgccattctcctgcctcagcctcccgagtagctggaactacaggtgcccgccaccatgcccagctaattttttatatttttagtagagacggggtttcaccatgttagccaggatggtctcgatctcctgacctcatgatccgcatgcctcagccccccaaagtgctgggattacaggtgtgagccaccgcacccggccaatctaagtactcttaatccatgtttcccacactgcagctagaatgatttttaaatcacattttagtctgataatggcactgcactgctcgcaagcttgatttcctgttgtcttaaggtagtccaaacataaatccttgtgtgatatagcccttacttattcagtctcacctttaagccattctcccttttacaagctccatgccagcttgtatgaagtttcttgaaggggctatgttcccacttgcaccccacctctcgttacaggctctttttttttagatgtcaattttcatttcctttggggaagccttccctgactcgatctctctgctttatgttcccatatactttcctgttgtaatacctacaccaaatggtgacttcttgagtttttcctctttgttgtgctttttttttttcagttaggaaggtaataaacatttgctttaaaaatactgagcaattaagtgatagaaataggccaagcatggtggctcacacctgtaatcctagcaccttgggatgccaagtcgggagaatcacttaaggccaggagtttgagaccaaccttggcaataaagtgagaccctgtctctataaaaaaattaaaaaaattaaccaggcaatgcacacctgtaatattagtttcttgggaagccgaggtgggaagatcgcttaagcccaggtatttgaggctgcagtgaacaatgattgtgctgttgtactccagcccgggcaacagagtgagaccccatctcttaaaataaaaaaacattgaacaatccagtggtataaagaataaaaactaaaagctcttacttttgaacctcatttccaagttcatatgtattctagagtatatatgcttacatgttttttaaattaaaataggaccgtgctattcatttttctgcagcttatatatttttattaaatatttgagactatatagcacattctctttaataattgtgtaacattgcagcatactgatgaccataatttagttaatagttcctcttggtggatattaattttttaaattaatccctggcagaatatacataccagaagaacattgataatacccataatgtttattgctattcccccagcatctaatacagtgccttccctatagaaagcacttaataaaacttgttaagcaatgcatatgccttttccaggcgaaaaggctgctgtgccagctcttacctgatttgtgttggttacctgtaatgtatcagttcatatcaatggtgagaaatagaataacgggagtgtggactggccttggagtcagaaggcttgggttggattcctgggtataagcagtgttggttaatatggtcctttgttggtcagattctaataggatacttactacattcagtttaagtgaagatcgaacaacataatgcatatacaaatactttgtaagtgtaacacccagtacaaatgttggcattactgtctccctccccgttcctggtaaccactgctttattctctctctgtctctctttttttttcggagacagggtcttgttctgtcacccaggctggagtgcagtagtcacaactcaatgcagcctccacctcccgccctcaagtgatcctcccacctcagcctcccgagtagctgggactacaggcacacaccaccacaccaggctaatttttataatttttgatagagacagggtttcgttatgttgcccaggctggtctcaaacttggctctagcaatccacctgcctcagcctcctaaagtgctagaattacagatgtgagccaccgtgcccggcctttattctctatttattcaagtttttttatttttttagattccatatataacagatcaaatagtagtcgtcttctttctatctggcttatttcacttaacatattctggatgaacccatccagattcatacatgttgtgacaaatagcaggatctcccttttttttaaggctgaatagtatttctggaggtgtgcgtcaatgtgtgtgtgtatgtgtatgtgtatactacagtttcttaggtcaaaggataaaaaatagcagaaattcaggacgcgcaagtatagagatataatgtgtatcatgaggactatagttaataatattgtattcaggattttttgctgaaagagtaggctttaggtgctctaggcacacatacacaaaaagggataacaatgtgaaatgatggatatattaaatttgcttgactgtggtaaccatttcactatcaatatgtatagcaaaatttcatgttgtacgtcttaaatatatacagtattttttaaatgtcagtactattaatatatttttctttgttggttttgtggattgatttgtagctccaatgaggtttttaaatagattaaagtattgaccaccaccatctttacaaagttaaggtcatcaggtaagagaccttatacaatgcccaggaagccgtaacagtattcttgaatgttactctgtgtttagggctctggagacatatacaatccatccctattgcctttcctggttggcgtaaaaactatatactcacttggatacatttatgtatggtaaattgagttttgtatattcagttgtgaaaatatctccttttgttttttttatttagtataatctctctattgcatcatctcttgaagaacaagacaggaactttctcttatacatacttctagaatctatgctagtacctagcagaagtgcacatcttccgataagtgtcttgacttttggacaagatactgtgattacccacacacgcatacatatacataggaactaagcaatcagttgtgggttatgtggggttgtgggggtactgctatcatgtagcagttttataactgtaggcaaaaatattttcaaactaatggcattcccttgggtatttcttacctatttctttgtatgctttgtgatttttgttgttgttgttgttgttgttaaaaactggccatttgaatctaataaggtggtgactctggacatcagattctccctctttctgaggttttgctagtttgtttttgtttttgtttttcttttgtttttgattaacataagtagtctccatgctgaggatcagcctgagatgtaaacttaaggtcttctcaggaattttctgagcctgtgcctttctctgtatattgtggtgacttactaatttctctcaaatatgcaattgcccttcaatgtcctaattttcaatgtgtggttctcaaaaggtgggaaaatgaagacagggaaaaaggacgctgtccctttaagttccccggaagtcacttcagcctaagggggaagggcttgtagcaatagggaaagggtgctgcaatgacttcctacctctgtgtctgcacctccacaatcataagcagcagtcagtgatcatagcacaagatagggtcccatttgcccatcctggctcccataaggagcataggagttgttccaggaacatatgcatggctgcctgccaatgggccagggataaagatgggtagccacagctgagctaagagctgaaattgacctaaattaactgtaatttactctccaaatctttctctgggagttgcaagtccacagtggcttctagaattctaaaataattgcatcaaaccgatcttgccgcagtgtgattgttgtctaggttgggagacaagattcctggtcctttctgctctgccttattctcagaatttgctcctacaatagtcttgtaagtggtttccgtatcttttgttttcccccaaagttgtttcctacatagctgtgaaaatgaccttttaaaaatgcaaattgatttttatctccttatttaaaaggttttcaatggcattttatcgtttttagtgtactacaccattatatttatggtgccctttctggtcttcatagtttgtctcttgactaactttctactttcattgctgtatgtcatgcttcctgtgttagtccgttttcacactgctatgaagaactacctgagactgggtaatttataaagaaaagaggtttcatggactcacagtttcacgtggcttgggagccttcaggaaacttatggcagaaggcaaaggggaagcaaggcatctcttacatggtggcaggagagacggagagaacgaaaggggaagtgctaaacttttaaaccatcagctctcatgagaactcactatcatgagaccagcatgaggaaaatctgccctcatgatccaatctcctcccaccaggtttttcccctgacacatggggattacaattccagttgagaattgggtggggacacagagccaaaccatatcattccacccctggcccacccaaatctcatgtccttctcacatttcaaaacacaatcatgccgtctcaacagtccaccaaagtcttaactcatgccaacattatcccaaaagtccaaggccaaagtctcatctgagacaaggaagtcccttctgcctgtgagcctgtaaaatcaaaagcaagttagttacttccaagatacaatgggggtacaggcatttgataaatgctgccattcaaaatgggggaaattggccaaaacaatggggctacaggccccatgcaagtctgaaacgtaacagggcagttattaaatagtaaaagctccaaaataatctcctttgactccatgtctcacatccagggcacgctgttgcaagatgtgggctcccaaggccttaagcatctctgtccttgtggctctgcagggtacagcacctgcagctactttcacaggctgccattgagtgcctgcggcttttccaggtacatggtgtgaggttttctgggatctggaggatggtggctctcttctcacccctccagtaggcagtgcccctgtgagcattctgtgtgggggctccaaccccacatttcccctctgtagtgccctagaagaggttctccatgagggctctgcccctgcagcagacttctgcctggacatccaggtgtttccatacattctctgaaatctaggcagaggtttccaaacatcagttcttatcttctgcacaactacaggcccaataccatgtggaagccaccaaggtttggggcttgcaccctctgaagcaacagctcgagctgtaccttggccccttttagccacggctggagctggagcagctggggtgcagggcaccgtgtcccaaggctgcacagagcagcacagccctggtcctgggctacaaaaccatttttccttcctaggcctcctgggcctgtgatggcggggagtgcagcgaacatctctgaaatgccctggagacattttcttcattgttttggctattaacatttggcttctttttactcatgcaaatttctgcagccagcttgaatttctcttcagaaaattggtttttcttttctacctcatggtcaggctgcaaatttttcaaacttttacactctacttcccttttaaacataagttccaattttagaccatctctttatgactggatatgactgtatgctttcagaaaaagccaggttacattttgaatgctttgctgcttagaaatttcttctgccagataccctaaatcatctctctcaagttcaaagttccagagatctctagggcaggggcaaaatgctgccagtctctctgttaaagcatagcaagagtgacctttgctctagttctcaataagttcctcttctccctctgagacctactcagcctggatttcattgcccatatcactatcagtgatcaatggttttggtcaaaaccattcaacaggtctctaggaagttccaaactttccgacatcctcctctcttcttctgagccctccaaactgttccaacctctgcctgctacccagttccaaggtcacttccacattttcaggtatttttatagaaatacgccatgtctctcggtaccaattttctgtattactccatttccacactgctataaagaactagctgagactgggtaatttatcaaggaagaggtttaattgactcacaggtctgcatggttggggagccttcaggaaacttaaaatcatggtagaaggcaaagggaaagcaaggcatgtcttacatggtcgcaggagagagagcgagcaaagggggaagtgccaaacttttaaaccattagatctcatgagaactcacttgctgtcatgagaacagcatggggaaatctgcccctgtgatccaatcacctcctagcaggtccctcctctgacacatggggattacaattcaagatgagatttgggtggggatacagagccaaaccatatcacttcccttagacagttaactctcatttgtccttctgatctttaatcatatgtagttctcaattaagtctatttgaatatacaaaccacctccccctatctttaaagttttttagagcactgtatatctgttttatatattctacattatttttatactcggtttcttttattttaaaataaattttattgcatatatttaaggtatatgatatgatgttataagatatgatgtaaaatggtcactatagtggaacaaattagcatccattgtctcagtcagtcattttgctcccagtggcaagagcaactgtaattattcatttagcaaaatcctgaatccagtatactatgaactatagtcctcatacagaatatttcatttatctgtataggctgggtacggtggcttatgcctgtaaccctagcacttgggagcccaaggtaggtggactgcttgagcccaggaatttgagaccatcctggtcaacatggtgaaacctcatctgtatcaaaaacaaaataaaaaaatgagctgggtgcagtggcacacacctgtagtcccaactactctagagtctgagatgggaggatcaattgagcctgggaacagagtgagactctatgtcaaaatacatacatacatacatacatacatacatacatacatacatacataaaatgaatctctataattctttagtcaaaacatggagcatatctgtgttttttagtcaaaacgtggagcatatcagtaggtatatataccacacatacctactggtatatgtggatggttacgggagaccagaaggatgttactgagttggtacatcatacagcataacacattaagatttggtttttgactgaaatactatatagctttaaaaaaattcttagtcataaggatataccaatttagagatatagtttagtcacaagtatacagattataattctacaaactaattccaaggagatttaaaaaatttttaaaattctatttatttaatttttaaacttttattttaagttcaggggtacaagtgcaggtttgttacatagttaaacttgtgtcatcgggggttgtggtacagattattgcatcacccaggtattaagcctagtacccattagttatttttttctcattatctccctcctcccaccctccaccctccaaaaggcctcagtgcctgttgttcccctctatgtgtgcatgtgttctcatcatttagcttccacttataagtgagaatatgtggtatttggttttcttttcctgcattcgtttgcaaaggataatggcctccagctccatccatgttcctgcagaagacattatctcattctttctttgtggctgcatagtactccatggtatatatataccacattttctttatccagtctatcactgatgggcgtttaggttgattccatgtcttttctactgtgaatagtgttgcagtgaacatatgtgtgcatgtatctttataatagaatgatttatattcctttgggtatgtacccagtaatgggattgatggcttgaatggtatttctgtctttagttctttgaggaatcatgacagtcttccacaatgcctgagctaatttacacttccataaacagtgtataagcgttctttttctccacgaccttgccaacttctgttattttttgactttttaataatagccatttggactggtgttagatagtatctcattgtgattttgatttgcatttttctaatgatcagtgatattgagctttttttcatttgattgttggctgcatgtatgtctgtttttgaaaagcgtctgttcatgtcctttgcccatttcttaatgggattgttgtttttttccctgtaaacttgtttaatttccttatagatgctggatattagacctttgtgggatgcgtagtttgcagtattttctcccattcggtagggtgtctgtttactctgttgatagtttcttttgatgtgcagaagctcttcagtttaattagatcccatttgtcaatgcttgattttgttgcaattgcaacaaaatatatattgaacttgatgtctgtgactctaatttacccccatgtaattcattctcatttccccttcttatttctaagtcccactccaacactgagcttttaccctctgccatctgtttacatgtttgtttaatcccagtatatgtgtaccacttttcagaattttttacctgtgcctagtgagaaacaactttatcaactagtgtacaatgtttatatacagttttttgtctttagtcgtacagtttctagctaaaatacttttttccagagtttcttgaatccatttataaacacattattttacagaattataaaatttgccccttcattccccatacccatttatgaggttatgtctcacattttgtaatacaattggatttgtcacagtctgcattctatcttcggttcccccaaccactggtagattttttttaatttacgtatattaagagtcattctttgtctcttgtcaaagttctgtgggtattgtcaaagttctttgggttttgacaaatgtatagtgttgcagatccactactacaatactatgtatattagttcaccacccttaaaattcttcccctagcaaacacttccttctccccaaacccctcaaaatcactgatctgttttctctatcaattggtctttcccagaatgtcatatgaatggaataatacagtgtgtaacctttttaatttggcttctttgacttaacaaaatgcattttaagattcatccaagttatgtgaattaatagtttgtttcttttaattgctaagtactattccattataattatgtaccacagtttgtttatccattcacctactgaaggacatctttgttgccaagtttatcaataaagctgccagaagcatttgtgctcaggtttttttgtgaacctaagttttcaaatcagttggccaaatacctagaacatgattgtggaagtctctgttcataagaaatttcaaaactgtctttcaaagtggccatactattttgcattcccaccaccgttgaaggagtactctgtaactctgcgtcctcactagcatttcttgctgttaattttttggatttagcattctaatacatgtgtagtggtaccacattattttagtttgcatttccgtaatgacaagtgatgctgaacttcttttcatatgcttgtttgccattcttatatcttctttgatgaagtatcttttcagatcctttgcccattttaaaaatgtgttgatttttttcttactgttgaattttaggaattctttatatatttggacttcctttatcagatacatgatttgcaagtattttttcctaatctgcagcttgtctttttattctctttgtagtgtcttttccagaagaaagagtttaattctgataaggtccaatttatcatttttctttcatgtgtcttggttctggtgttatatgttaaaacttttcaccaaaggtcaaggagattttcttctctgttcttctaaatgtttcatagttttatgctttatattgaggtgtatgaatcattttgagccaatttttgtgtaactcgtgaggtatgtgtcaagggtttttgttgttttgttgttgtttatggtcattcaattgttctagcatcacttgttgattgagactatcctgtctccattgaattgtcattgcccctttgtgaaaaatcagtttactatatttgtatgggtctatttctgggatctctcttttgttccactgatctatctgtccattcttttgccaacatcatgctatcttgattcctgcagccttcaaggtataccttgaagtcaggtaatgagagtgctctgattttgttcttatttttctgaattttggctattctaatacctttatctttctggactattgattgagattgccttgaatgtatagatcatattgggaacaaataagaccttaacaatatgaagtcccaagtcattaacatggaatgtctctccatccatttagattcttttattcttttctttctttcattagtattatggacttttccacatacagatcctgcaaacattttgtgggatttatacctaagtacttcatttaataaaatttcaaattccagttgttcattgcatgtatgtaggagagcaattaactttggaatattgacgttgtattgtgcaactttgctaaactcagttattagttccatgaggttttttggtagattcttcagggtttcttacatagacaatcatgtcatctatgaataaagatagctttatttcttcctttcctatctgtatgccttttatttctttttcttgccttattgtactaagtagggcttccagtacaatgttgaaaagaagtgtaacagagaaaatctttgccttatctctatcttaagggaaaagcattcactcaccattaaaagtatggtgttaactttagttttatgtgtgtcgtttagttttggtttttattttttgctttttttctttgttgagacacagaatcactctgttgcccagactggagtgcagtggtgcagtcatggctcactgcagccttgacatcctgggctcaagtgatcctcccatctcattctcctctccctctcctgccatacacaaaagtagctaagaccacaggtgtgcaccaccaggcctggaaaattttttttattatttacagagacaggggtctccttgtgttgcctgggctcaagtgatcctcatgactccacctcccaaagtgttgggattacaggtgtgagccaccacgcccagccagttttttgtatatatccgttattaggttaaggacgtattcttctgcatctagtttttttagaattctgtcatgaatgagctttttttttaagttttattttaaatttgggtaacatgtacaggtttgttacataggtaaactcatgtcacaggggtttgttgtacagattatttcgttacccaggtattaagcctagtacccattaattatttttcctgatcctctccttccttctagcttccatcctccaaaaggccccagtgtctgttgttctcctctatgtgttcatgtgttctcatcatttagctcccatttataagtgagaacatatattatttagttttctgttcttgcattagtttgctaaggttaatagcctccagcgccatccacgcccctgcaaaggacatgatctcattgttttttatggctgcatagtattccatggtgtatacataccaaattttctttatccactttaccattgatggccatttaggtcgattccatgtctttgctattgctaatggggctgcagtgaacgtatgtgtgcctgtttttttttttttttattctatgtttgatctttaaatcaaataggatgggtcatttataatgtcagtagataggccagacacagtggcctgcacctttaatcccagccctttgggaggcagaggtgggagcattacttgaggccaggagttcagatcaacctgggcaacatagcgagaccccatctctacaaaaaattttaaaacttagctggtcgcagtggcatgcacctgcagtcccagctactctggaggctgagaggcaggaggatcacttgagcccaggagttcaagacttcagtgagctatgatcatgccactgccttccagcctgggtgacagagcaaggccctgtctcaatgtaaataaaatgtcaatagatcttatttcttatatatacttaatttaaataaaattaatctttatttttataaatgggaaaaggctaaaagatacctttagtttttaatatatagaacatattattatatgagattaatatttcatttcgtcatgaaattatggaaaagtaaataaagacaatttattatgtaatttaaaataatatactgtttttttaatcttacataatcatataccacacagaacaatgaagaatattttaaaactttcctttaggatgggagtgaaattctatattacttttaaagtgatttaagaatatagtaaaggtaataattgcataatttgcattagtttaagaaatatccagcttatgcagtgaacttgttcattgttaaaagatcacttgcataatgccgggaatttcatgacaaaatggtatagtatataaagaatatggtttccaaaaattttaaagagccatctaatggcaaacccttagtaaaatttaaatattagtttctctgtatgctgagggatgaaatggatacagaattacctgtgctagagccatagagcacccttctactcagcttgctgtaataaattggccaaaggttaagccatcagtccatttcctagtgtctactcaacagtggctctctttgtgtttcttcacttgttaaagcaatacagcaagtgttattgagaggtaaaacaaagcaagcctaacatcagacactgatggctttttaaaagttggaatcggatgttattgcatgtttcaaagagtatattgatagtacatctttatggaagccactgctctaaagtgaactgaattgcaaatcaaatcagcattatgcatcagtgatgcttaggtaaatataaataaatattatgtttagtggaccaattttagatagtagtgctgtgggcttggagaatgatttgaaaaaaatttttttaaaaactttaaaaaattgcaagacataggtttattttccttagcaaattaattaggctggattttgttttctatgtaagtaaaccttttattcatcaaatgtagctttaaatataaagtatagaggaaaccagttaatttaagcatagaatgctttcagaaatgtgcaatattatttaggacctttactgtaatagccccagagtatgtctgagcatccatgcagattagatcttgaacagctgcatggagtacacagaagtcatgattcctgcctctgtgaactaacttgaataaagtctttcatctaaagatctcattgtttgtctatttcatgaatccctcatctcatctctgaagggctcattcagtttaatacagtttagctttgtggtttagagctctagaaattgctattgtaatttataatgcacaaagttaacaaattaatttcataatttaaaaaaatagataaagtccactctaaaatgatttcttttacaaagacatggtaactttggattctagctcacacctaactagttacgaactgtatgatttgaagtaaagtatttatgcttttaatgtccaatttctctgtggtgataacaaagcctaacatagagttaagagaaataaacatgtgaaagtgcttaagttcatttgttcctacataaatttagagtgctgtcattctgctttctgtcttaatcctgctcatgaactgaggctcatctcatattctatgttctgtgtgatgtgttctgtaaacactttaacagtgattaaactgaaaaagtcactatcatgtcatttagatgtgatttgagaaaataccagatgatcttttcctcatttgggtacttatatcacattttgccacttgtttggcagtaacccatatgttgcctggcatattatgttgtatacttgttattcttctctacagataatgagttatttgaattctgagatcttgacttaattgaaccctcataaaaattaatgtgtagtgctttctaggtatggaataaacttctattatttttaaaaactgctttggaatacccacacatatttctcttaaaatagtgaagatggtcaaatttgactgtaattttaccaaggaatttattatattaaagccacctggtcataatctcagaaatctgatacagttattaaaaaatttgagtacatgaaaattaggaaccagagaagtttttattcaaagacttctaacacagaatggcaaaaacataaatggagatgggcactatacattagaaacagagtaatgtaggtggcatttatccatgcaatcagtggatcttatcggtatcaactaaattctaggtgatctgctatagccggggatataatgattaaaaaaaaaaaaaaaagacaagatctgtacctgatggagcttatagagtaaacagacaaatatttaaaccagacagtaacagtgtatgatgattatgcataaatagagttatgtgagagggccagaggcgaagatactttgcatacagtgattagaaaaggcgttttagaaaaagacacaaatagtaagacccaaagaatgagaacttgcctagattgtggtctctggtttctccctgaaaacaatcaggattccttggagaactagcttatttcaagtctgggccaggaactgtaaaacaacaataacagcaacaacaacaacaaagatgcattcagagtctatttgggatcatgatatgggagccaacttggaggggctctgacagaccacagatgtgacaatttgagcatcagaagaaagcaactttaattaattggaatgcatctattatttaaaatacatgagttcataatgttactttaaaaattcattgttcatctttggacccaaatattggacattcaaatatttatcctgtctttcctccaagaactgtatctcaatataaccagatagttcatgagggataattctttatagaattatagctaataaatatagaaagaatagctattatactttaatgaaatgaaaataagtacctaggcaatgacgcttttcacattttcctatatatatttgtgattgtttacgttaggaaatttaagtatcagattaaaagggaggggtgagaatttagcaagtaggaataggagtggttagaagatattttcatgcaatgggagcattatgaacaaggtgcagaggtgaaaaactaccgtacatatttagggaagacttagtatttggagctcccaaagtacaagatatgttaagtggaactgttacggatatgtagttctatacaagttctcagaatacacaatacttagaaatagtgaaaccaaattgttgccaagttcgggaggaacttgagattgaagctaatttgacagcagaccttaatagaaaggtaccatgtagagtgtagtgttgattttacttgagtaatttttgcctcaagcaggtagttgattaatagatgtgattgttcttcatttcagcattgtgttctttttagttacgtgtatagaaataagtatctcaatgttaatgatttctataaccattacattaggccctgttatagtgttaggggaccacatatattcctatccaaaagtaatacgttggccaggtttggtgactcatacttgtaatcccagaactttgggaggacaagggaggtggcttgcttgagcccaggagttgagccatgggcaacatggcgaaacactgtgtctactaaaaatacaaaaagttagctgggctcagtggcatgtgcctgtagtcccaggtacttgggaggctgagttgggaggattgtttgagcccaggaagttgaggctgcattgagccatgatcgcgccactgcactccagcctgggcattggaatgaggccttgtctcaaacaaacaaacgaacgaaaacaaacaagcaaaaaaacaaacataatacattgtataattggaatgagcagtttaaaatcaattcttaacaaaatggtcttctcaattcaaatccctgtacctctccctgacacctgttatagataaacattctgttttatccagatttgtgttgtgtagataatagtaagtgggcaaatttctttgtaaaacagtttattttgttgtttgaagtgacttgtgtcatggtatcatttaaaaagaaaagacccttaaaatctgtcttgagaattaataatatggaacagcaccaaaatttgttcattaattttacatgccagtatatatctgtctacttcaaattgaatttgtttttctctttcctggtatttgagagtttggctgccgagatttagaaagctgtgtgatcagagttctatggagatggacagctgtgttccctgtgacatgccagaggtggtttgtttttatggctagtcaaatagttaaaagtgaaaggcatatcaatgaagtttcaactttcttatccttatactcacccttttcctaaaaatggagacaagagaggactggacaataatgaaaaaaggttgtagtgttctaccatttatcattgttttttgtttgtttggttggttggttggttggttaattgggttttgtttttttttttttttgagacagagcctcactctgtcacccaggctggagtgctgaggcccagtctcggctcactgcagcctccgcctcctggattcaagtgattctcctgcctcagcctcccaagtagctgggactacaggcgcatgctaccacacccggctaatttttgtatttttggtagagatagattttcaccatgttggccaagctggtctcaaactcctgacctcaagtgatctgtctaccttggcctcccaaagtgccaggattataggtgtaagccaccacgtgcagcctatcattgttttttttcacttctgaattaaatttacatttggaaaaatgagattttctaagtcatgtattttaaggaaaagagcttcctttatggcataatatttattttagaaaaaatatgtattttttaacagggtatgcagaagttggctagtcaatacctgaagagagattggcctggagtaaaagctgatgatcggaatgattacaggtaaattagtagtttttgcctattttctttagaaacggttttacttaaagctatgttacatatagataatgtaacactctagtttttaaaagaattacttctttcctctgctgtgttttcggatataatttcaaaattatcaaaattttaatgttttataacattaaataatctaaaatagattgtaatctatataaaatagatcattttcatgtcttatataagccaagattatattttatataattaattatacccccaattgaaacttaaagaaggcaggtgacaatggaacacaaattgctgagtgacctatgatgaaacacattattgtgacggtgatgaaacaagattgtatatgttctgccatcttcactgatacttttgaaataaattctaaatatggaaagatggggtttttgtgagactaggggggaaactttctaatgtattgtaaggaaaggagcttctttttagcataatacttattttagaaaaatatatgtgtttgtatttttgaatataaacaaaagatttagacgtggctagttaatatcccacatacgaattgtaatgaaggtggatgagaatggaatacagattgtgtcctcagtgacctactgatatcttaaaagtatatgtttgtttagaatttggtttcttttggccaggggcagtggcttacgcctgtaatcccagcacttggggaggccaaggcaggtggatcacctgagatcaggagttcaagaccagcctgaccaacatggtgaaaccctgtctctactaaaaatataaaaattagccaggtgtggtggcgggcacctgtaatcgcagctacttaggaggctgaggcaggaggattgcttgaacctgggaggcagaggttgcattgagccgaaatcatgtcactgcactccagcctgggcgacagagtgagactccagctcaaaaaaaaaaagaatttgatttcttttttgaggtcaatttggaagtatttattatcttttacgctcaggagttgtcctttgtgttgaaggacccagaagtcagtgacctcagagcttgcagtctggttaggattatgaccaaatacccttcaaacaatagcagagaatccagggtaattgagaacttagtattgaagcgcatggtttagagtctgaatacgaaatcaagctgttgaattgtcagtgatgattgacatcagatgatttcttaagaatgtggcaatgaagctagaaaactgaaggatatatgataagaagccctaataattcttcacagtggcctactgatatcatggaaggtgtcttgagagcaataaataatagaacagtatgattgcaatagagcatattaaagcaaaacaggaaataaaaatattaatagattttcttcatgcctgtaatcctagcactttgggaggccgaggtggaaggatcacttgaggcaagtagttcaagactagactgggcagtatagtgatactccatctctacaaaaaaatacattagctgggtgtggtggtacgtgcatgtagtcccagctactcaggaggctaaggcaggacgatcgcttgagcccaggagttgaaggctgcagtgagctatgaatgcaccactaccctccagcctgggtgacagagtgagactctgtctcccaaaaaaaaaaaaaaaaaaaaaaagaaaccacacagattttcttaaggattttctgtatctgcaaaattcagctaaggaggaagagaggagagatgaaattctaggcaagagaggcaagtagaacaaaaccttgaggtgacagtgagcatgggatgttcagtgttgctggtataaggaaatcagcctaagaagaagattgcttgcagtaaagaaggatccaacttatagatagttaggctgggcatggtggctcatgcctgcaatcccagtgctttaggaggctaagatgggaggattgcttgaggccaggagttatattccaagtttatttaaaattcaggattcaggttaccaaagaaataaggattaaaaagctatgctcctaggctagcttataaaccctaatttaaaaaagtattgcaagccaagatatacaaaatatttactatgtggcagacactgtgctaagaactcatttcccatgattatcagaacagctctgtgaggtagatataataattctcattttatactataggaaaccaggtctcaggttatatgtcttactcaaggtcagatagctatttaaacacacatttattctttctttcttattcataggatacatatgaaatacctactacatgtcagcggttaaagtagaccttaggattagagaggctagaagatatgttgtctgtcctttgtaagcatacaggagatagccactataaatagttgcagaattgggtagtaggagaggggcactggagccatagaagaaaacctgggcttgtagagccaggtcttaaagaatgtgcaggagttttccaggcagacagtttggtaaaagaaattctaagtgaaaataaccccttccaggcatggagcatgagaaaatgtgactgttaggtaacagttcagtagggttgctgtgaagtatgtgggttagaggttaactggagtggtggagattaaggatacatcataggtaggcatcataaaaggactttacatatcacagtatagagtttgcttttttattcagaacgtaatggaggtgttgaaatgtttccatgagaggaatcatattatcatctttactttaatgatagtgtaaaggtggattcgaggggtgtgaggaagacttcagaaaggatagaatggcaggaatttaattcctcatcatctcatatttgaaccaaggaaattgtagcagaaatcaagttgtagggaagatttcagagatatttagaagacttaagccagaggacttgcaaatgatttggcagagttttgttttttgtgtttgtcaaatttgttctgagacaaattacatatataaacagttttcttcatatttaaaatagctcttgcaacattgaaagcacttgataaatatttactgactgaatgaatgaagcagggggagagagatgaagaattatacaatgactcccaggtgttttcatttaggcaactgagaggatggtggtgctattgtgaaaaagacaatagaaagatcaggattgaggctgagaacaattgccagtgtttttgtttatttggagcttattttagttttgttatttaaaattttccatttaactttttcgtatttatatttgcattggtagttttaaattcttatccaagtaatacatgttttttatcaagtaggtaaacagtacaggagtataaagaatatcatttcccaagcatcttccattcacatttctgctcccctagggtaattgctattacaagtgtgtggtcttttctttcacatttttttctgtgtgattcacacatgggcatacatagttttgttgtttctaacagaactgcaattattatatacatgcagtctgtaacacccttgctccccgcccacacacttaaggagtctattttagaaatcccttcatgtcagtatgttctggtccctcattctttttaatgcctgctttagtgccatagtattgatgaactatacttttgttatccacatccctatttgtagttatttagtttattagtatttcaaataatgcagtgaataagttctgtatgaacataagtatatttttgtacactgaaagtgtatctgtagggtaaattcttagagggagaaatgctggatcaaagggtttatatatttaaaatgttgatattggagggagggtcttcaaggtggctgactaggggcacttcgtacctcctccactaagaagaaccaaactagtgagtgaataatcacatgttgactagatcatccaagagaacactggaattcaacagaaaagtgacaggaaatacctaaagttaaaaaggaaagggaaacaaggtagcctgttcaggtgggattagtcaggagccaagagagacccccattggtccacattcccactgtagacttctgtagtgctggccatggaagagcccttcaaccttcctgggccttgaaactaagatagggagctgccaggagattgtgtgatggcactacaccaagaagggagctcatgctgggtcccacacacgctctgagaactaagcaactgcagcaaggcactattttagagccctgcccccaacagactgtgcactgtcctggggtccagcatcactagggctaaaccacaagagaagtgtgagctgctgcccttggggccaagctgtgggttaacactgttaggttagcagtgtaagtgctgctggggagcgagtggtgctggggcaagtattccccacctgctagcctaggtggtgcacatgttccccacctgctagcctaggcttccagctcagaaggtagccctcccttttccagtggcagggcagcagtgcagccactactgcctcccacctgagcattctgccagtggcctagggatcagcctgcccctgcctaccatggctggcacctgcacatattgttgagagcctgagggcaagccaccccagcctgacttcatatccctactccatgccagagcacacaggctagggtccaggagattgcccagcacattctaccaccattggcacctgaatactcctctagggggcctgaggttggttctacccacccctgccactacaatcacagctgacacctacctgcacatggcacctgcaggcttggagactgagctgcccaccccctcacagccaccaccaacaccagcatacactgctcaagacccagaagattatcccatcactgccactgctgttttatgccagctgcccagaggcccaagaatctgcccacccacccagctcactgctgccactaccagcatctgagtaagccacctgaaggccaagaattggcccacctggactactagtgccaactcaccactgcctctactggggctcaaagactggcctacctggtgccccagtcctcagcaaaactttaccacaggccccactaataactgcacctgaaaccactgaataaattacaaacaccactgacactgttcatagccaaagaaatcgtacagataccgtaccactgcaagcacccagaatcaaggccaaagggccctaccaaacaacaccatagatctatcttcaggaaaacattccctacagaagcaaattcaaaaaactggaagaagtgactatcacatcagatgtgcagttatcaatgtaggaaacatgaaaaagcaaggaaatataactccaaaggaataacataattctctagtaacagatcccaataaaaaacaaatttacaaaatcctggaaaaagaattcaaaatgttgatattaaagaagctcaatgagatacaagaaaattctgaaaaacagtacagagaaatcagaaaaacaattcaggatatgaatgagaaatttaccaaagagagatataaaaaagaaccaaacagaaattctgtaatggaagaattcattgaatgaaatacaaaatacatttgaaagcttcaacaatagactagatcaagcaaaagagaagatctcaaaacttgaagacaggtcctatgaaataacccaagcagtcaaaaagaagaaaaataagaaagaattaacaaagcctttgtgatatatgggacaacataaagtgaccaaatacacatattattggtttcccagatggcaaagagggaagggaaggttagaaaaatctatttgatgaaataatagacaaaaacttcccaagtctaacgagatttagacatccagatactggaggctctgagacccccccaggcagatgaaatgcaaaaaggcattctccatggtacattatagtcaaactatctaacatcaaagacaaagagagaattcaaaaaacagcaagaaaaaaagcatgcagtaacctgtcaaggaactgctatgagactactagcagatttctcagcagaaacctttacaggccaagagagaatggtatgatatattcaaagtactgaaagaaaaaaaaaactaccaaccaagggtactgtattcagcaaaattatccttcataaatgaaggagaagtaaattctttcccagacaagcaaaaggttagggaattcatcactactagactggccctaaaatattaatattggaagttgttccccataaactgtataaatatatttaattttttctagtatgactttgttttttgagacacttctcactccatcacccaggctggagtgtggtggcatgatcttggctcactgcaacctccacctcccaggttcaagtgattctcatgcctcagcctcccgagcaactgggattacaggtgtacgccaccacacctggctaatttttgtatttttagtagagatggagtttcaccatgttggccaggctggtctcaaactctttgatctcaagtgatcagcccacctcagcctcccaaactgctgggattacaggcgtgagccaccacacccagcctgtagtatgattttaaattgtccctttgtttttattttttaccaacagtgcatgtaatcagtcttttaaattgtttgcctatctgatgatacatgcagcatttaatgtcattaaaacctcaatttgcattagacttttgtaacactactttctcttggaccttttttttttttaaatttgagaacaggttttcattcctttctatgtaaatgcttctcaaaaatccctcagctctctaatgacttttaagtaagcttatttatattcttgtctttaaatcttgactatgaactggtaataataatatatttttattaacttttcaacttgggaaacaaaaagctgcctctaattttaccttctttgtagatctcttcatatctgaaatgttaagtagctgcttgtttgcatgtgatttctttcacaattccatctgctataatgacacaaactatatctttatatctttgtaaaacaggcctactgtcactcccctgcttgaaaatcttctattgtttttccttgccgatgggataaatttaaatttcttttcatgatattcaaaaccatgaagaaacctggcaccaaattatctctctacttacctctggccatttctgctttcatccttggttttccaacctttgggcacctcagttgcagttgtgtttcagttcttatcaacacctccactggactgaaagcagtctttttccttgtctttatttctgttacccaggcttaggatattctccctttctactaccaataacaaccatgtatgaacatttattaaaacaccattcttcttgttactagttattatataaattattcttaggttatgaacttaatcacattttcttttctttgttttgagacagtctcggtctgtcgcccaggctggagtgcagtggtacagtcttggcccactgcaatgtctgcctcctgggttcaagcaattcttgtgcctcagcctcctgagtagctgggattacaggtgtgcatcaccatgccctgctaatttttgtatttttagtagagatggggttttactatgttggccaggctggtcgcaaactcctggcctcaagtgatctgcctgcctcagcctctcaaagtgctacaggcgtgaggcactgcagccagcccttaatcacattgtcctgagttgtcttgagatgtgatgccagtagaaaggtgtatttctaagcctagggaagacctgtggttttgtttgttatatcttaaacactttttactttgagataattgtagccacacatagtcgtcagaaataataaatacaaagagtgctcttacattccccacccagttctcccagtggtaatatcttgcataactgtagtacaatatcacaaccaagaaattgatactgatacagtcatccaacttaattcagaattcgttagttttatacacattcatttgtgtgtatgtgtgtgcatattgagttctgtgcagttttaccacatttgtagctttgtgtgacctcttccacacttaagatcttgttaagaatttcttgatttctttcttttcttttcctttctctttttccccccttttttctttcttctttcctttctttcaaaacagggtctcacttttgcacccaagctggagtgaagtggctcactgtagcctcaaactcttggatccaagtgatccttccacatcacctcctgcatagccaccactaccaccatgcttggctaattttaaaattttttttgtagagatgaggttttgttatattgcccaggctgatctcaaactcctggcctcaagcaatccttctgcctcagcctcccaaaatgctgggattacatgcgtgagccactgtgcccagccttgatttatttcttaatgagaaatttcttctggtaaagttttctaggttttcctagatatcttatatgatattcataaaagaaatcgttcacagcatgaacttaggtggtatatggatgaatggttttgtattttactagttataacctaattattatggcaagtatttttcagttagaatagtgatataaaatcgtaagatacatatattttagtttaaaaggttagtccttttaacaaaaatgataagaaaataatggtacagaagataggagacaaaaatagtagatgatgtgtacaaaggacttaggatacataagtcttggtataaactatatcagaatgaagaggccctttttaatgttcagcattgttactgagactaagaacaatcttgtgtcagcaaaagacagaggtttgggagccagacacatttggtttcaaatctaggctccatcattccttcctctcctcctccagtaaatatgtattgagtgcctgctatgccataccctgtgccgaacatacaacagtgaatgaaacagagcttctgctgcatggagcctacattctaatgagggaagacaaacagtaaacaagtgaataattaaacatatatgccaattggcggtaagagcagtaagcatagtagggagaatacagagggccaagaagtgattgcgcagcaattgctgtaatgtgcagagcacaggtgttgggggacaaggcagaagcagagagggcaggtaggagactgttgcagtaatctaggcataaggtgagggtggctcaaagcggggtagtcacagtggaggagactggcagtaattaaattccatggtattttttaagtctagcaaacaggatttcttgatggagcagatatgatagacaaatgaggaatcaatgatgattccagggctttgggtttgagccaactactagaaggtttgagttgctgtcagtgagatggaatagatagattgccagaacagattttagggaaatcaagaatttagttttgtacatgttaggtgtaaaggtgcctactaaatatccaagttggatatgttgaacaggcagttagggtttagggaaggtgtctgggcaggaattaaaaattcaggaattgggctgagagtagtggttcatgtatgtaatcccagaactttaggaggctaaggcaggaggatggctcaaagccaggagttcaagatgcagattaagcaacaaagtgagatactatttttatttaaaaaaaaaaatagccacatgcagtggctcatgcctgtaggcccagttacttgggaggctgaggcgggaggaccacttgagtccaggggttcgaggctgtagtaagctgtgatcatgccatgcactccagcctgagcaacagaacaagaccctgcctctttaaaaaaaaaaaaaaaaaaaaagtttaggaatagtcaggatattgatactctttaaagccatgagaccggatggctttaaaaccatctgtagaatgagatcatctaaagagtgaatgtaggcctggtgcagtggctcacacctgaaattctagcactttggaggctgaggtaggaggattgcttgagcccaggcgtttgaggctacagtcagctatgactgtgccactgcactaccacctgagtggcagagcaagaccttatctcaaaaaagaaataataaaaataaaataaaaatttaaaaacaattttcaacagagtgaatgtagttagagaagagaagaagcctggggtctgacttgagggcactccagtatttatgggacagtgagatgaagcggaaccggcaaaggagactaaagaatggctggtgaggtgggagtagaccaagggagagtgatgtcctggaagccaagtgaagaaaacatttcaagaaggataaactaggtcagtgttgctgataggtcgagtaatagaatcaagacttgaactatttggactagccataggaagatctttgatgactttggcaagcaatttcagaagagtggtagacactaaagtctgatttggatagaattgagagacccagatgagagaaagtagaaacagtaattttagacaattctttcaaggagtttttctataaaagagagcagacattagggtggcagctggtgagaaatggaggtttgatggagatttttcaaatggagatattatagcatgtttgctcataagaatgctccagtagagatggaaaaactgacattgtagatttttgaattgatattcttgagtgagaggttgtgtaacatagtgtaaatgtgaggagttggccttcagagcacaggtagttcgtgcaagtaataggaggattggcataatgtatgggtgcagagacaaggagtttggcaaatgtggtgggaacatgtggacattgccttctgatagtgccactgttggctgaaagtgtggtcgtattagaggtttgagaagagagaacttgggaaataattgtgtagaagggtgggtgaagaatggattaaggaaatgtagtacccttgctgggtagcactaaggggttactagcatttatttgacatcaatttaaaatgctaccaggcaacgtaattatctttttctccagccacattctgccatatactttgatgtgatgtaaacagttttagatttaaccaaggtaggagcttgtaggttataaaggtggaaagagaaagaggcaagggtaaaaagggcatacataagggagtgattataaggatagaccatgaaacctaagctgggtaatgaactgaaaagggagattatgagaggggcaagagacaatggaaagggggtaggaccaaatggattgtgggttcttataggactgagtaactgttagagtcagaattctaaagggtttgagtagaatcaggaggtgttagtcagaaatcagaagattgaacttgggatgggagcaaagcagtagttattagtaatggcagaatctaggttatgaccatggaggtgctatttcctggtgagtagccttagaaaaatttcacaaccttctgagcctcaattttctcctctgtaaaatgggaataatacctatcttacagaattacgatgaggattaaatgatatgataaatgtaaaatacataacgtagtacttaccatgtgatatgtagaatggcaaagtaccgtatatgcttgatatcctttttttttttttttttttttttttttggagttggagtcttactctcttgcccaggccggagtgcagtggcactatctcggctcactgcaacctccgccttccagttcaagcgagtctcctgcctcagtctcctgagtagctggtggggttacaggtgccagccacaacgcctggctaatttttgtattttcagtagagacgggatttcaccgtgttggccaggctggtcacgaactcctgacctcaggcagtctgcccaccttggcctcccagagtgctgggattacaggcttgagccaccacgctggctgatacttttcttatccttcacaattgcttcatatgaaacctggtgaaataaaatttttacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggtggagcttgcagtgagccgagatcccgccactgcactccagcctgggcgacagagcaagactccgtctcaaaaaaaaaaaaaaaatcactctatgacctatgattatttttccttaattggaatgaaaaacaccactaccattgggagtaccactattatgttaacaagaagtgcttctatttgttacaattctgctgctgttactatgtattcatttaaaagaatctgtgtatcatgaattttcatatcatttgcatttaatttttaaaatagccctgtgaggtaagtggtgcaggtatttttgttatttctccatttgccagttgaggaaatgaaagtatagtgaagtgtgctacttatgattattttgttaaaactagaacttgaacttaggtcttctgactggtgactgaattctgtgcttttcatggtatatcagtgttcaggatatgtttccctgctataaatctgctaaactctaaaggtctctttttaaactatctttttaatgaaaggatttgtctttttattgtacagtcttcatagttaatacattcatccattcatttatttactccttcaacatatattattgtaaccattctttatttgctaggtccttgcaatagcaagacatacacccctgccttcatggagctttcactatagtgagagggacagatgttaataaacaattacattaaaatatttataattaaaagaaaagtgctggaaccaagaacaactaacaaagaataacttgattgagtttgggggttggcttggtggtgacggtgaaagacttcccaaaggaagttacatttaaactgagactggaagggcaaacagctattaactaggagaagggataaagagaagagggtgttacactgagagaagaacatggatgaagggtatctcccttcctctctttcttcctatcacaatttataatggttctttttcattttttttattattttaaaatgtattttaagtataaattaatagttacaaatcatagtactgaatttttctctcagtacattcttcaagaaaatcaattgttgggactgcttaggagggagagcctgtggtgagtttacattgcaagttccattggttgtcatgcagtgaggccatggagagcattcgttttgctgctcttaacttcatcagtgcttttatgctgacagtttttgctggtgcaacacattgaatctttccaaaggaatagtgatacacctctgcctaaataatgactatttccatctaaaccgattcatctggtatattacatgaacaaatttgtaagactccatggttgaaaaccatagtttatcaagttttttcctttacttctaactaagatagggacccaggcaatttttctttttcttgcttctacactgtcatctgttgaccacagtgagcattctgtatagcatttagtcccacatgttgctgtggttgaaaatcgatatggatttcccacaaaagggaaatctcaggagatgaatattataatctatcagaatttcactttaaggactcattttaaaaaataaagcattgccattgttataaattatcgattgtgtttataaatagtgtaggagcatgctagaattgactaaggcatttagcaagtaggaaagaaggttgaagaggaagttggctagaaaaagcaaaggattaataattctttgacttgactgagattgctgagcacatttatcaagcaaaggtgatggcacttgcttggaatgaatccaaagcacagtgtgatgctaagcattgttgtaacagggagacagatgtagagccacactattatagatttcttttgtcagacaaaatagactttgcaagcacatcaacagttgttcatgatatatttttccagccgcgtcagtttatataagagtaaaatgatgtcgttgaaagacaatgtactatatatacaggtacccaatcttcgtcttgtatctcagtagtgccaccttcttcttatatgacctaaagtgatactctaaaatctctctgggcctcagttaccttattactaaaattaggaaaataacttaatgaagtaataaaacttgatattcataattatggccctgtgacagcaaaagacttggagagtctgaaatattcactaatttttatagtgttagctttgtaattcttgtagcactttactccattattaagaataactaatgaatcagaactccctattgctgagctataagaagaatagagtatatgccatgttgcttgttatgtgtgctgacatattgcctataagccattataaatacattaaagaagacattcatttattctgtcagtgctgccctgtgagcaaaaggttagccaactttttcttcctgttccctgcctaatgcttttctatccctctttgaatttaggagcatgtatcccgtttggaaatcttttctcgagggaacaatgcaggtagcccagtctcggatgaatatatgtgaaaactataaaaacttcatttctgagcctgcaaggacagtgagaagcttaaaagaacagcaactaaaaagggtattgtttttatttctgttcttatatgcattttaatatcccagtgctacatttataatctgcaaggttatgctaaattttatttaaaactatatggtcccatatgtttctggttgacattttactaggattttctgatttcaacatgttctcattaagtactatgttttattaactgctaaaaatgaatgtaattcaaatccatggacgttcaaaaagctcagtaaatactttttagtaataccgcttttcggcataattcaagtacatagatctacttagtttcacaatatcggtatagtttgatgtgtattagaatagttacaaggttattaatcccactagttcttgaaaaaagtttacattaatttgtcttactttcaacttgacccattttgtataataatttaaaggaaattaacacattttgactaaacataaaaaacttactttaaaaaacctgatggactctaaactttaattatatgggttacacatgagtaaatgttttcaaatggacatattttattacacagaaataaaaaattcataggaaaatggcattgcttaatgtgactttttagaaaagttggctgttgaaaataggtgattgaattgtgttcttttggaaatagagttacaaaaattgagattatcattatacctaataagtaattaaaattttcttgtggaagtattaatactttagaaaatattaaagtaaaagaaagaaaatattaaagtaattatttcgggaaataatattttagaagccatccagtgttttgattctaattgtcattaggattttcagaacatttttacaaacacctttcccaccaaaaaccccccaattttccgtttgccaaagatgattctagtagcatgaaatcaatatgttagatgtatatgtgtctttatgtaaaatgttaatttctttagagcactcacctaatattagtcagttaaacatatttgtataagaatgcctgtgttttatctttgccaaaaaatatctctttcaaaacaaacatagtgagtaacctatgtgatcactggccagtgattttgagttggaagaaagtgtgtgtgtgtgtgtgtttgtgtgtgtgtgtgtgtgtgtctgattgtgcagaaagagggtgtaaggtaggggcagagaattaatactagtataacttcccaaccaggaggaaatactgcatttcaaatttccagtgcattcatcagatctaattgaattactgccaccttactcaatatcagaatatttagagagtttaactacctctggtgcttttctcttccattgatgaagtaatctcagacctgaatttaactgacattcctgggcaaagaatgtttgataaggccgggtgtggtggctcacgcctgtaatcccagcactttggatggccaagccgggtggatcacctgaggtcaggaattcaagaccagcctgaccaatatggtgaaaccccatctctactaaaaatacaaaaattagccaggtgtggtggcgtgcacctgtagttccagctactcgggaggctgagacaggagaattgcttgaacccgggaggtggagattgcagtgagctgagatcgtgccactgccctccagcctgggtgacagagtgagactctatctcaaaaaaaaaaaaaaaaaaaaaagaatctttggtaagattcaacaaatgctcatgtctgtgaattaacttgttttatattattgctgatgatctatgttacatctaagcaattgttaaatattcagtacatattgggtatacctgtcaggactctgagatagcaaatgaaagaaacctccttcaaactgctttaagccaagaagggaatgtatctgcttgtataactgaaaattgaaggacttcaagcatgggtggatctaggggttcaaatgatggtattagaattcagactttctttccatccattagctctgcttttctgaatggcttcactcactaacaactctctccacatggtgacccccaatgtgccagatttataaatcttaaaggtagcaatcccagatttttcattttcccaaatgaccagaattgttttgcatagcagctgcatcatttggcattcccaccaacagtgcacaagggctccaatttctctacagccttgccaacatctgttatccttttaaagaataatagccacctaacaggtgtgaggtaattaatattttattgtggctttgatctgtatttcactgatggttggtgatattaagcaatctaatattttttattatcaattttttcctccactattagcttcttactttttaaatcctatattcttttagtaattaccttagagattataatatccctccctaacttattacattaccttgaatcattaatcttactattccccaatccttgttccaaattaactttttttttttgagacagagtctcgctctgtcacccaggctggagtgcagtggcatgatctcgctcacagcaacctctgcctcttgggctcaggtgatcctcccaccccagtctcctgagtggctgggattacaggcgtgtgccaccacacctggctaattttattgtatttttagtagagacagggtttcaccatgttggccaggctggtcctgaactcctgacctcaagtgatctgcctgcctcagcctccaaaagtgcggggattacaggcatgagccacctcgcctggtccaaattaacttactacaatctaccttgaattagtattttactacctcatgaacaatataaaaatcttctagcaagataattccatttaactctcatttatgactttttggctgttagaccttttgactctgttcatgtcttttctactttttcagcattttgttttccacccttttttctctgtgtacttcaatctgaatatttaacaagtttattaatatactgttctactattttgaatctgctttaaaaactcatcttttggggacgggagtggtagttcacacctgtaatttcagcactttgggaggccaaggtggaaagatcatttcagtccaagatcagcctggccaacatggtgaaatcccgtctctacaaaaaatgtaaaaattagccaggtgtggtggttcatgcctgcagtcccagctacttgggaggttgaggcaggaggatcacttgagcacaggaggtagagattgcaggaagtcgagatcgtgccactgcactccagcctggatgacagagggagaccctttctcaaaacaaaacaaagaaaacctcatattttggaatcttaatgtacttttcagttccaggatttttatttgacttttaaatactacattccatatttctggtacagttctccatgtttttcctttatcctcttaaacatgttactactgatctctattatataatttcactatctgaattactgtaggtctcttttaaccgcctgcggtttttcttgatttttggttatttgggtcttctgtttgattatgactcacaatattggacattgtggataaaaactgtagaggctctgggaagatgttatttccaaagagggttaagctttcttctggcaagtggatagaatgctattagatcaccttgattctgttaggatctctggttttaggctttttagggctattctgtttcacttactcctagagttttaactgaaaatatagggtgcttaccaagacccttctaatttgacaagacttgaactctaacctttgtcttctcaacatcgtgtagctgctctgatgctctgatctctgctcactctttggcctctcggctatagttctctactggatttcttggcattttacccaacacctgctttttagaagtcatctgttaacccaaggggaaattgcatacagatttttggacttgcttttctgcagtacccctctttctagacccttacctctcaagttcctgttcttttggcatccctaaactccaacctctgtctccccagtctcgtaaaaatgccactttctgtttctgtcctatttctttataccatgattcaacaaatgccctaaggaaaaacattaagttgaatttaagacttaccttggtgtattcctcttttcctgggtgtcttagtcctttaagtccagtgtgtggtggtggtctttaatgctggcagttttttaaaaatgtattttgttcaacttttacactttccagtctagagaaaggtagtctgatccaagttgttctgtcatgatcagaaccaatctgacttaaaatttttcctctacaacattttaaagttcatgtttttttaaagattttctctaatttgactattttcttttataatgcttggaagataaacacaattgtattacaattatgcagagccccagtttataatgaggattatgagaattattacatttttcaaaattattttctgtatgctgacatttgcttaaaaattagaatgagagctacaataacttaaggctttttgccattcttatgtttacttaaccatacttttgtccgtatctttcacatttatactagagtttacttaccatccttgaaatattgtggttcacatttgtataacactttagagtttgcaaactgctgccatatccattatagtcacatttgatttttacacaaccctgatagtatttaagtattattattttacaaatgataaaactaaagctaaaaatgttaaagagacttaggtagtaaataacagagtgggaacttgaatatactactacttcctaattccaaatcctgtacaatgcttttaaaacaaagcttaatattgaaacaggtttatagaaaaatacatgtaaatgccttcaccatagtagactacttaattctcttactccttttatcttgctccttttatcctcattctcccaatttcctaattaattgttcatgtttctacataacctttatgtttattattttttattattttgtgaattttccattctgctttctttaattatacaactgggtttggacattacccttaagtctacagtaaaaattaactttttaaatttttttcttaggataaatttctagggcattattactgggttagagaacctaatcatttgtaggacttcgatgtgttggcccaggttacttttatttgtattcttatattcaagttattagcaagtttattattgtgtctctgtcatactcagagactatacttttaacttcttccttttttttttttttttgagacagaatttttctctgctctgtcacccctgctagagtgcagtggcatgaacacggctcactgtggcctcaacctcttgggctcaagtgatccttccaccccagcctcccaagtagttgggactacaggtgcttgccaccacacctggctgatttttgtactttttttttagagatgaggtttcaccatgttgcccagggtggtctcgaactccagggctcaagatatctggccgcctcagcctcccaaagtgctaagattacaggtgtgagccaccgcacctggcccagtttttggttcttaatatcaaaattgtagccatggagcctgcttttagctcttcacacctgcaaacacagcattattagaatgtttagcacttctttatgggagtgtcaggttgtcatcttgtcatttattaaacaaaaactttgtatttgataagtactattacaatttagggggaaaacagcttttcgttctgcaagataaaagcttacttttagtttatatgtaacaaaatactattcggcgataaaaaggaatgaagtactgacacctgctacaacttgaatgaaccctaaaaatgttttgataagtgaaagaagtgagaaacataaggccacatattatttgattccatttgtactaaatatcccaaaaaggaactccatagagacaaaaatagattaattgttgttggaagtggggagaaatggggagtgacagctaatggatacagagtttctttttggggtaggaaaatgttttggaattcaagcagagtaatggttgaacaaccttgtcaccactgaattgtatactttaaaaaggtgaattttgttgtatgtgaattatatgtcaattttttaaaagcttttaagataaactacatctataagatacagtttgcactatatcttttttttgttttgttttttgagatggagtctcgctctgtcacccaggctggagtgcagtggcatgatctcggctcactgcaagctctacctcctgggttcaagccattctcctgcctcagcctcccgagtagctgggactacaggcgcccaccaccacacccagctaatttttttgtatttttagtagagacggggtttcaccgtgagtttacactatatcttaaaacatggtcatcacagaactagggtacacactttaatgggttccatagtaaatggtatcatcacatccttgccgtgtgactcagagtaaattatttaacatctgagtctattttctcatcttaatgggatcactgctactactactactgctgctgctgctactactactactacctttttcatagagtcgtttcaaggactaaatgtgataatacctgtaaagtacgaaacatagcacctgtgcagtgcccacaaggggtctttttagaagtaataagcattcagactcccttggctctcataggccacacctgacaagaggtttactgagaaggacagagtacaggaaacacaatttgccagtagggaagcatctagcattaatggaaataattctcccactattgtatgtctcggtccacatagctgaccagttattctgtttggtcctccaagtgacaggtctaggacaagggagtgagacacatttgcagagccagctttagcccctaaaggagactaaaattttttacaacaactctatagacagagcttccagtgtccctgtaagggacatgtccggatacaccgtactcacagaagcccaaagcctggcttttctatccgatatttatttatttatttatttttattatactttaagttttagggtacatgtgcacaacgtgcaggttagttacatatgtatacagtgccatgttggtgtgctgcacccagtaactcgtcatttaacattaggtatatctccaaatgctatccctcccccctcccctcaccccacaacaggccccagtgtgtgatgttccccttcctgtgtccatgtgttctcattgttcaattcccacctatgagtgagaacatgcggtgtttggttttttgtccttgcgatagtctgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttcctattgtgaatagtgccacaataaacatatgtgtgcatgtgtctctatagcagcatgatttataatcctttgggtatatacccagtaatgggatggctgggtcaaatggtatttctagttctagatccctgaggaatcgccacactgacttccacaatggttgaactagtttacattcccaccaacagtgtaaaagtgttcctatttctccacatcctctccagcacctgttgtttcctgactttctaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgagttcattgtagattctggttattagccctttgtcagatgagtagattgcaaaaatgttctcccattctgtaggttgcctgttcactctgatggtagttccttttgctgtgcagaagctctttagtttaattagatcctatttgtcaattttggcttttgttgccattgcttttcgtgttttagacatgaagtccttgcctatgcctgtgtcctgaatggtattgcctagcttttcttctagggtttttatggttttaggtctaacatttaagtctttaatccatcttgaattaatttttgtataaggtgtaaggaagggatccagtttcagctttctacatatggctagccagtattcccagcaccatttattaaatagggaatcgtttccccatttcttgtttttgtcaggtttgtcaaagatcagatagttgtagatatgtggcattatttctgagggctctgttcggttccattggtctatatctctgttttggtaccagtaccatgctgttttggttaccgtagccttgtagtatagtttgaagtcaggtagtgtgatgcctgcagctttgttcttttggcttaggattgacttggcaatgcgggctcttttttggttccatatgaactttagtcttttccaattctgtgaagaaagtcattggtagcttgatggggatggcattgaatctataaattaccttgggcagtatggtcattttcacgatattgattctttctacccatgagcatggaatgttcttccattcgtttgtatcctcttttatttcattgagcagtggtttgtagttctccttgaagaggtccttcacatcccttgtaagttggattcctaggtattttattctctttgaagcagttgtgaatgggagttcactcatgatttggctctctgtttgtctgttattggtgtataagaatgcttgtgattttttgcacattgattttgtatcctgagactttgctgaagttgcctatcagcttaaggagattttgggctgagacgatggggttttctaaataaacaatcatgtcatctacaaacagggacaatttgacttcctcttttcctaattgaataccctttatttccttctcctgcctgattgccctggccagaacttccaacactatgttgaataggagtggtgagagagggcatccctgtcttgtgccagttttcaaagggagtgcttccaggttttgcccattcagtatgatattggctgtgagtttgtcatagatagttcttattattttgagatacgtcccatcaatacctaatttattgagagtttttagaatgaagcgttgttgaattttgtcaaaggccttttctacatctattgagataatcatatggtttttgtcgttggttctgtttatatgctggattatgtttattgatttgcgtatgttgaaccagccttgcatcccagggatgaagcccacttgatcagcgtatgttgaaccagccttgcatcccggggatgaagcccacttgatcatggtggataagcttttggtgtgctgctggatttggtttgccagtattttattgaggatttttgcatcgatgttcatcagggatattggtctaaaattctctttttttgttgtgtcactgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactgtttttggttggtaagctattaattgttgcctcaatttcagggcctgttattggtctattcagagattcaacttcttcctggtttagtcttgggagggtgtatgtgtcgaggaatttatcagtttcttctagattttctagtttatttgcgtagaggtgtttatagtattctctgatggtagtttgtatttctgtgggattggtggtgatatcccctttatcattttttattgcgtctgtttgattcttctctcttttcttctttattagtcttgctagtagtctatcaattttgttgatcttttcaaaaaaaccagctcctggattcattgatttttgtgaagggtttttttgtgtctctatttcgttcagttctgttctggtcttagttatttcttgccttctgctagcttttgaatgtgtttgctcttgcttctctagttctttgccttgtcatgttaggttgtcaattttagatctttcctgctttctcttgtgggcatttagtgctataaatttccctgtacacactgctttgaatgtgtcccagagattctggtatgttgtgtctttgttctcattggtttcaaagaaaacatctttatttctgccttcatttcattatgtacccagtagtcattcaggagcaggttgttcagtttgcatgtagttgagtggttttgagtgagtttcttaatcctgagttctagtttgattgcactgtggtctgagagacagttttgttgtaatttctgttcttctgcatttgctgaggagtgctttacttccaactatgtggtcagttttggaataagtgcagtgtggtgctgagaagaatgtatattctgttgatttggggtggagggttcctatcagatatttatagttaatttttagtttatcccaaattgatgcagtttgcctaccagggtttgtaagcaatgttgcctaataacacagctgacattgtgtcttctcatcaggtttctattgaaacacagatctagaaagttaagcaaaggcccagtttcgtgcagaggggaaaagttttgttttattttgtgtttttttaaccttttccttcacagcctaacacttattaagtgcttaataaatatgagtggttattttgcttttatctgtccatgcagaatcttctagatgtctcatcccctgtagtcctttcttaacacctaacagcttctgggaaagtctagcctgtatgtcatatggttaagtttattcttgttttatcctcattcttctgatgtccttgccctcctccacactattcacccttgcacaatagtccttcaccagtgtctcctcctgctttgctgagcttttgccagtctccaccagtgctatttcaggcttagaagtttttagatgtaactgctctaagctggtctcaggctggtgaaacttctaattggtttgtttcaaagtggggtcaatctcctttggatactcagaaaggtcctgaggcagtgttgcttggccccggtgtgttataagagttaattgattaaacattgttttagttgttatgtccatcccttctcctcgaatgtatatgtgtatccacggagttgggcaggggatggttttgagtaataattgttatgtggtacccaggtttcgtgcttctcttgttcaccttggacttaccaagtcagactactcagatttcactccctcttgtctaaggggtgaattcttcagtaccctttgcactgtcggttacccaaacataaagagagactttgttaagattatggggaaatacagaattgccttattcttttgattttattatcatgatatctccaacagtgagaacatttttcatagttgctcttccatgtcttaccttaacgtcagtcatcagcagcactcgggttatttctcaatgtatggttgttaggcaaactgtgacactgtttgatgtgtagtacttgagatggaaataccaggattttaattcacaggattttaatctgcaatttgaaggacactgaacgtactgacttttcccctggatttccatcctgaaggcatagtgtatagtccttaggatgaagtcattttctgtaagcctgaaaactaaaatcataatgattgtacttttgtattttacagtgtgtggaccagttgacaaagatccaaactgaattacaagagacagtgaaagatttagctaaaggcaaaaagaaatactttgagactgaacagatggctcatgcagtacgagagaaagctgacatcgaggcaaagtatgtgttttaacatttctgagaaaattattatgcaaataaatgttattgttgctaatagtttgttctctattagtagtgagcatggacccattctcaggtagtggtggtttcatttgacctacatgtgttatatactttaggtcacatttttttaattggctgatttttatctgaattaatatagcaaaatgggaatattagattagtcagtttttcacattaaattgaattttgaaaaagaaggtaaatgaacattgtatttacagacttgaaagcttatcaaaagcctgaagtcactgctatggtgtctgaatatcagggtttaagagcctcatttttctcatgctggattctcaatcagttgtagttggaaattcctgtgatcctcaggatgccactgaaggtccatgaacacatcaagtgaacaaaagcactgacctccatgtagaaaccctgccccaggcactgtttttttcttttacacaaaaatctagtgtatatatacataatttttcatgtatgctttagcaattgtatgaattcaatatatgtgaattataagacctttttttaagaataagtaggaaaagaaggaactggcaactggtaatagaaggtgatataaagcaagcaatataatagagatttttgcagtgacaatttgaggaaagataaaaagttgatgagaaaaagcatgttgtataactggactctgaagacatctgtgagaaggagagctgagactcagggtcagtgtgctgactgatgcaaaatctaggagtctgaactcctaatcataatatcagaaaggctttgaacacctgtacaaacagaccagtaaggagggggctatctttctaatacagtttttattcacaagaaatgtaagcaaccttataagcaacttgtgaaaattcaggggctccgcggtttatcaagggctggtaagtgagtattcatgaaggacttgatgttacaggaaaacacatttaatatttctctaatttgttttattgtatttattgttttattgtttgaacctacaaatatttcctgtacttttatagagtcagtgaacccatcttctcaataagacctgaagtttttagattagatgtccattgggaatatactgtcatagtcgtttttagaaacttgttttcttaaactttcagagatcctagaacagagaattgacagatttgtaaagcatgtataaacaaataatttagccacagcccacaggatgaacatgagcacagtggaggggcgtttctgagaagtggggatttgatagggtctgattcacagagctgatcacaaggaattgccttctaacatgacccaaattcagaggggatacagcaagctagacatattaatattaacttttcaactatagagtaaggaatgccactttatcttcatttattcgcagtttgttgaatactttatattggatatggtgagtacagagatgagtaaggtaagctttgtgccctcaaggaatttaaggcctagaattagaaactcaaagaaatcaagtgcctaaagtcacttaatattaactaataacttacttgcagtagtaatgtgaaaacacttttaggaaagcctagaaaatatagaggttaattttgcctaatgataaatgaaagctttatagaagaagtgatgtttggatagaatcttgaggaatgagtataaattttctaagtagagataaggaggaagatcaggaaggggaagttaaactgtactacctatagtttttatagatgatttgatagatggtgtggagatgcacacattaggagagaccatagaaggaagagggatacaatttgaaggagatgatgaatttcattttggatatgtttattctgaagagcctgggaaacactggggtgaatatgtttggaaggtagtcaaatatctggcacttaaatgagaatttgggcctcaagatctcgctttgagggtcagttgcctatcagatggtagttacatagtatatagaatagatgagaagttgagtttggaaccccaaggaacattaattttgaagggtaggtggtaaagagtagcacgcggtatagttcattatttgtgtagtgtttgggtgtaaaaatcctgccttattttttctagattgaaatgtttgagaacaggtactattttattctatctatcactaatacctaccttaatactacacaagaagtatattaggattaggaaataaagcagaagccagaaatttaaaaccttatattggaagatctacatgcaactcagcctatttgggtaatgactgtaaaaaaaggagaactgggaatatccccaaacacagtcttattctgaaaaggctttcttagagatttgagtttgtggcctttacttttctagataaaataaacaggaatatgattaataaaagtaaaataattggggccgggcacggtggctcacgcctgtaatcccagcactttgggaggccgaggcgggtggattacaaggtcaggagattgagaccatcctggctaacatggtgaaaccccgtctctactaaaaatacaaaaaattagctgggcgtggtggcaggcgcctgtagtcccagctactcgggaggctgaggcaggagaatggcatgaacccaggaggcagaggttgcagtgagcagagatcacgccactgcactccgacctgggcaacagagcgagactccgtctctaaataaataaataaaataaagtaattatgaaatatgactatgacaaggtaaaaaataacaggaatcttttaaacccaatttttttaacaatggggaagtagttgggctgcatatgtgttcatccctgaatgttttctcttgttagaaaaataagaggctgcttttcctatcctcttcacactggctttgcaaagactaactgctccatcatccagtcccaaactggccagcaactttacttcatgaggcacagctgccaacacatgtattgaattctctcatggaaatcaccctgacactgaagtcaggacaaacattgcagctttaaaaaaaaaatcactggtcctgggagtgttgcttgttccctagcatttgtctgttgactttctccatatggttatctgcagctgtttgggtaaaatcaacatgtttgtactacctattgttagattatggttactctcccaaactgaaaaaggatcaagggaaataagaacccaagagtgggagaagattacatcatacagggcagagtcccaggactttctcagtaagttcagaatacccccttagagcagaggaggcacacaggcaggtacccaaacaagaagtacttttaatggtggaaataatagaagtaaggacttcatagagcctattgttagagtctttcacacacagccctgaaagtttgctgacgcttgcctccataggttgattgtccctgggtctctctaacctttgcaggaactaaagtgtatgaagttgtatggtactgagaatagtctataatttgatggctcttgtttattaggagacaccaatatattttgatttttttttggtcaagtttttttttttttttttttggtcattctggatatttgtcttatattaatcccagtatttcctgttttaccatgataataaattcttcctgtagtaaaataaaggaaaataatcattactcttggttttccattttttcattcttttttagagcagtatcttcaaaaaagattatttttaaattttaataatatatttagtaattttattgtgatataattagatgattttattaaacatacttttctatttttattatagatctaaacttagtctttttcaatcaagaatcagtttacagaaggcaagtgtaaaggtaagttttcaataagtgtatttcacaactgagaaacctcttagcttgtaaaacagagaattggatctttgagggtggaggtggattatttctaccttagagaagcattttaaagtcactgactcagggaggaactttccctcccagttcatgggggttttgcacccagctgtcaacaccttggacacacttgcttctcaagactgcattagggataagtttctggaccttacctgcttaggcagcctgttgtctttagctcttagtccaagagacttaatccgggggctttggaaagctctacaaaatctatttcgtttagatttagacccctgagtgatattctgggccagatgtgagtgagtttttccttcggaaacttcacactgtggaatgcctgattaagtaagcttagagacctggctgtggctgccaggcttcaaactagcatgcagttcatctggcacattaggagtgctgatttttaaaaaactgttttctaactccactagattttacccatacctttgaagataaggtacttatttcagaacctttatttagtcatttgaataaatgggcaaaatatttttaagttatctacaaagctttagaagtatgttaagcaaatatttgaaaatgctcctgccctgtataacagttctagtcactgtttcattccttagtagtgatgaataatttttatatacgtataaatgttttccgcacgtggttacctttattcttgttggggagccattaattgcaaactaagagtaggattcctatgtgttttgcagtacaatatcagtttgcactgattattttattttgctatgttttagttaaaagcccggcgatctgagtgtaattccaaagctacccacgcaaggaatgattatcttcttaccctagcggcagcaaatgcacatcaggatcgctactatcaaacagatttagttaacattatgaaggtaatacagctttcatatctatggtaattttacttcattgaaaacaaaaacaacttaagttgggtgttgggtttatgggattgaatctataaaagagtagccaggctatgttgcatctcattggaatatacttgttattgtttggatagcatctgtttcagataatttggaattaatttttagttaagaaaatgtttacagacaagtcacagtaaaggattatattattccctaggtgcggcaaacatttgttatctagtggttattgatgtagaagatacaagagtgatgtaagaaataaaataatgactcaaactgggaaactacttctgagctattttatgagactcatgtcatggtttcaataaattattgaagctaggcagaatcttcaggtatcttctgaatcatcggagaaagacattttagcataatttttgttagattgtatctgtattttttgaaaaatttttataagaaaagttttatgcaaaagaatatttctattaaaaatatatttttatagtgtatctcttagcctgaattttttattaactacaattttggccacaactatgtctaatgataattatgaagctttttttaattttaattttttagagacaaggtctcgctctgttgtccaggctagagtgcagtgatgatcacggctcactgcagccttgaactgccaggctcaagcaatcctcccgcctcatcctcctgagtagctgggatccaggtgcatgctaccatgcctggcacctttcttttatttatttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcagcctcccaaagtgctgggattacaggcatgagccaccgcgcccggcccctttcttttatttttagaaacaagagtcttgctatgttgaccaggctggcctcaaactcctggcttcaagtgatcctccctcctaagcttcccaaaatgctgggattacaggtgtgagccattgtgcttggctattttttatttctaaaaaaacttagatttttaaaaaatttcattacgtttatcctgaatttatgggtaaaattgcacattactatttgatgattttgagctgcgtacgggacaaacaaaagagtatgttcagtagctatatgaagatgtctgtcctctgggtattactctgaaatgcagatagattagattacagtttgtgtacccaaacttgatctagcatttccctgtttataccacctatgatgtgtctttaactttcactgaaataaagagaagatagtagaggaaaaggaaacctttgtaatctgttgccaggtttctcccttgttgctgacaggcaagctctgctttggattgtatctgtcattctttcctgttttcccaaaacccaaacattttatcattttgttttttcttattttcaacccatccccctcaaatgtattgttcttaatgactaacaaacacacacattgctgtagtcgaattgcttaatttacaaatcagcaattgtgaatggggatgcagccagagcaggtgctcttttttctgcagtagctctggaaaagaggtcaactctggccagaaactgcaagttctttccttgaaagtagagatgggacagttctcgggaccttcaggcaaaaacaagagtgttgaagggagtcaaactggactaagaagtatcctattgcaaaaacgttttttctttcctttttgttcactgcctgaaatccccttttcctagcttctgttgtgacttctgcttattagaatacaggttagaaaatatagagacaaggaactgttttgtcatctcagatgaaaactctgcatatattttccataaagtattagacctagaggtttaggtgttttagtatatatagtttttgagacagggtctcgctctgtcataacaggctagagtgcagtggcttgaacatggctcactgcaacctgaacctcctggtctcaagggatcctcttgcctcagcctcccatgtagctaggaccacaggtgcctgccaccatacccagctaatttcttaatttttattttcgcagaggcgtggtctcactttgttgcccaggctattctttaactcctgggcttaagagatcctcccacctcagcctcccaaaatgctgggattataggggtgagctactgggcctggctggttttagtatcgtattaggtattacatagtgcttcagacttacaaggaccaacagtttcaaagaacacatttactaaagatgatttttagcacagctcgcacttaaggttgtaattcactatattctatatatgtctactattatatcaaagctgtatatttttccctatgaatatttttaaatgaacattatattaacttaagcaacagcaaaaataaaatcctattttttttctattggatctacagctaaaaaagatggccttcaataaaccagagaaagtacattcttatttgggggatctgctctctgcctaaagcaaagaggaagttaaagggcctggccagctcacagattaatatatgttctcgaacttactttgaagtctttatgcatatatttgatcagcattgggtaggtcatgctttggagtattcatttaatgaaacattgtggggtactaaactgattaaaaatagaggcaggggttggtccctcctgccccttaaaaatgagaaaacatactttcagttttcatgtactgtacattaactcattttcttcctcatgctaattctatagtctgcagtacaggaaaactcctatcaatcatgctgttagctacttagtaaatttccaccattgaattgtcagtggcccttagatgcctttcttgaaaatatctgtttttctgaattaatgttaaggaaatatctatttttctgaattaatgttaaggtgataatgccctatatgggtagcttaaaagcagggtatttgatttgttggtttaatcatacacatttaagagcctcttacagcatgctaactactgagttaggctttgggaagagacagatgagtaagacatactacttatcctcaaagagctcaatatggtagaagagagtgagatgtatatatatacatacacatatatatacacacacatatatacatatatatacacatacatatatatacatacatacattatatatatatatatatatatacacacacacacatacacatacatatatacatgattgcaaattagagtgatggaaatcacttactgctggaggactgtggttagtaataataatagctatcttttttattgcttaatattgccttggcattatcctaaccatttaatacatgttatcctttctcattttctttgttatcctcgttaaagttcatagctcattatttaaataatactctaacttatattcttatctttgcccttcttcaaatgaaatgaaattgtaactctgatgagcccccataactggataatctgtatctaagcagccaagtactgctgaagaaaagtttcgacggagcagattcatgatcataaattaatagagaaaccagtgcagcagtttcaacactgcttagatggcctactgtcttttccctagttaacttttcctactatttttaacagttatttcaacttttcccccctcttcaaacctcaaacttaccccttctcttttatgcttagcaagtgggttttcttcctaatttacagagacgatagaaaccgttggaagacagcttcaatattgtccacttcatctgtgttgaagactcttccagagtctcagtagcagttgttcctgtctaaaggtgatcttttcacctcagctttggattatatctcatcccctcctgccttcttagggaacaaaacaattattttatgttcttttcgtatttcctggacattctgttcttacattagcagttatcttggtgataacaaccctcattatgactgtcttttgagttacattcttctaatctggactagttgccctctgtgtcagatgcaagtatttatcctgagatcttcctatatgtctttgttgtgttagatctccagttttctttatgatatgtcttatttttttcttgatttatactgtcctttggtagagcacatcctccagtaccttcttgcgaaagtgggcatgggaagtaagttttttgagatactatgtttatgaaaatggcatattatttgcttgtacttggatatagaattaaaggttgaaaactctttcattgaaacattggagtccatacctcattgttttcttctttactgtgtaagtattgagaatccaaagccatcctagttcttgattatttgtatctgatctaattgtttgttttttctttttttagaagtttatggaatattctcagtgtaccctttgatttcttggattaattcttcccttttgttttctctttctggaacttcccattattaagatatgatatctcctagcttgcttctttaaatttcatttctttcttattttccatctttgtcattatgttgtactttttgggagacttcttcaactttacagtttcttttattggacttttaattttttcatagtagttttaatgtatgagagttctgttttctccacatccttaccagcattttttattgcctgttgtattagttcgttttcacactgctttaaagaactacctgtggccgggcatggtgacttacacccataatcccagcaccttgggaggccgaggtgggcagatcacctgaggtcaggagtttgagaccagcctgccaacatggtgaaaatccatctctactaaaaatacaaaaaattagctgtgtgtggaggcatgcacttgtagtcccagctactcagggaggctgaggcacgagaatcgcttgaacctgagaggtggaggttgcagtgagctgagatcgcaccactgcactccagcctgggtgacagagtgagacttcatctcaaaaaaaaaaaaaaaaaaaagaaagagctacctgagactgggtaatttatgaagaagaaagggttaattgactcagttccgcatggctggggaggcctcaggaaacttacaatcatggtagaaggcaaaggagaatcaagtaccttcttgacatgggggtaggagagaggaagcgaagggggaagtgccacttttaaaccatcagatatcgtgagaactcagtcacaatcatgagaacagcatcagggaaatcgctcctataatccagtcacctcccacagggaccctcccccgatatatggggattacaatttgagatgatgagatttgagtggggacacagagccaaacatatcacctgtcttttggataaaagtcatttgacctgggatgacatgctatctaattatagttttgatttatgtttctctgatggtcaatgatattgagcacctttttatatgcctgcttgccatttatatgactttttttgagaaatgtctattcagattttttgctcatttttattttttatttttatgtatttatttatttttctttttttattatactttaagttctggggtacatgtgcacaatgtgcaggtttgttacatatgtatacatgtgccatgtggtgtgctgtacccattaactcgtcatttacattaggtatatctcctaacgctatccctccccgctccccccaccccatgacaggccccagtgtgtgatgttccccaccctgtgtccaagtgttctcattgttcaattcccacctatgagtgagaacatgtggtgtttggttttctgtccttgctgtagtttgctcagaatggtggtttccagcttcatccatgtccctacaaaggacatgaactcatccttttttatgactgcatagtattccatggtgtatatgccacattttcttaatccagtctatcattgatgggcatttgggttggttccaagtctttgctattttgaatagtgctgcagtaaacatatatgtgcatgtgtcttcagagcagcatgatttataatcctttgggtatatacccagtaatgggattgctcggtcaaatggtatttctagttctagatccttgaggaatcgccccaatggttgaactagtttacagtcccaccaacagtgtaaaagtgttcctgtttcttcacatcctctccagcacctgttgtttcctgactttttagtgattgccattctaactggtgtgagagcgtgctcgcttcggcagcacatatactaaaattctaactggtgtgagatggtatctcattgtagttttgatttgcatttctctgatggccagtgatgatgcttttgctcattttaaaaatcagattattagatttttttttcctatagagttgtttgagctccttatatattctggttattaatcccttgtcaactggataatttacaaatattttttaccattccatgggctgtctctgcactttgttgattgtttactttgctgtgcagaagttttttaacttgatgtgatcccatttgtccatttttgctttgattgcctgtgcttacagggtattactcaagaaatctttgcccagtccagtgtcttagagaatttcccccaatgctttattttaatagttttgggctgggtgtagtggctcacacctgtaatcccagcgctttgggaggccaaggcaggtggatcacaaggtcaggagttcaagaccacctggccaatatggtgaaatgctgtctctactaaaaatacaaaaattagccaggtgtggtggtgggcacctgtagtcccagctactcaggaggctgaggcaggagaatcgcttgaaccgggaagtggaggtcacagtgtgccgagatcatgccactgcactccagcctgggcaacagagcaagactctgtctcaaaaaaaaaaaaaaagtttcatagtttgaggtcttagatttaagtctttaattcattctgatttgatttttgtatatggtgagagataggggtctagtttcattcttctgcatatggatgtccagttttcccagcacttttcccccagtgtatgttcttagcaccattgttgaaaatgagttcactgtagatgtatggatttgattctgggttctgtcttctgttccattggtctgtgagtctatttttatgccagtaccatactgttttggttactatagctctgtagtataatttgaagttaggtaatgtgattcctccagttttcttttccccagcctaattattctgaagaataagatcaggcctggcacagtggcttacacctgtcatcccagcactttggaaggcgggggtgggaggatcacttgagtccaagcgtttgagaccagcctgggcagcatagtgagactttgtctctacaaaaaaatttaaaaattagcacgtgcttgtagtcccagctactcaggaggctgaagtgggaagataacttgagcccaggaattgaaggctacagtgagctatgatcctgccacagcactccagcctgggtgacaaagtgagacctcatctcttaaaaaaaggaaataaaaagaataagttcatgttgatatctaaatacaagtatttggacagattccccaagaaatactatttatttcttatgccagtagttactagagcagatactgaatatatctttctctgtctgtatattattaggcagatttctttaaactctaaactaaaacaaacaaacaaaaaactattgctagaccctggaaatcagataactgatttcatcaaatctacagaaatcaactcagctggtttgtggtgagataatttgttcctcacatgttcctttttcatagcatgttcttgtgcaatatatgaactaacattttttagaagcttgtgaaatattttctttgtggtttggatgaggaagaatgagatacagtgtgtcatagtagaaaagagaacaaacgtcaatttaatggaagattttttaaaagcttagtaattcttaataggatttatttctagacaaatatttcttcagtggaagccaaacatacattgactagttgataatttggtgaagtaataaaagataaacatctttctgtatggcagaaatctagaaaatataatttgacttatcttttgcagactttttttgatcaaatgaagagaaaaacattaatatacaaatcctttctaaaattgatacataataactatatatttatagtgtatgtgtgatattttgatgcatgcgtacaatgtgtaaggatcaaatgggggtaattgagatatccatcatctcaaatatttattatatatcatggagtgttgagaacatttccaaatcttctctcctacctgttttagaatataccataaattattgttaactatagtcaccctgctgtgctattaaacagtagaatgtattccttctatctgactgtaattttatacccattaaccaacctctcattggccccaccttcctatccttcccaacctctggtaaccaccaatctactctctactgctggatatatatccaaatgaatggaaatcagtatgttgaagagatgtcttatagcactattcacaatagctaagatgtggaatcaacctaaatgtccgtcagtggataaatggataaagaaaatgtagtatatatacacaatgaaatattattcagccataaagaagattgaaatcctgtcatttgcaataacatggatgaccctagaggacattatgttaagtgaaataagccaggaacagaaagccaagttctttttcggtttttctggctaagcattaattccaaaaatcttcctcattcatatgtaggcgtatataactcatcttttttattttgagttgtggctcttctggtttctctgtcgtctctagctcttgtacctctgattcacctaatgtctgtttacttaattaattagcatggaagtcttcaattctattaaattctgcttaattctgctttaattctgttaaatctctgcttctcttgctttatatccttttttttttaatgccctctttcttggagagagtaatcatttgactcagttcccataaataccatatgattctcaaatctgtctgcagcctgccctttaattattcatatttgtgcctttaccactggtacttgtgaatactgaaagtaactaaaaataaatgcattttaaaattctgtttctcagtcccagtagccatatttcaaatgcttaaaggccacatgtgactagtgtctaccatgttggacagtgcagatatagaacatttttgccatcttagaaaactctgttgaacagcagtgctctaaagcttattttgtttttacttgttatggtttgaatgtgtcctctaaagttcatgtgttggaaacctaattcccaatgcaacaatactgagaagtgggacttttaaaaggtcattaggtcatgagggcagagcccttatgaatggattattgccattgttgtgagagtgagttatttattacaggagtgggttcctgataaaaggaaaagtttggcccctttccactttccctcttgtgttctgttgctcttctgctttctaccatgggatgatacagcgtgaaggcccttgccagatacaggcccctacacctggacttcccagtcccgagaaccatgaaccaaataaacgtctgttgtttataattacccagtttgtggtattctgttatagcaacagaaaatggaccaaaactttgttttcttccatcccgccccccgcccttacctgtctgttatcaactctgctggtcatttttcccagtaaccacttggttatatttgattatttcacaattaattgctccttcatttgcactctaggtctttacttatatcttgttaaagaacagaggttggcaaacatttcttgtaaagggacagataataaataggcttctgtgttgtggttactcagttcagctgttgcagtgcagccatgaatgtggctatgttccagtaaaactttacttacaaagctggatgatgggctggatttggcctacaggccttagtttgcccacccttggtatagaactttaaaaactgtgttatgaatgttctaactatataaatatgctgaaaataataaaatgagtacccatttacccaaccaccaagcttcaaaaatgaaacactctcagtacagtggaaatctcccaggtgacccctcccaaaacatctcccttatgttcaacagattgtaactaccactctgacaatagatagtgttgtcttagatagtatcatgccctgtgatattatgcaacttgcatttttctcactcaacattgtatttgttgagattcatttgtatgaatttttaactttctttgttatctttgctatatagtatttcattgtatatatatatcataaataacttacccattttcttttcttttcttttctttcttttttttttgagatggagctttcctcttgttgcccaggctggagtgcaatggcacgatctcgtctcaccacaacctctgcctcctgggttcaagtgattctcctgcctcagcctcctgagtagctgggattacaggcacatgccaccacacccagctaattttgtatttttagtagagacggggtttctccatgttggtcaggctggtcttgaactcctgacctcaggtgatccgcctgccttggcctccaaggtgctgggattataggcatgagccaccgcgcccggccataacttacccattttcttaatggaaattttagttgtttattgttttactgttacaaacagtgctgttatcaacagtcttgtacattctccctggctcacttgtgctagagattcttaagggaatatacctagaagtggtatgcattagaagctgtacaaaagagtgccagcttacaatccttttattgtacctttcagcattgtttgcatatcatttgaagctcgggaagcatttgagtttgtactaggtgataggcacttggtgatacagagatgaattggatgtgatccatactgtcattgagccagaaacaaggttattctctggtgccgcccacaaggggcttatggaatatggggtaatagattctttccctgctacattggttattttatgattggttccctgtgactcagaaagataaaattaggatgcttcttgtaagtctttaccaaacttctaaagtaattatttcgaaatatttttagcagttgaacaactttttaaaacaaactcctacatggaatctttatatataaagcagataaaagggaagttatttggttaaagtttgtgagcctgtttcctctttgtgtgttttccccactccctatacctgcctgtgacatcctctactttcccatggttcctaaggcatcaggctgaatactagggcaccttgaaatatagtttggaaagaaatgttctaagacaggattttccaactaccaaatttcttatagaggtctaagctttacctagatgatcttaattttagagttttttgaggtaaactcataaaaatataaatcaaaacatggtaatcagttcacatccttcagtggacaggtctaacaggtaattgaatattctcatttcagagtttaatttaatgtcttgggctggagaatcaacaatagatgaggggtactgaagcagagaatacataaaactattaacgagagtattgtatagggtgacaagaggcataagaagaaaattttaaagagattaactctttttaaatcaattttattgaggtacaattaatatacaataagatgcatctattttaaaatagggttggttgagttttgacaaatatgtataaccatattgtcactatcataattgcaatcaatatctagaatatttctatcctcccaaacttttatctctcgttcctttgcagttatatttgatttccgttgctatgtaacaaatcaccacaaacttagacgttttaaactacctccatttattatctcacagttctgtaggtcagaagtccaagtaggcttagccaggttctctgcttagggtttcacaaggccaaaatccaaatgtcaccttggctgcattcttatctggagattctggggaagaatctccttccagggtcattcaggttgttggcaaaacccagttccttctggttgtaggacttaactctgttttcttgctggctgtaggctggggtcattctcagctcctagaggtgctctcaggtcctttgtacataattctccattaccaagccagcagtagtgtgtccagtcctgttcatgttttgaatttctgacttttttgctactagctagagaaaactctgcttttaaagattcatgtgattaggtaatcgcagataatctcccttttgccatttaacgtagcataatcacaagagtgattatgttctactgacactcaaaggaaaggggattatacaagggcaagggtcactgggatcattttatagttctgtctacttcagcagtcttcacgtattttgttaaatttattcctaagcatttcatatttctcaatgttactgtaacatttaggttttaatttttcctttcagttctttttattaatatataaacatatgattgatttttatattttgacctgttccagttacttatagtgttactctgcatgacaaatgactgtaaggctcagtggcttaaaacaacagcatttagtttgccttcaagtctatactttgggcaggggggtcagtagggataacttatctccgtaccactcacatcagctagagaaactcaaatgtgaaggttgaattctgagggcttgctatctcacgtttctcattaatgctgcctattgactcagaccttcccgaggctgtcagctggagcttctgcacttggcttcttggtattgcctttctcacaatgttgtggttgggttccaaaggcaaatatgagggcagtgggggttaggggtatgttttgtcccattttgtatacctaaccccaaaattggtgttaaatgagtgagaaaggagaggttcagcggcctttcttcatggaagtcttttcttcatagaagaattcgcatctcaccaggctttgtatgtgagtgggatgtcggcaggctgtggcagcagacagtggcatttcacagggatggacttttatgaaaaggggagtgaaagtaatgcacagaagaaaccagtggctccattaatcttggagagagccatgagagtgctagcaatagtttttaagtgaggttgaaaaaaatttgaccttgaggaaagaattctaaaatgccactaaagtagctttgattttttaaaaccaaccaggttaaaatgtgaacacatgattatttgttatcttagttttaaatgcagttttctataacacatgatatttttccattaccttttattgtagggcttttagataaaagacaattttcatacattagaattgtaagtatttttactcactggattgtagactgttaggttttggtagtgttcttagattctgtaatatttattgttggttaaaaacttgaggtggtgagcactgttagcattaattttggggttaagaaaggaagtggtatatgtattatctgttcaacattcttagccatttgtggctttagtgagttttcttgctttatcagtcatttatcaagtacctccctctagttttctttttcaaaccactttgaaacagcaagttgggttcattttactggtattctgatgactgttgattgtggttctcaggctgatgtaatcatgtcacaaaatacaataaagatgatattccatcactgaggtgcttagtcacagattaaaatagtccctggccacagacaagtctttttctgagcccagtcccctattcctgtaataatgagggtcaggtctcacttgtgtgtatttggtcgtgttgtacctagcataaccaatgtgtgtgtttaaacttcatccaataaatcacttaagcctaagaattttgcttctttatcacaaataacatagtgtggagtttgctgaactctattttcagacatggctttataatttctgacttaattgcatgttaagccattttatttgttttcttattaaattaactagtcaaaacataccgtatttcattgattctaacatttgggcttttttctagtcttttaatgttttttatatcttcgatgcttcttgtattctgtggtgtcttaaaggaggataattttgcctaaagttccactttgtgcaaggcacacaaagaagtaaggaaatgggacaaatactctctaccctcaaaaaattaagacaaagattcatctttttgtctctgtccctctcagtgtttttctctttctttctcagacacatactctaaaaaattaactgaggtggcaaaacctaaatgccaactagcttttctgcacagttctaatccgatttttattcctgatataaataacttaaagccaaattaaattaaatgaaaccattctaacatgatccaagagggagaaagtctgtaggtgaagataataaacattggaatgcagctccgtctctcataaggtttttgaagggagtaggtagactgttaacactgattttgacatggctacactggacagttcaagtattaacttagtgctgacaatgaggaggagacatctggagtctgagaagaccagccacctaagtgataccccaggtatactattttaaattgatttcaaagaaaatctatatgaaaggtagtagcatatgtatatatgtgtgtatatcattaaaaccatgtttttcatataagatgaatcactggacaaagccttaatattattacctatcagttttgaaggaaaggataactgggttttatttttgttttgtttaccaatttatagaaatatcttttaatgttactataataaaaccattaaagcaccaaggagaagtgttggtcaaaggatgaaccttgggtacacagaagcactgctggtctctggagtgaggatgactggtcagagcatcctgacttctgtaagcaggccttatgctcatggggtatatagtttatagcctttaaccctgccaagaacagagaaagtttgcagggcttctgaaattccatgccagcactatcattttggaaatcagaataaccccccatttatggatattgtaatttatcatctgtcagcataattggaaatatgtattatttggcaagaagagttcctcttcagggctctccattaagatacatgtgccacagttattctgatcctatgtattggaatcccagccctggttagtcctcatggattatctttcaatgagacatcaagacataactacaggtaagatagcacatctgaaaaatagcctctggagaggagtaaccgtttctgaacaaaagcttaggtcaacctgaaggtattttctaggaaacagaatgataaattatagtttcaaattaaaaggcaaagatctatcagtcttaaggacagagtaccagtgttatttatctgtaattattttcatttgttcagaaagtaattttggagcatctacattgtaccctacataaaaccttcagtggcttcttatcgcccttaggataaaattggaaaacctcaagataattccaaaggccttatatgctctgttctctgcccacttctttttttttttttttgagacagagtcttgctctgttgcccaggctggagtgcagtggtgcgatctcggctcactgcaagctccacctcccaggttcacgccgttctcctgcctcagcctcctgagtagctgggactacaggtgcccgccaccatacccggctaattttttgtattgttagtagagatggggattcaccgcgttagccaggatggtctcaatctcctgacctcgtgatccgcccgcctcggcctcccaaagtgctgagattacaggcatgagccacccgcacccagcctctctgcccacttctttttaaaaaaaattagatataattcacataccataaaactcaccgttttaaaatgtaaaattcagtggttttattatatttactaggttgtacaaccatcaccactatctcattccagaacatttctgttatcccccaaaaaagctctataccccattggctgtcattttgtgttctccctactccctagttcctggcaaccactaatctgctttctgtctctgaattttcctcttaatggtcatttcatataaatggaatcatacaatatgtggcccatttgtgtctagactgtttcactttgcatgttttcaaggttcattcatgttgtagcatatattagtaatagtactttatttttttttgtacctgaataatagtcatattgatatggatataccatattttgtttacccattcaaaagttgatgggcatttgggttgtttccacttttcggctgttaccagcctatctctattctcatctatttcccccactacacaagggtctttttacatattgctcttactgcctaaaacaatccctctcttcactatcctcatttactttcttaactttttttttttttttttgagacagagtcttgctctgtcgcccaggctggagtgcagtggcgcgatctcagctcactgcaagctctgcctcccgggttcacgccattctcctgcctcagcctcctgagtagctgggaccacaggtgcccgccaccaggcccggctaattttttgtatttttttagtagagatggggtttcactgtgttagccaggatggtctcaatctcctgacctcgtgatccgcccacctcagcctcccaaagtgctgggattacaggcgtgagccaccgcgcccggccactttcttaactcataatcagggttcacatcccagtccaaatctacttctttagggaatccttcctcaaactatatcatattcctctattatattttcttctagcgtcaggtttttttccttcaaaataatccttgtaatttataattatatacctgattgtattgtctctttgccttttcctcctacctttagtgtactataaacttcatgaaagcaaaattgtgttttctgctcacaattgtatccctggaatctagcacagtaactgacatatatatctgttgaatgtattcatgcaggaatctgtttgcatcattaagtactagggacacaaaaatgaaaaaccagtctctttgcagggagcttgcagtgaagctatgcaggcaagtaagtattttgtaagaataaatgctgtaattcccgtattagtataacaaagtaatatgctcagtttagtccgggtgtggtggttcacacttgtaatcccagcactttgggaagccgaagcaggaggatcacttgagatcaggagttcaagaccagcctggccaacatgacgaaaccctgtctctactaaaaatgcaaaaattagctgagtgtggtggcgggcacctgtaatcccagctactcaggaggctgagacaggagaattgcatgaacccgggaggcagaggttgcagtgagccgacatcgcaccactgcactccttcctgggcgacagagtgagaccaactgaaaaaaaaaaaaggctcagttcaaagaagaataataaagtgaacatcttccttcttgccctgtagatgtatccatcacgctggtagttatattaaatgttcccatgcttttctttattgttttattacacaggaatttatccataaacaatgttgtttatcttcttctcttgcctcattgttactttatgtgaatagaatcatgtttcctgccgatgtttatatttttgagattgtatctatattgatacatagaactgtagttcattcatttcccctccagtattgtgttctgttttatgactgtattacacacagcatggattaatcctggtcatgaggtagagcaacagaatcttatcacaagagatgacatactgtgtgattctatttatatacttaagaacatgcaaaactaatctgtgctaatagaagtcagaacaatggttatcttgggtgaggggtgtacatagaatgggaaagagtgccttctgaggtgttggaaatgctctaaatcttgatctggatggtaattacccaagtataatcacattgaagacttatgaagagtcacatttacatgttatactttaacaaaaagtttcagaaataaatacatgaaaatattgagttttaaaaaaatactataatggcagtatgtacaaatgtaattagaacataggaaatagaaggaaagtcacaaaaggctttatagaagtagcttttaagttaagacttattttgtctcacctggtagaatgtaaggcattgaaaggaggaactgtgtattgtttcctactgtgttttagtgcatagaagagcgctcagtaaaaattcatagaattgaatcaaatttagttttcctggaagacaggcaaatggagaactttccaagtatagaggcaacaataattctgggctacagatagaagtagttcaatatttctacagtataatgtacagctggagtgtagcaagagatgaggctggattctaggaagttatatgaatggggttgtatccactgttaagaattgttctacaggcaatggggatctatcaaagacctttgaattaagaagtaaaatgattggccaggcgcggtggctcatgcctgtaatcccagcacttttggaggccaaggcgggcggatcatgaggttgggaaattgagaccatcctggctaacacagtgaaaccccgtctctactaaaaatacaaaaaattagccgggtgtggtggcgggcgcctgtagtccccgctactcgggaggctgaggcaggagaatggcgtgaacccgggaggcagaacttgcagtgagccgagatcctgccagtgcgctccagcctgggcaacagagcaagactccatctcaaaaaaaaaaaaaaaaaagtgaaatgatcaaatttacatgtttggaaggattactctggcagcaatatgaaaggcagatactaatagcaagaataccagtaaggctattaccataaagacctggggctgtgggttgtaaaggagaaagaggtagattcggaagttaacgcagaagattctgctgctgatgatgatgatagaagttaacatgaagagagtgcttactgtatgtcaggaactctgctagactccagacgaaaaggcaacaaaaacacagcccttgcccttaaggaatgaagaaggcagatgtgtactgttagaggcatgtacacagtgtggtagtagcacaaaggggaaggaataaccaaccccatctcagggagtaaagaagacttctcagacgtggttacatttgtgttgggtcttaaaagatagatggtataatgacatcaaagaagagttataatgacatcttaagcaaagggaagagccagtgcaaagacaatagtacatgattcgatgtgatgagaacataagattggaaccatcaaccagttgttcattttcctgtacatattgcactgattttttatagtcaggatatatttgtttttgtttctttaaaagtaattctcttgatttctgttacatcatttcaatctttagagaaatatttgaatgctgattgtgtcatccataatattaactatattatccatgtttgtatcatccataaatttgataggctttcctactatttattccttcagggattagttaagtcattgaaatggatagagccctctggttacttggtaagtaaagatctacttccaagtttacccatctattaattagccattgttattcaactgtgaaatctattcatgacacagagttgtcatctaatccagggtccccaaccccagggccttggacctcagcagtccatggcctgtgaggaaccaggccgcacagcaggaggtgagccgagggccagtgagcattactgcctgagctccacctcctgtcagatgggcagcagaattagattatcataggtgtaagaaccctattgtgaactgcgcatgtgaagaatctaagttgcacactccctatgagaatctaatgcctgatcatctgaggtggaacagtttcatcccaaaaccaccccaccctacccatctgtggaaaaattatcttccacgaaactggtccctggtgccgaaaaggttgggggctgctgatccaatccacatttttttcagtcttgttcttaatcacacacagcataatggctaaagaagagaagtttttttgagcaaggcaaatttggtttgactcctggtttcactgcttaccagttttgcagccttgggaaaattatttcccttctgtatgcctcacttagctcatctgtaatatgaggctgctagtaagtatcccagattgctttaggaaatctaaatgagatagtgcgtagtaaatgctcactactttgccaggtatatagtaagcacatagtaaatggaaaagtagtcatcatcattattgctattaataagatgttatttaattttaaaatttttattgagggtctactatgggcctaacactgttctggatatttgaaatacatcagtgaaacaaagacaatatttttttaaaaacacacgtaaagtactgagtatatgctaggcactgatctaaataatttgctttcattagcctaccaactctctgtagtaggtgctattattatccctcttttaccaaagaggtaaccaaggcatagagaggtaacttgccagctcacacaggtaagcagttaagtggtagaactggagtttgaactcaaccagtctggctccagtgtgccttctcttaaccactgtgtaatactgtcactcatccagagtcacttccactgatgcctgctgaaatcaagatatttaacttttgtggcagttctgtaatctattgactctaattgcttaaaaaaaataggagggacctttgtgatatcattttggtgtgatttttttttttattttaacctgtgctggctcctgatgattattggtattttttaaattacaaagctatttgtttaaccatcttttccagaatttgataggaaatcacattaagcttacctctctgtcatttgttttacataaagaacattcttagtttaaaaaaaaaagggggaatttagttcatatccttagttgacaatggttgaagaaaaacatctcaaaaatcacttagtttatataaagtatattttgtaaactcctgttctttttacagtgaatatcaatcgcttataccagaggttctcaaacgtttttgtctcaggacctctttacactcttaaaaattattgaggaatcaaagagcttttgttgatgtaggttatacttattggtatttaatgtatttgaaatttaaactgagaaaatttagagacacaagaatgcccaagtacagatttcattagctgtcagagcgattgcatcatcacgttattcagcctctagaaaactataccacatacttgtgaaagagtgggagttaaaagggcagacaatgtcttagtattataaaaataactttgaccccacaggtcccctaaaagggtctcagagattccccccagtggtcccttgatcttaccttgagaacctctgccatatactaaataaacttattactgtcttcagttagaagaaactctaagactaaaattgaagatctagaattgaatatttcaatggaattcttaggtttcaataacaatgcttattaagggttatctaaatgtattagatactttcagggatgcagagatgaaacaaatacaacttcttttctccaagagctttcttgttacgaaatgtggcatttacacatcgagttgaaatagagtgaaaaggggtgacatgtttgttgtcacagtaaacaaactacataccactagactcacctttgcaatttataaactaagttacataattctataaaatatttttgactattgatgattctcttgacatgtgattaactataaacaaaaatgacagcaatctttagagatcattgcattttgctttaggctagtatatttaataacttgctctgaaagatttgggcaaacagggtagggaattgctgtcttcaagtcactttagattcatttctcaaaagtatccatttctgaactacacatccgcatttaaaacaatagtaggccaggtatggtggctcacgcctgtaatcatagcactttaggaggccaagacgggagaatcacttgaggccaggagttcaatatcagcctgggcaacatagtgagaccccatctattaaaaacaacaacaacaacaacaacaacaacaaaaaacttcttaaaaataaaccaggcatgatggtacacatctgtagtcctagctacttggaagtctgaggtgggaggattgcttgagcccaggagttcgaggctatagtgagctatgatcccactccagcctgggcaacagagtgagactctgtctcaaaaaacaaacaaaaagtactaaatacagagaaatacaattcaaaatgacctagaaacacctggatttgatatacttgtagagcagctaagaattgggagggcagataccacattttaaaactgaatattaaagaataaaaacagggtgaaaagtcacaatgttggcgatggaaagcattaggtttgagcagtgctaaggcagcctcacatgtgtgttacctccccattcctaggtcaccattttctatttaccctactctgcaaccactaaaaagtgctttagatcaaaagtaggaaaacatagtaagtgagaggtatgtgtgcctctttccctaagcataatttactttctctgtcttcacccccaaatttctggctcagtcttcttatctacaacttgggaattctttttattaaagcctttctttacctgtattcttattatcagagtgtatttcacaccctggggttctttattatgccctgtcccttgccccataccctttctccacatcaactcccaacattatcaaagcagagagaactttctggtggctaacagaatggatactattttactagaaatctttgtaactttaaaggaatgggaatggcaaataggtttcagtttatgtgtcagttgtaagaaattaatagcagctgcatggaacactggaccaagaagtattatgaaactgctaggctcaagtgccataatccattatcagtcactgtcataggtgtgagaagagtgaatgacagcacatggactccacatttgaagccccctgacctagcagatctctgcctttgaatccatttaaatccaaaggagcagcagactagagcatatattccatatgatatagtttggatatttgtttcttccaaattgcatgttgaaatgtgatccccagagttggaggtgagatctaatgggaggtgtttgggtcatgagggtggatccctcatgaatcgcttagtgcccgcctcacagtaatgagtgagttcacatgagactggccatggcatctcccctcccaccttgctcccttgtgacatgcctgctctgccttcgccttccactatgactgtaagcttccagaagcctcaccagaaatagatcctggcactgtgctttttgtacagtctgcagaactgtgagccaaaccttttttctttatagactacccagccttacatattcctttacagcagtgcagaacagattaataccctatattaatatgtgtttgaagtgtgtaggtttcttcctatatatctgtgcttttaaaaccatcttcctcaaagttagactgaggtcagtgcattgaaatatctgaggtatattgatatcacacatacacacacacacacacacacacacacacacaccctagaaacttaaaatcagggaaatttgaagtatagttctacctctgctcatcagcatataatgtacatgatctgtcttgatctcagttggaccagtgcctgacatttaatattaaatacttctattgctcctttcagtaaacacatagaaagctattgggagcaggtgcgttgaaatgtctatcttagcaatttattgaaaccaagcccacattgtgtggagactttttatttcatgtggcacctgactgactgtagaagcaaccctaaattgacggtctcagagtagactgagcctttctgactaaaaagactgtggggccaggcgtggtggctcacgcctgttatcccagcactttgggaggccgaggcgggcggatcatgaggtcaggagatcaagaccatcctggctaacacggtgaaaccccgtctctactaaaaatacaaaaaaaaaaaaatagccgggcatggtggcgggcgcctgtagtcccagctactcgggagactgaggcaggaaaatggtgtgaacctggggggtggagcttgcagtgagccgagatcgggccactgcactccagcctgggcaacagagcgagactccgtctcaaaaaaaaaaaaaaaaaaaaaaaaaaagactgctggatatatgaagtggaaaagaaagaataacagggaaaccaggattgaaatttctaaaatgggtaaagagtattgacagaatcatacagaccatctaagcctgtgaatctcaagtggcttgtctctcctcttgtcctcccaagattctgatatgtaaggagatgtgtgtcccatgcacgcatggatgtacacacacacacacacacacacacacacacacatatcttactgatgagtatatgtaatatcctgtaggagtgccgaagcaagaaaataattgagagacttatctattccagtgcttctgtttccatagatggaaatgggtaagttgttttggcagactagaatgtccttttatgaaacaagagtctgaattttgtgttactgtttatttttttcaacttttaaaaagattatttcttagggagatttggttaaaatagataactttttttcttaaatctgattacttttaagtgactatagataaaacttgggaaggagataagagacctttctctgaaggtagatttttaataaaaggagaaagtggaattggtgaacttgaggtcgaaactgatggatcagtataggaaaatattgaaatactcacttattagattttgttccgtggtgtttacatatagaatccaacaactgttttttgttgttgttttgttttgttttgtttttttgagatggagccttgctccattgcccagctggagtgcagtggtgcgatctcagctctctgcagcctccgcctcctgggttccagtgattctcctgcctcagcctcccaaatacctggtactacaggtcagcaccaccatgcccagctaatttttatgtttttgatagagacagagtttcaccacattggccaggctggtctcaaactcctgacctcaagtgatccgcctgcctcagccttccaaagtgctaggattacaggtatgagccactgcacctggccagaacttgtcacttttgcactctagtccttagctccaaaggttttcctctgacttgatttaaagcaagccatctttcccctttgtaaaatagtgggaacacttattgctgaggttttcatgtgaaatgaagccaaaatattttaagattacaacagagtacattaaagtagttaaatggtgaggtaagagtcgtgtgtttagacatatatgtatctgtagattcagatattgtatacatttatcattcaatagaaatgaagaataggtttttatgttaactttttaaaataatttatgtttatataattccaaacttgtagaaaaattgcaagaaagtacaaactcctatatgccccagttaacattttgttctgtttgttccctctccctcactatatatttatgtgcttgtgtatatataaatatctatatccattatcattattctttttctgatccatttgagagcaaatcgtgaacataatgcctcctcacctctcaatactccagaatttatatccgccatgcaagattactcccttacctagctatccaaatcaggaaatcaacatcagcagatactaccatccaaaccacagacccaatacacatttttacgagatgttccaaaaatatcttttttatttctgacttgagatccaatccaggatcatttattaaatctagttgccatgtctctttagtctccttcaatctagaagagttcctcagtttttttccttttatgactttgacagttttaaagagtagagtccttggaaccaacccaaatgtccaacaatgatagactggattaagaaaatgtggcacatatacaccatggaatactatgcagccataaaaaatgatgagttcatgtcctttatagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagctgacgagttagtgggtgcagcgcaccagcatggcacatgtatacatatgtaattaacctgcacaatgtgcacatgtaccctaaaacttaaagtataataaaaaaaaagaagaaaaaaaaaaaaagactagagtcctttgattctgttggatgtctgtcagatcatgcattcttggcagaaatacctcagaaatgatgctgtgtcttctctatgtatcacatgaagaagtgcatgatgtcaaactgtctcacccctggtgatattaatattggtcacctagtcaatttggtgtcttctagggttggttttttttttttttccactatgaaatcatcatttttcccctatgcaatagtgctatggtctgaagtttccccaaaattcatatgttgaggtcctgacccccaaggggataatattaggaggtggggtctttgattaagtcatgagggcaaaattagtgcccttataaaagaagtcccagagagacctcttgccctttccaccacttgagaagccactgtccatgatccaggaagtgggccctcaccagacaccaaatctgctggcgccttgatcttggatttctcagtctccagaagtaagagaaattaatgctgttgattataagtcaaagttgattataataacctgttgattataagtcacagtttatggtatttcttgtatcagcctcaacagattgagacaaatagtattttgtggggagactctgccaatatcctgttccttgtcagacctccactcaccagccttagcatactttgatgaaaccctcctgaatcaaccacctttatgatggttgccaaatggtggttttctattttcatcatttcttctacttttcttagttggcattctaatggaaggaagaagtttctattctctgccatttatgtgcttgtttatttatttatatcattatgtccatggatttctgttttattcaatggattgaaatttgttactcttactatttatttttacgctcaaattgctccatacttgactgataggagtatgtccccattgttctctgagcacttcctctctggtgcaggatgttccaggcttatcatgtactttctttgccccaattctggaatcaactatttccccaagaacccctgtttccttttagtggaggatgatatttaaaaactaagcacttggtgtgctcattgcttctgtgtgctattactttgagtccgtagtgggcagaactaggaaatatatgtatgtatgcactgtaatattataatttgaaatacatgtttggtctctgcccccaagttcctggcacagagctcctaaagcccttgtagataaggggcactaagagaatcttttgttcctatatttggtctctgaccccagttcctgtcacagggctcctaagacctttctgatttcctgaatgataggagtgtctgacacagagctcctaaatcccttggagtttcctgggtcataggagaatcttgtcttaatgaagtaactcttagtgggctcctgaatagcgtcaggatgggggctggttgccaagggatccaaacatgattaaagggttggaacttttagctccaccccacccacctacttcagagaggagcttaaagggtgacttgatcaccattagccagtggtgtaaccaattatgcccatgaaatgaagcctctatgaaaaacccaggacagggttcggggagcctcctggagggtagcccacccagagagggcatggaagcctcacatgccttcttccataccttgccctatgcatttcttctatctggctgttcatctgttcctttgtaataatgttttataataaatgagtaagtataaataaaatgtttccttgggttctgtgacccactatagcaaactaatcgaccctaagaaaggtgtcataggaacgccaatttttagctggttggtcagaagtacaggtcacaacctgagacttccaattagcatctgaagtggggagcagtcttgtgggttagcagtctgtgagacctgacgctctccaggaagagagtgtcagaattggactggaggatgtccagctggtatctgccagggaattgcttggcatgtgggaaagtccccacacatctgaagtcagaagtattgtgttgagtggtgagtgagggtagaaaaagcacttcagttttttcctatctttattacatatacatacagccagatctgtttctgtatatatctgtgtgtgtgtgtgtatatgtatagatatcaattcacattgagatgtctgatggcaggttcaatacttcaagattctttgtagccttccccctttctatgtttgtatgtaaatatcttccttaccattgataaatctggctttcatcatactcaatatattttcttaatctctttgtacactactcatctcctgaccagcctggttacctactcagcctttgatttttccctcccaaacttgctactcttttgatcttcccaatttcagtaatgacaactatattcttggaattactcaagctaaaagtattagtgtcatccttcttgccccactccaaacccctcattcatcccattaataattcctttaaatagaatgattttttggctgggcacagtggctcacacctgtaatcccaacactttgggaggctgaaggggaaggatcgcttgagcccaggagtttgtgatcatcctgggcaatgtgagaccccatctctacaaaaaataaaataattagccaggcatggtggcatgcacctgtggtcccagctactcaggaggctgagttgagagaattgcatgagcccaggtgtttgaggcttgcagtgagccgccatgctgtgccactgcactccagcctgggtgacagagtgagaccctgtctcaaaaaaaaaaaaaaaaaaaaaaaaaaatccccacatctactgctaatattctaataatctaagccaccattattatctttgcatgtactttagcaagattcttctaattggctttctactcccacccctacctttatgtctattctctgcgtaatagccaaagtgatccttttataacctaagtcagattatgtcatttctttggtcagaacctactagtggcttctgttctcactaaatttaaaattcagaattcttatcaaagtcctaggtcatctactatcccttccctcactgtaatttaatcatattggccttttactattccacaccaagcacattgtcacctctggactttcacatgtgatgtttcctcaagcaagctcttaatgccagagagccacagaactcgatactccctcactccattcaagtctttgctcaaatgtgactctaacagtgaggccttccctgactacacaacataaggcggcatcttttcttcattctctatttcttttctttgtttatgtttattgtatttattacaacctgccataacatttaagagcaagagtttttgtgttttttttttcccccatgcagtgtctccagtacctggaataatgtctgacaaatagtagactcttgataaatattttgttgagtgactttttatggattcatgttcaataaattcatgtggttgaaattgatttaggtgatatattagcagtatcttttatatagctgtaaattagatgatgttttacaaggagtactagtgtcaaataagctctcaactggccttaagagagagaatttattttccaaatgtagatatttcagaaagcagaattagagattaaagattttttgaaaaagaaattgtgaaaaaggaattttgaaaaaggaattgatgggaagtatactcatcaccagcagtaggtttctggagatctaagatctggagtttacctcactaccttagtttctaatgcttgtcatgctttctcaagaccatttctcaaagaatgttcctcttctctaactataccttttctttctgatccagcactgttaggcatctcatgttttctggtgtgttttacttttcttaatatctaatactatgtttattttattttctattggagcacaataacttcataaatatctcttattctttgcactttcagtaacaaaattttttcaagtcaaagtctgccagcaccatagaggagtagttgtgtttgcttcaggattgtctgaggctttaaagcgggtgaactgctgaccttgaggaaaagcagataattctatcaagaaagcctccctccaggagtaggcttttattgctttattatatatcttaaactgtaagatcctgtttcttcacctgtggaaataaggtgaacaatatccttttcatgaattgtaaatatgtgtaagtgcctggcacatagtaggtgttctgtaagtattcatttatctttcttccttcccttatcttccactaatccatataacttaatgtctcatctctaccaataagctcttatgtatcttaaccaaattttcttaccaaaattaactataggccaggcatggtggctcatatctgtaaccccagcactttgagaggccgaggccggtagatcacttgaggtcaggagtttgagaccagcctggccaacatggtgaaaccttgtctctactaaaaatataaaaattagctgggcgtggtgacacatgcctgtaatcccagctactcaggaggctgaggcaggagaatcacttgaacccgggaggcggaagttgcagtgagccgaaatagtgccactgcactccacactaggtcacagagtgagaccctgtctcaaaaaaaaaaaaagatagtcaaacttggtgaacacaagcaaacaaaaaagtgtatggaattgtttttgctctaaaaatactagagactaatactagattagtgttttccttcataggccatatatatctttctggtattaagatagagaagagagagttgcttcatctgagtgaccaagcaagaccaatataagttaaagtacacagggagtttccaagcattaaactcatgggtgctcttcctgtctaatcttgtcttcatttggtaagacatatgcagacctaccatgaagcttcagggaatttttgattcttgccaaaaataaaaatgccctgaagtgtgcctgttgaaaatgccaacaatatgtagattctgaaagttatcttgtaagtgaaagaaagagtatagctgttacagtattcttgtcaaataggattttccctaagttttatgggagtaaggactttctctgctatactgaacgctagcctcatttcctcagcaagcatgattgatctcagttagatattaagaatttataaagagattgtgaaagggtaaacctcaaatcaatgggaaaataacagattttaaaagtcatgacattgagactcttaggaagaaaaattttgtttcttccatcaaaccaggccaaagtaagttataggtttgttaaagataaatgtaatagagaaaaacatgggagaatatttatctgatcttagtgtaggggtgagatttttaaggattctagcaaaggcaagcactatatgggaaaatggtgataaattttacaatcccacagttcagaaatgtgtaataataacaccagagcaaacatttattgagctaaatgccaagccttgtagtaagtgctttacgtataagtcagtgccaaggttgagaaactctgccctagagctgcgtaatctgtcgctctcgtttgctgtgttatcatatgccagatgttttgtcatagtgtaacaaggtttaccagcttcccaatctgcagcatctgtttcatcactgcttacaactctgccacttaacagatgccacctatattagtttttttgttacagcaatatcctacaccagatactaatcctgtattaattaggataaaggctaaacaattagaataggaagacccaaaatgcagtggttcacaaaagataggtgttaattatttctaatgcaatggtttggagtagataggtagcatttgcctcatgaagttattcagagactcagatagcagggtagtccatcactttctctcatggcctggctaaacctgtgtcattgatttatttgagttctagccagtggataggggaaagagagcatggagaagacacacctattctcttaagatctagtccttaaaggagcaaatgttacttctgttcacactgaattagagagaattagtcacgtggtcaatctcacagcaggtatggaggctaggaagtgtagtcccacagcatgtgcccaggaagaaagggataacatttggcggacaacaacaaatagtttccaccgcaactactacctgtgctgcctctaaatatctgagaagccaaatgataatgtgggagttaagtattcttataaatgaaaaattaaaatatcctaaaagaaataaggaaaaactacaaattcagttttaaaaagggaaatacaaaagactactaatcatacatcagtagctgattgtcaacaaaggtactaaaacaattcagtggaggaaagaatagtctttcaacaaattgtactggcacaactgaatatccacatgcaagaagaatgaagttggacctctacctcacagcatatataaaaattaattcaaaatgaatcaaagacttaagagctaaaactatataaaactctttgagggaaaaaaaaaatgcaagtctatgttaacttagaataggcaacagtttctcagatatcaccaaaaacacaagcaaccaaagaaagaatagacaaattgcagaaataaaaacttttgtgtatcaaaggaatctatggagaaagtgaagacaacccacagaatgggagaaaatatttgcaaattacatatctgaaaaggatttaatatttagaatatataaagaagctttacaattcaataaaaacaaataacccagtttttttaaaagggcaaggattttaatagacttttttctcaaagatgagtaatacctttattcattaggaatatgcaaatcaaaatcacaatgaaataccacttcacatccgctaggatgactaaaatttttaaaaacagaaaataacaagtgttggtgaggagatggagaaattgggtgagaatgtaaaatggaacagccattgtggaaaaacagtgatgtgaacattagcatttggtggtttctcaaactatccaacagaattgtcatatgaccccaaaactccactcttagatttatacccaagagaactgaaaacaagtgttcaagcaaaaagttgtgtacacaaatgtttgtagcagcattattcataacaatccaaaggtggaaacaacccaaatgtccatcaactagtgaatggataaacaagatgtggtaaacccatacagtggaatattatcaaccataaaattgaatgtagtaatgatttatgctacaacatgggtagaccttgaaaacattgtgttaagtgaaagaagccagacacaaaagcgtatatattgtatgattccatttcatttgtccagaataggcaaatccagaaatgtagaaagtagattagtggttgccaggcacagggggagagggcactgactacttaatggctataaagttttcttttcttttcttttcttttctttttctttcctttcttttcttttctttctttctttgagatggagttttgctctttggtgcccaggctagagtgcagtggcatgatctcggctcactgtaacctctgcctccagggttcaagtgattctcctgtctcagcctcctgagtagctgtgattacaggcacccaccaccacgcccagctaatttttgtgtttttagtagagacagggtttcaccatgttggtcaggctggccttgaactcctgacctcaggtgatctgcccgccatgggcctcccaaagtgctgggattacaggcgtgagccaccacgcccggccaggtttctttttgtggtgataaaaatgttctggaattaggtaatggtgatggttgcacaactttgtgaatatactaaaagccactgcattgtatactttaaaatgattaacttaatggtgtgtgactaatatctcaataaaaaataagactagtgactgtgaaaatctagcatcccaccagtaatcaaagaaatgaaaattatgctgggtgctgtggctcatgcctgtaatcccagcactttgggaggccgaggtgggcagatcacgaggtcaggagatccagaccatcctagctaacgtggtgaaaccccatctctactaaaaatataaaaaattagccaggcgtagtggcgggcacctgtagtcccagctactcgggagactgaggcaggagaatgttgtgaacctgggagatggagcttgcagtgagccgagattgtgccactgcactccagcctgggcgacagagcgagactgcctctcaaaaaaaaaaaagaaatgaaaattatgacaatgttaatcttaattgtatccattaaaatggtaagttaaaattttgttaatacactcatattctattattgataatgtaaattgatacagttgttttggaggacttaattggtaatatgtatcaaatgctttaaaataaactatattctttgtctcagaaattatgttgtaagaatttattctaaggatataataaatatctattatgatatttgtctacatgcttgatgatgacaatgagattaaaaatggaaagcaactaaaatgttgaaaaatgaaacattcagtaattttgaagtaattgaaatgtttcataataagcagccaataatttatgatatccagtggctgggcacagtggctcacgcttgtaatcccagcattttgggaggctgaggtgggtggattgcttgagtccaggagttcaagaccagcctggccaacatggcaaaaccccatctctactaaaaatacaaaaatttgccaggtctggtggcacatgcctgtaatcccagctactcaggaggctgagacagaagaattacttgaaacccagaggtggaggttgcagtgagccgagatcgcaccactgcactccagcctgggtgacagagtgagactttgtctcaaaaaaacaaaacaaaacagacaaacaaaaaatgtatgatacccaaacgatgtcataaaaattatgttgtataagattataccattatagtgccatgaaaaatgttaacactgtattaactgattaaaatgagaatcataaataatatgtaaaatatagtcttgaatttgtttttaaagtctgttttataagttaatgttcccatatttatgtgagattacctgtgatttttgttttctttggatttttctgtatttaattttctttatgagaaaattatgttttcaatattttttttaactaatgattttatcacactgtaatttataatcagaaatctatgaactaacttttgggagatttaaagtaagggctgttccaacagaatgtgctggaggatgggagttcctacacgtccattaggaccagcaatatagtggtgtggctattaatctttcattataatatacccatttcttgctagactcagtgactctggttgattagttcattgcttagaataagatcttgtggtcaattcctatgtgagtcaagtaaacactgactttggctttagttctagtcagacaacttgtaagtgtgtatcacaagtcagaggggacactacatgggagagcataagtggatttttgtagatcaaccattgttgtgggaaaacctcttcagttctgctcctcttggccagatgtgggcctgagtgtgagtctggataagaagagttcaaacttctcttgtgacacacagcatttcttacccaggggaagtttaaataaatttgaacataaaacctaggtcttccacttggtttaaagcccttaactaagaaataagatatattggaaaatgcttcgtacctacagcattgttgttaagagatgttggccccatggggcatgcagctgttaaaccagagtgactcccagacccagtgatgtgagtctcattttcttggacctgaatctcacctggggcctgggaaagcaggctgggacacaaggagaatagctcttgggtagctgggtgagctattgcatagatggctgcaaagactagtcccacaaagaggggcacctggtgctgccttgttggcaggcagtcatttttgtcctacatccttgtgagtagtcttgtgaatatgaatgtttacttaagcttgaaaaatttccctaggcattatacttaacatcttgggactcagtttcctgctctgtaaaatgaaaatgttgtctaccttaaaggtggttgtaaaaagtagagttactgcacaaagctcctagaatataatagatattctgtaaatggtagctattactctgtttataccatcgtattttaaaggtaaaatatgctagatacttccacaatacctattttacagacttgcattagaggatattggcaggtattgacattttgagcattgtaattattgaccatgtaattgtctagttttttttaaattatactttaagttttagggtacgtgtgcacaacgtgcaggttagttacatatgtatacatgtgccatgttggtgtgctgcacccagtaactcatcatttaacattaggtatatctccaaatgctatccctcccccctcccccaccccacaacaggccctggtgtgtgatgttccccttcctatgtccatgtgttctcattgttcaattcccacctatgagtgagaacatgtggtgtttggttttttgtccttgcgatagtctgctgagaatgatggtttccagcttcatccatgtccttacaaaggacatgaactcatcattttttatggctgcatagtattccatggtgtatatgtgccacattttcttaatccagtctatcattgttggacatttgggttggttccaagtctttcctattttgaatagtgccacaataaacatatgtatgcatgtgtctttatagcagcatgatttataatcctttgagtatatactcggtaatggaatggctgggtcaaatggtatttctagttctagatccctgaggaatcgccacactgacttccacaatggttgaactagtttacagtcccaccaacagtgtaaaagtgttcctatttctccacatcccctccagcaccagttgtttcctgactttctaatgatcgccattctaactggtgtgagatggtatctcattgtggttttgatttgcatttctctgatgtccattgatgatgagcattttttcatgtatcgtttggctgcataaatgtcttcttttgagaagtgtctgttcatatcctttgcccactttttgatggggttgtttttttcttgtaaatttgtttgagttcattgtagattctagatattagccctttgtcagatgagtagattgcaaaaatattctcccattctgtaggttgcctgttcactctgatggtagttccttttgctgtgcagaagctctttagtttaattagatcccatttgtcaattttggcttttgttgccattgcttttggtgttttagacatgaagtccttgcccatgcctatgtcctgaatggtattgcctagcttttattctagggtttttatggttttagatctaacatttaagtctttaacccatcttgaattaatttttgtataaggtgtaaggaagggatccagtttcagctttctacatatggctagccagtattcccagcaccatttattaaatagggaatcgtttccccatttcttgtttttgtcaggtttgtcaaagatcagatagttgtagatatgcggcattatttctgagggctctgttctgttccattggtctatatctctgttttggtaccagtaccatgctgtttggttactgtagccttgtagtatagtttgaagtcaggtagtgtgatgcctccagctttgttcttttggcttaggattgacttggcaatgcaggctcttttttggtcccatatgaattttaaagtagttttttccaattctgtgagaaagtcattggtagcttgatgaggatggcattgaatctataatttaccttgggcagtatggccattttcacgatattgattcttcctacccgtgagcatggaatgttcttccatttgtttgtatccttttttatttcattgagcagtggtttgtagttctccttgaagaggtccttcacatcccttgtaagttggattcctaggtattttattctctttgaggcagtcgtgaatgggagttcactcatgatttggctctctgtttgtctgttattggtatataagaatgcttgtgatttttgcacatcgattttgtatcctgagactttgctgaagttgcctatcagcttaaggagattttgagctgagacaatggggttttctagatatacaatcatgtcatctacaaacagggacaatttgacttcctcttttcctaattaaatactctttatttccttctcctgcctgattgccctggccagaacttccaacactatgttgaataggagtggtgagagagggcatccctgtcttgtgccagttttcaaagggaatgcttccagtttttgcccattcagtatgatattggctgtgagtttgtcatagatagttcttattattttgagatacgtcccatcaatacctaatttattgagagtttttagaatgaagcgttgttgaattttgtcaaaggccttttctgcatctattgagataatcatatggtttttgtcgttggttctgtttatatgctggattatgtttattgatttgagtatgttgaaccagccttgcatcccagggatgaagcccacttgatcatggtggataagctttttgatgtgctgctcgattcagtttgccagtattttattgaggatttttgcatcgatgttcatcagggatattgttttaaaattctctttttttgttgtgtctctgccaggctttggtatcaggatgatgctggcctcataaaatgagttagggaggattccctctttttctattcattggaatagttttagaagtaattgtgttgttttacctccatgtcatgcaatagaagttaaagttggcagcatcacaatgaataatgattaaagtctgagtatttaatagtcagtttatcttcatacgttcttagtgtagtagtttacaatatttgaacatgccttagaacaaatatttaattatagatgtgctaactgaaacttcttgtagttaatgaactaataaaatatcaaaatacaatgtttatgtatcttattcagcaagtatttcttgaataaatactaagtgtgaggtatcattctgagtgcctcagtgaacaaaacagccaatataattttatattttaaatatgtaaaacactgaaacatatatgttcaaaagtcaaatagactgacccagggaattctcacttccatttctgtgcccttcatctccgtctcacctgtcattctcttcaatttccttccctttcattaaagctattaataaataaccaaggtaatatgaagttcacatttactgttttcccataatccatattgttctgtgctgtctttttcctgattcagtgtctcactaatcctttcctactcaaacctctccatcagacatcttggaattctattcagtagtcctcagttaatcctaactatagttgaattaagtaggttgaagttgaagtaagtgttaaatgtagatagtaaatataaaagtcagggctgggcaaagtaggtcatgcctgtaatcccagcactttgggaggtagaggtgggcagatcacatgaggtcaggagttcgagaccagcctggctaacatggggaaaccccatttctaataaaaatacaaaaaattagctgggcatggtggcacgcgcctgtaatcctagctactcaggaggccaaggaaggagaatcacttgaacccgggaggcggaggttgtagtgagccaagatcgcaccattgcactccagcgtgagcaacaagagcaaaactctgtctcaaaagaaaaagtcagtattaatgaatttgtgatttagccaggcatggtggctcacacctataatcccagcactttgggaagtatgcacctgtagtcctaactacttggaagcctgaggtgggaggattctgaagtccaagagtttgaagctgcgaactatgatcataccactgcactccagcctgggtgatagagcgagaccctgtgtctaaaaacaaaacagtgagatatgacttcacatcctctaggagagccataataaaaataaaataaaatgaatagcatagcatataccataacattctatagcatgtttgtcaatactttttaattttaataaagtatgtattttccatttgattaccaaagtaccagaagaaaatttgaaaagtacagaaaacctaaagataaattaaaataacttcacattgtaacagtaaaccactcttactgtcatcttggcatatccttctaatctttcctaggcatgtattacatatacatgtttcaaaattgttatacacgtaagtccttttattttttcacataaaatacattctgagctattcctgcctgtgttagcccatttacattggtttaaagaaatacacaaggctgggtaatataaagaaaagaggtttattttggctcacagtcctgcagactgtacagggagcatgctgctggcatctgcttctggtgaggcctcaggaaacttacaatcatggcagaaggcaaagtggaagcctgcatgtcatatggtgagagatggagcaagagaggagggagctgccaggctcttttaaacagccagctctagtgtgaacttatagagtgagaacgctctcattactgtgaggacagcagcaagtcattcatgagggatctgctgccatgacacagacaccccctgctaggcccacctccaacattggagatcacatttcgacatgagattttgaggggacaaaacattcaaactgtatcactgcctttacatgttacttgaaaatgtgattttaatgactgcatagtatttgatcatattaatatgccattaactttattacttttttatgcttttataaacttttttaatgctttttagtgaaggttcttttttacaatcttaatacacctctttgataacttccttaagatatctttttttgaagctacattccctggtcaaaaacaaagattggttaatacttttcatttggctagctgattgccctctgaaaagattatatcagtatatacttctgaaagcagtgtatgaaagtgcctatccttgcacccttgtcaaaactgtattttatatttaaacaaacgtacatatatgagcaacaatctggatgaaggtaaagaaatcttaatttttaattttttgcttactaacaaattgaacatttttatttcatgttgtttaaacaactcttctgaccagtgatgagttaaaagaaaaaatagatcaatacaagaacaaaacagttaatgataaagtaataataagtaatatattaatagagttgggagtctatattttatactaagcaaactgacatccaacataatttataatttgtatttttataaatataaaaattatataaattataatttaagtatagtttttatatcctcttagatactattttgaacgtgtgggattcagtgacttagcaaaggtttttatttgaggccattcattaattcataatttaacaaatatttactgtcattctatgtgtcatttactggggacacatagtgaacaagactcatgtggcctctggtcccttgaaggagaataaaaatattaaaatagcttatttatttatttttttgactgtcctaaattatgaggtatgaattttacaaactttacttatattagtggtaacagtggaactggagagttttgcgccttctctaagctgcccggcaagaaccaccaatagcatggtggaacatacggtcctttccaagcccatggctctttcggcctgtagatgtcagcccacacatctccctgtgcttatagactgctttggtgatccattgggtgtcaggatttcttctgatagctttatggaatggatcaatgaggataacctcaaaaaatttgtatgtgtaatcttcaccaacccaataagaattcaggactctaagagccccacagtggcatccagctcactcctctgcaacgcactgaaggcttcaggcaaactttagctgattaacaccatgatgaacaggcttgccattagttgcacccttaggaactgggcgttttctgccaccacggtgaacatgaatcctatatataatgtaaccttgcttggccttgcagcctggtcggcgcgctttatcaggctgggtggggcggggagccctgtggagagcagagagctggcagtactgccagcagctgactctcagaagaaagcgcatgacatgagactacttctttctccatagctcctggatgtgcgggtatgcacccatcttggcttacctgatggctactgccagacagaaaggaaaatagcttatttactatttattgccacatattatactaacctcattacatatattatttcctttaatattaaaacaatatttggtaactgcattttagaaactagcatgtttctaattaaacctgtttacatcaactaaaatactaacatgctttgtaaaaggcccttcagtattgaaagtgtagtgcattgtggtaagcataatataaacacacaaagccccatttagatattgtgaggctttcagtatttagaatctcagtagtgatgagtttaaaaggctaaggatgatggcaaagctgattccaacttggggctaaattttatttgtcctgcttctatggaattagacctgagagtcacctatggtaggtcacaaatgccttttcaattttgatttgcttgcattttctatacaggctgtaacactgccgcataaaacactaggggctcttgccagaggggactgtacaagcagtccacagatgttctcgaagaaactccctggaactttactactcggttatacaaagagccgtcaaggccaggcatggtggctcatgcctgtaatcccaacacttgggaggccaaggtgggcagatcacttgaggtcaggagttcaagaccagcctgacaaacatggtgaaaccccatctctactaaaaatacaaaaattagctgagtgtcttggtgggcatctgtaatcccagctgctcgggaggctgaggcataagaatcacttgaacccgggaggcgggggttgcagtgagcctagattgtaccactgcactccagcctgggcgacagggcgagacactgtctcaaaaaaaaaaaaaaaaaaaaaaaaaaaggaaaagaaagagccatcaaccgtcttcatagatttcctataagccagagaattttctcagtgatcaaattctaaccaagaaactgaaatgtattcatcaaacaggcagcttttaacatctgaataaatctctataactctctagagaaaattaagttataattgtagtaccattaaactgtggaacatggaagttgaaacttaatttttgtttaataatttaaaaaccattccttagaaaggtttttgaggcccaatctgttgcagccacaatcttaccgactgggggaaaaatgcttagttacaatttttaggggggaattactgtcatgctgctgagaaatggatcctgtcttttttgaccttccttccttcctgaacgtcctctgctaatgttatttctgtgattcaaatactgccaagcacagcacaagtttttgctggaattgactttagaatggacatgtgagtgtttataataaggaaacagattctttttttcataggctctgtacttaaaatatttattatcctgaataaccatatacccccaaaaaagtacagtttggctactgtattaaaatttgaaaatatcctgcattacatgtttagtagctcagaggccacttttattaaatgtaaagaccaaaacttctgtgaccctatccttactatatttttttagaaaatatttataatcttaaatcagctttagagtgcaactcaaaaaccattttaaaacctaatgaattaaattattaagaaaacaaaaaccaaaatgataaattagtcttgggttagcttgataagatttttttcaatagtttagaactgaactattctgttaatgaaaattgtgactaatgtaattctgaaggactttcaagacaggttcctctctactgtttgtgtagaatacgagtaaaagaatgatgaaaattgaccctctccagacaaacctatagagacttccactacctgctagaagatgcctaagcttctccatctggtgagatgctgtgatctgctcacccctcattcagtcaggaaaaggacaccttgcaaatccctgacttgttttgctggctgtgggcacacctagacaccagcaaggaagagaatagaaggcaaattctccccaaaccggctactgctttgaacacccttaactatcctagacccttctggtctcaatctttgaaactttataagttcttccagctatgccaggtttcttgaacttctgctaatagccttgtctaatagtctcgactggctgacattaaattcaagtataaatcttggaattcaaactcaagaatcacttgaacccaggagacagaggttgcagtgagccgagatcgtgccattgcactccagtctgggcaacaagagcaaaactccgtctcaaaaaaaaaaaaaaaaaaaaaaaactccttcataatctggataatactgccccagtcttaccttcagcactcttcatttatttacctcaggtaactaaattctgccattgagggtgctggggatgtatttccctacctggaatgctttcctcctatctcaattcatgtcatacttcttagacatactccttagagactccagccagcattattctgttgtttcccttaccattcagacataacacttatcttaaattatattaacagctacatcagtctttgtttcacatatttgatcttatgttctgtatttcccatggtgcctagcataataactgggtgcactcagacatgatttcctatagaaaatcatttttaaacctcatgtttgtctaggtgcctctcttctagcaccctgtataattgaaattatcctgtttgtttgtttccaatgcttgcccaggttctcatggttatgtattcaaaagcacatatacaaacacagagttaatgctaagcatagttcttggcacagagtaggttctaaaaaaatattttggccaggcgcggtggctcacgcctatattcccagcactttgggaggccgaggcaggcagatcatgaggtcaggagatggaaacatctagagatcagaccttgcctttccattaatggtcccatatgtccatgacatgtttattaactctttcctaaaatgtcaatgtaaggaatactcaaattggccagcatcagagatattgtttactgaattaacactaaggctttatatttcttgctaaatgctttctgtcagttcaatactttgatgtcaaaaatgcacacaaaagagactatttaaataacatggccaaaagatgaatatagcaaaattctcagactaaactgaaatgccaagaatttttttgtttgcagcagtcctatttactgtctaatctatacgtttttctgatttagatacctaaatatctaaacttctgttttagtttccccaaaagccttaagagttccttcatcaagcctttggtcctctagctctgtcttcctccagctatataattgtgttcatattctgttcctcatcaggaccacagctaaggaagaactcctctttgctattggatggtagggttgatgagcagaaatctgctatttaaatgtttaatttttaacaagattatgaagcatataaagaaacaggaatatatagcccatacacagggataaaaggaggcaagagaaactgtctccaaggaagtccatacattggacttactagacaaagattttaaatcgcctatttttaatatatttcaaagagctaaaggaaaccatgtctgaagaactgaagggaagtatgagaatgatatctcagcaaataaagaatatcatctttgatacaaattataaaaaggaatcaaatataaattctggagttaaaaatacaataactgaagtaaagatatactataagtgttcagcagcaaagttaagttggcagaagggagaatctgaatttaaaggtcagtcaattgagattcttttttaaaaatttttatttcttttctaaattagagatggagtcttgctatgttgaccaggctggtctccaactcctggcctcaagcaagcctcccatcttggccttccaaagtgctgggagtacaggcatgagccatggcacctggtcgagattcttgagtttgataaaatcacactgataattcccaggcaaccatgccaaaatatatagtaaaaaaaacaagggaattaaaatggtacatagaaaatattgatttaacagacctcttaaggagatactatttttaaattattttatagataaggtaacagacttagagcagttctactgctcaagtacataatagagtcagactcagaagcccagtctgtcaccaaaattccttactataggcttacaagggagatagatgaaattctctggtagaacatagaaatggttaagccctattattttaataaccaccatttacacataccatactcttatgattctgtcagataaggaatggaaagctcaagaacggtcagtgtcttcccagagtgatggttgctagtaagtggtagaactgggatttgaatgaaagtatatagggttcaaggttttctgttgcccatgatgttttgagatggcaacctaaatattatgtggttttagcccactcacaactgggtgagcataagtagtacagcagacctttttcagacatctgacttatcttgcatgctagtagtaatgcaagaggataacacaagctttatagaaaaacagcattgaaattttcctttcctggttttgtaatttacagacataaacttccttatttgtttcctctttcacagaacatgaagtaacctgaagtaactcagtgcttttaaataaaacaaccacataaaaaattagatgatatgtttctgattttactttatatcaactgataaattcaactacatattaagatatttacagtaatgtaaatacagcccagtacttgttttgatttcttgtaaaaagctactttctctttgtaacctgattaggcgtagcttggggtcttctgaaaaagataaacaaaagcaaggaggcagtctgttttcttccagtatcagcaaagaaagactgtagaatttcatgatttaattttaagacaactcacatttatcatcatcttgatatttatatccttgacttttaccaaagtctattttagaaatgcccgttgctctcagaaaagaagagtttgtttttctaggctgcattaaggaaactcaagagatttcagcaaaactttattgctgaagaatctgtgcccctcctggatctaaataaggaggggactgtttaaagttcttactttaggggaaattacatcaaatgcttaggaaaatgacccattttccctcctaattcatcataatcttcttcttcaaacaagttctaggacatttacactttcctgtaagtaaatgttcagtggagcattccagatttctaagtttctgaatttgtccttagaatattcctttttttttcttcactattttgagtatttaacattatgagtttgggagtttaggttccaaactcaactgattttaaggatcaagtagataaaatgaataaagagggcagaggtaatgtgtaagggagtgtgtggcctaatagctacctggaaaggacgtggctgcttaaaggcattcaaattcaattgtttaaaaatattgtggagtcattaaaacatattgctggtcaaaggtcccatggtttctcagtttctcaattactacagaattattcccttagaaatttgtgtccaatagtcaaaaagtttggctatttttttaagtatatttggataaattacctaccaagtttttgcatattggagaccaccaaggagttcatactgccagattaactcacatttatataaaccttgaaagaatgcttatcctgccatttctgagcatttataagtgaattctatcattgattaagaaatttatggccaagcacagcagctcatgcctgtgatcccagcactttgggaggccgaggcaagtggattacctgaggtcaggagtttgagatcagcctggccaacatagtgaaaccttgtctctactttaataaatacaaaaattacccgggtatggtggtatgcacctgtaatcccagctactcgggaggctgagccagaagaatctcttgaacccaggaggtggaggttgcagtgagccgagatagtgccgctgcacaccagcctgggcaacagagtaagactccgtctcaaaaaaaaaaaaaaaaaggcatggctcttcatagaggtctctttgaattgaagtttgtgcatgtctgttcacttaaacaagtgtaaagaacattcttgtgttttgctcatttaaatgtaaaatgctagacaagatacagatgcatcttcatcatacgtgcccttctcaaactgttatgatacttttatgatttgttgtaagctttaaatagctcttttttttttttttttttttttttctgagacagtgtcttactctgttgcccaggctggagtgtagtggcgcgatcatggctcactgcagcctcaacctcccaggctcaggcagccctcctacctcagcctcctgaatagctgggactacagccacataccaccacacctggctaatttttgtattctttgtagagatggagtcttgctgtgttgcccaagttagtcttgaactcctgggctcaagtgatacgcccacctaagcctccaaaagtgttgaaattgcaggcatgagccactgtacccagcactaaatagtttttactttactttaaatttgtaagaaatatatgcagcttttggattgtatttgcaattcagctttgacataaaaattgtctactttaagctttgagatctgtttaattgaagagaaccaggaatagtaaggaaagcaattgaattattattacttgcaatttattgtccatgtgaatcaactttttttccttacaatgcaaccaaaagacacaatttggatatggctaatataagttgggtatcatttattactctttagtaagaagtcttttgattgcaaataacaatgacccaactcaaagtagcttaggcaaaacagaggaatttgttggctaaggtaaccaaatcacagaaaggatgagatggtgcttgctcaagaactacccaattcaaggacactgtccctgtcctctgcccaccattcccatcttcactttgccaaatttctcatcactgcttttctctgtgagttggtttaattctttcctactacagataggcactatctgcttggtaggaagaataactttggtgggaaggataggccatttttggattaatctttcagcctctatcccagggatgacctaatttaagtcaagggaccacctccacccagtaattaggggcagaggacagtggtttgaggttctgtcttgcatatctgcctaccctgcaagtttacccctgagatcaggacagcaggatctgttgctagaaggaagaagaaggcatgcaaggttatatatattttatgtcttggaattccacataaaaggatgccactactgaaaatatttgaaaattactgaattagagttttatgaaatcaattactcctttaacttgtatacgattttataaatgttatgtaacatcattagatttctcagtcatggggctcaagtataggtttattcattttttgtaatcatgcgaattctgattggtgttattatttgttgaacagatatttattgagcactaccagtatgccaaaccctatgctcaacacagaagatggaatggtaaacagacagacctgatgcctccctttatggaacttaaacaaaaagagggacatacaaacaaatatcaccagtatgaggttgtatgctatgatcaggagttatgaagcaaaaagacaatagagatatccaagtagatgattaagtgaagagactaaggctgataagagtgagccaaaccatgggagagaaagcagagagtagtcaaggcagaagaaaagcctgtgtgaaagctcagaggcaaaaaaggagtattggagaagccaaaaactgcattgtagagaaggtgtaatacggaaggagaatggggagtgagtaataagtgaagaagctgaagaggtatgccaagttcagataatgtggtctgtaatgatttttttaaaagccttttcctaaatgtgatgagtagccagtgaacagtgtagagcagtcaagtaaaatacacaatttagaaacatcctcctagctgcagagtggaaatgagttggtgagagggagagttggatgcagggcaacagaagattgctgcaataatctggatgagacaggatggccagaggggagtagctgtggagatcaggaggaggggttgggtttggtaaatatttaagaagtggaatcaataagatttggtaattaacagtatgtgggggacaaggcagagggaaaagtaaatcttcacttccaggtttctgccacaggttggcaagtgaatagtggcatcacacactgaggaactcaaaagaaaagcagatggaaaagagaatgattcagtctaagaggcaatttgatgcacaggttagaaagtcagaggagggaagtagtgtctggtcaaaatataagtcagtctgataaaaatttaaaacaacaacaatgaaacaatggcattgacccagaatgctattgcaagatcttgtgaagaatatacgcatagccctgatcttgtctgtctgtgcaattctatttgacagatgtttgttggatactgttatgcaagatgtaagaagagttttttgtgtttttgagacagggtcttgctctgtcacccagactagaatgcagtggtgcgatctctgttcactgcaacctccacctcccgggtccaagcaattctcctaactcaacctcccaagtagctgggattacagatgcctgccactgcgcccggctaatttttgtatttttagtagagatggggtttcaccatcttggccaggctggtcttgaactcctgaccttgtgatccacctgccttggcctcccaaagtgctgggattacaggcgtgagccaccatgcctggccagaagagtttttaaaacttagaaattattttttaaattaatttttaaaatttttattttatttaaaaaaaaaatttaaggctgggcatggtggctcacacctgtagtcccagcactttaggaggctgaggcagatggatcacttgaggtcaggagcttgagaccagcctgaccaacatggtgaaacctcatctctactaaaaaaaaaaaaaaacccacaaaaattagttgtgcatggtggtgcaagcctgtaatcccagctattcaggaggctgagccaggagaatcacttgaacccgggaggcagaggttgcagtgagcctgatcgcaccactacactccagcctaggtgacacagcgcgactccttttcaaaaaaaaaaaaaaaaatttaattattgtgggtatatagtaggtatatatatatatatatatttgtgaggcacatgagatgttttgatacaggcatgcaatgtgaaataagcacatcatggggagtagggtatccatcccctcaagcatttgtcatttgagttacaaacaatccaattacactcttaagatattttaaaatgtacaattattattgactatagtcaccctattgtgctatcaaatagtaggtcttattctatttttttgtacccattagccatccctacctcctcctcaacccctactaccctttaaaaattaaaaaatcatgtcagtctgaataattacattttgttttgttttgtttttgagacagagtctcgccctgtcacccaggctggagtgcagtggcacgattttggcttactgtagcctccctcccaggttctagcaattcttatgcctcaggctcccaaataattgggactacggatgggcaccaccacgcccagctaatttttgtatttttggtagagacggggtttcaccttgttggtgaggctggtcacaaactcttgtcctcaggtgatcctcctgatcccaaagtgctgggattacaggtgtgagccaccgcacccagccaattacattgttgaagtcaaagaaaatatagagatgaatctctaaattaaaaatgttttatttggaaaacaagaattgcattttgggacagattgggtgatcttcagtatgtacaaagaacaaagagaaggttggcactagtaaagttttgaggagctggcaagctgtgattggtgacagcagtgggtagttagtcttagagtcacaacagattgtttcggcagctattagataatactggtttcaggttaccacaggcagtttcagcagcgggcttgcagagaattacattcatggagcaacattatatgccctaagtgctttttcctcctggcccctcaattgatttagttggatatgacaagaatgacccaatttttataatcaactttcacaacatattatttttttcatcataataaaggtgacccaattaagataaatgcctcattctctacttcactctcaaaatgtttctttggtgctttccctcttacacaactggagtctgcttttgtagctcagacccttctcagtttgattcatttcaataatcatttattagaggcctctgctaagggtaggataaagggaagaaagtgctgcctgttctcaaggaattaagggtcttttgggaaaatctgacatgtatataaatggtttcaatatagtgttttaaatactgtgatggggagtttgtaaaaattgttttcaagctctttggttctatttttgggacaatttttattctgatcgttggctttttaatcaaagtctatataaatatttatgcaatctgccttctaatcacaaaccatgttgagacagtactacccagaattgctttgaacttcatttctagatgccatcattggttcagacaattgcaatttaaggcagggggctggagcaaatcatagggttatcatccacttcccgtgctttgaattccaactgtttcttaatttttgtatctcctgcattaactctatgcacactagcaataatccacccaggccagaaggcctccagctatcttacccaccagaaaatgagttcatgtgcaggttaatgagtatcacagccttgcagaggtggtaattaaaattcagggaattctgggtgttggatagctgaaaaagatattttaagattaatctccattgaaagtggcttctattcctcagggatctagaactagaaataccatttgacctagccatcccattactgggtatatacccaaaggattataaatcatgctgctataaagacacacgcacacgtatgtttatagcggcattattcacaatagcaaagacttggaaccaacctaaatgtccaacaatgatagactggattaagaaaatgtggcacatatacaccatggaatactatccagccataaaaaatgatgagttcatgtcctttgtagggacatggatgaagctggaaaccaccattctcagcaaactatcgcaaggacaaaaaaccaaacaccgcatgttctcactcataggtgggaattgaacaatgagaacacatggacacaggaaggggaacatcacacatcggggactgttgtggggtgggggacggggggagggatagcattaggagatatacctaatgctaaatgacgagttactgggtgcagcacaccaacatggcacatgtatacatatgtaacaaacctgcacgttgtgcacatgtaccctaaaacttaaagtataataataataaaataaaaaaaagaaagtggcttctgatcacttgggcctcctctcacctacttaaataagattcaatccatgattggcaataatacccatacagcacatagaagaatattgtgaaaacgctaaggaagagctagttgagtcagttttgtaaagcacttggaactcagtaagccgttagtaaatgtcagttgcctgtgttaaccatcattatcatttaagtatttaagtggaagagaaggggggaaggacattctaggccaagagaataacttatttgggaacatgaaagtgaatgtcattttccaaaatgactcagtatagttgggaagtagagtataatgcagagaacagtgatgagagatggtgctaatgagagagagttatgttgggaccagattgtaaagaatcttcaatgcctgctaaagaatttctactttgcaaaatatacagtgggagccattgaaaaaaattttgtggaattttttttccctaatatgttattcaggttttctttatgcttttttatgaaaaatttccaacatacactgaaggaaaaaaaaaaggcagtataatgacccccacgtactcattatccagctttaaccattatcaatatgtggccaatgcattgatgattttaaagcaaggcaagaaagactaacattataccacatcctttacctttatcctttatcttcactatgtcctgtggagtatgtggtactcccactttccctaattataaatgagaaaatcattaacatgataaagtaagtaaaagctctgggattctaacccacatccaactgatttcagagctcaaggtcattcctgtcttgcatctaaagtagagcgtgattccccgttgaaaacagctgctgatccatctacagtaacagtacctattggtgctcttgaccctattcaggatggtaggcttctctgcctgcagccactctccttccagagggtcaccagaatctaagtccacataaatgctcaacctagtcagctaaagtaactgtgcagttcagtagttttcaaagtatggtcccaggccagtggcaagttgttagaaaatgcagactcttagggcccatcttcagcctgctgaatcagagactctgggtggggcccaacaatttgtgttactgtttttttaatcagactttattgtttagagcagttttagttccacagcaaaattgaacagaaggtacagagatttcccttacactcccttcccctacatacaattcctcccactatcaacatcccccatcagagtggcacatttgttgcaattgatgaacctacactgacaccatcatcatcaccccaaattcacagtttacattagggctcattctttgtattgtacattctcagtttagacaaatgtataatgatatgtatccaccattgtagtatcatacagaatggcctcactgccctgaaacaatctgtgcttttataagctctgaagtgattctcaggcatgcttaaagttgagaacatctggtttagttagaccttagaaaatggaaggcagctcgtatctgaaggatcttccttacccttaaaggcttacagggttttttgcctacccggaaaagaagagagggcaagactgaaatacatttgttttgtgcttgtgaattgttaagatagtaaaaactaggatttattactattaagtagggatttgcctttttaaaaagagtggttcaaatccctgttggaagtaaatccttttcatataagtagttaggtactactagtgcaccaagtcgccatttttttcactcttttatgttaaataatgcacatctgtataattctggctgacattcttccaacttaagtgaagaaagatgcttctacatctaaattcaaaactatcaacaaaagttcagtatttctaatcaagctccttttgttacgggatctctggggtgccagtttttctggctagaaacctctgtggccatggtgcctttgcccaagttcttgtcctgtgtcctggaagtatgcggtaggcagacaagtgaagggtaaagaagaattttatttactgttaaaacagctcagaggagtgagtagctcctctctgtaggcatatcgtcccttggagtgttcagctctcagcagagaggaggccctggagagggtggcttttgtccacaggcaagtcattgggatgtctctgcaggtctctgaagctcccctctctgctggcaagttgtctctgcagctctcaatggagagagtactcctctctgcagctggccatcccatcgtctccagctattagcagagagaatactcctctctgcaactggtcatgccatcctctctctaccctattcctcctctggccatcctctgctctgctctgtctgagcccagggcttttatggacctcagaatggaggaagtgtgtgtggattggtctatgggcagccatgggaaggcccagaagaggcaccaccagtccccactctagtctgctggactggcagtccagcccccagtcttcaggccctccctggcctgaaggtggggccttactgggaacccaccctcttctgcccaggactctgcctcccattgctattcagggccctggggctcagccccaaccccactaatctgagtgggctccaggagaagagagaggccaagcagcgggaacagatatccccaagccagcagggacaggggcagggggcccttcccggccctcccccaggagcacagggaggcttggatccacagctgcagattggtcagctgtagccagtcccaggagggtggggctcctgcctgctccgtagaccaggaggccagggtctgtaggtgcagtttgagcgactgcagtggtacctgggcagctcccgtcccaactcagaaggggcagggctctgtagccactggctccatggagtgtgcaaccccagcaatgcttccctgctctagccggcatgatggcagcagccactgccatcactttggtaaggctttggcagccatttcgataatcgtgtctactggtggaccctgggatacgtgcgtcagttattatctcatgatgagataatatatgttttattgctgaagtgaaatacaccgtggcaacaaattccttcttgaatgtctttatgaagtgtttagaaatttatttgtttgtttgtttgttttaaagatagggtctcgctctgttgcccaggctggggtgcagtggcacgatcatagatcactgcagattcaaactcctgggctcaaacagtcttcctgcctcagcctcccaagtagctgagatcataggcacaagtcactgtacccagctggaatttttaaagtaggatttaagaagctgagtgaatgtataattcctgatttgtaatatacttctatcaaaattaaaagtacaatgcctttagtaagaaatatctataatcagaaatgatcctgattatggtaaggtcaaaaacagaagtaccagcagaactttgattttcttttcttcaacttttctcctccctctcacttgcacccatacagctagcacagagcctaggcacagtgggtactgtttatattgtactgagataatagaaactgtgtgggtatatggttcaccttaaaatccatgccttatttttttttgagctcatgatgcctgtattaccatttgctgaactcaaaatactccaatggtttcctgccaaaatgtaatcatgttatgattgtccaccaagaccatttctaaggtagaaaccttacatcagaagatgttatatgtttctttttctaaacaagttcaggaaaagtatgtcctgatacaggaaatttattcagacttaacaccagcagtgtctctggttatgttacataattacatggaaatcatagtaataatatttgcagtgcctaaatttgaagtgctcaatggtgtcatctagtggtgtaagcactatagaaggtgcagctttattactcagtgcttttgggacagaatttgtgtatttaaaaaaaaaaaaaaaaagtttaatggaacagccaaacataagatacaatggaagacttccattgaggattcttagatatagtaccaacacagaagcaacaaaagaaaaatagctgggtggggcgtggtggctcatgtctgtaatcccagcactttgggaggccaaggtgggcggatcacgagatcaggagatcgagaccatcctggctaacacggtgaaaccccgtctctactgaaaatacaaaaaaaaaaaaaagccgggtgtggtggcgggcacctgtagtcccagctactcgggaggctgcggcaggagaatggcatgaacccaggaggcagagcttgcagtgagccgagatcatgccactgcactccagcctgggcaatagagcaagactctgtctcaaaaaaaagaaagaaaaatagctaaattagactgcatcaaaatttaaaacttgtaagccagatgcagtggtgagtgcctgtggtcccagctatttaggaggctgagacaggcggattactggaacccagaagtttgagtccagcctgggaaacatgacaagaccttatcactttttttaaaaaagtaaaacttttgtacatcaaaagaaactttcaagaaagtgaaaagacagcccacaaaatgggagaaaatatttgcaaatcatacatattgtaagaatctagtatccagaatatataaaggattcttacaacccaacaacaaaaagacaactttatttatttatttattttctgagactgagtcttgctctgtcacgcagagctgtatttcaatagcacaaactcggcttactgcaacctccacctcctgggtacaagcagttctcctgcctcagcctgccaagtagctgggattacaggcagacgccactacatcagctaatttttgtatttttagtagagacggggtttcaccattttggccaggctggtctcgaactcctgatctcttgatccgcccacctcagcctctcaaagtgctgggattacaggcgtgacccaccacacccaacctgacaacctaatttaaaaatgagttaaggacttgagtaggcttttcaccaaagaagatatacaaatggccaaataagcacatgaaaagttgctcaacatagtcattagagaaatgcaaatcaaaactacaaagatataccgttcctaatcactaatatggctttcataatttaaaaaaaaaataccaaaatacaaaagaataagtgttggcaagggtgtggagaatttgaaccctcatacattgctagtagaaaggtaaaatgttgcagtcactggaaaacagtttgacagttcctcaaaattaaacatagagttatcatatgaccgagcaattccattcctgggtatattcccaagagaaatggaaacaggtgctcaaacaaaaccttgtacacaaatgttcatagcagcattatttatttattttttaactttgcagcattatttataatagtcaaaaaatggggaaaaggcaaatttatatcacctgattaataaacaaaatgtggtacaactgaatattattaagctgtaaaaaggaatgaagtactgataaatcaatgagccttgaaaatattatgctgggcaacagaagccaggcaccaaaagtcatatattatatgatttgatttatatgaaatatccagagtaggcaaatccatagaggtagaaagcagactagtggttgccaggggctgggggaaggaagggatggagaatgaccacttaacaggtacagtgtttttggagaagtggtggaaatgttctggaattagataatggaaattgttaaacaactttgtcagtgtactaaaagccactgagttgtacactttaaaattattaaaatggtgacttatattgggtgaattttacctcaatttttacctctactgattggcaagacttcagaaccttgattattattaattattattattatatttttccatagttattgctagtgtatatgtcatatgtatattctgtttttttaacctaaaattatttgatacatacttgtcatctatacagtttccacggtttttattttggtgacagtacacatcatagcttaatcattcctcaaatgttcagtgattttctctcctttttttttatttcaaagatccctgttacaaaatgtttaaggaaataagaatgtttccaacccttcatagatattacactgggttttcttccccaaagcagtatctctgagtcacttttctttttttaatatttctattgtgttttttctgtcactgctgttcagtaaatatacatataccaatgtataatcctaccaataatggattgggggaaaacggagattattgtagagtgtctactcttttccaggcactgcacctgcatcctttcacgtttattatttcacttaactcctacacctaagcagatgagcaaagatcagaacccacgcattttgtctctaagttgtgtcctgttttcccacagctttaccaatattggatcttacctcttttagttcctgtttattagagagattcaacattttctcaagtgattgttaactgttcatatttacttacaatctgtatcttttgtccatttattattaataataaattttaaactgaacatacctacttttctcataggcagaagatatcatatgtcaaggctttactgtaattttttttcttttatttactcctctattacaggctcttgatggaaatgtgtatgatcatctcaaggattatttaatagccttcagccggactgagctagaaacatgccaagctgtgcagaacacattccagtttttattagaaaactccagcaaggtaagttacctttagtgcaacgtgtagtgttatccaacttagaagctaaagtatttctgcatacaaagaaaatgaaggtactagtgatattagaagaatgcattaacgaacaaatttcctggtaacagcattccttctaacaaagttggaggagattctgttctccttgttgatgagttgaagatggcaccaagggcaaaaagagaggtgctgatacaaggtagcttagaacattggcccattgccatgtgcattgcctttgagaagggtttaaacagttttgtattctactcagagtttaaatgcactctgctcacatgggggaaacaacaggtcatgtgtcagtacaaagagtactaaaagagcacgaagggaaaaggagcgttttgtaattgatataaaaacaacagtgtcttgggtttttttcaaattaagccctactatctatatgctgtcattctttgacagcagtcgtttcatttaaaagtgttgagatccatcaggtttgctgacatgtcacattgtatgcagagaaaataaatgcaatgacttttcttcaagatttgatagattaaaatgttttgcagtcgtgaaactatcctttggaagataaattgttcctgtggttggcaaatgttttttatctgataaattaaattcacaataaatgtttcctgactaaaggaatgcattttttaaaaatacgcatttcataactgctactttaaaagatccagttcaattttttttttttgtcagggagagtgagaactggctaatacttttaggagagggatcaggatatccattttcacatgacagtgtccaaagacaggaaagaaaagcacagactcttcatcctgaatgcctcttgtatatatattcttgttttcactgtaccagagctctcaattctgtgtttataaaagtgttaaaaatgctaggttgatacggaaatacaaaaatcactagcctggtgctttgaagtcctgtcatgtatctgttttcctatattgtcatcccccaaaatctaagagaaaaggaaaatgtagtaaaacattaattgaggaatctatgtagtatgtatataagtatttactgtataatttgtttgattttaatgtatatatatttgaatttttcagaaaagaatgttgggggaaaagtctatgaaaaaatcttatctttgttccttctatgaagtggttgatttttgagtgaacaattttgttgttgttgttgttatttttagtagagacaaggtttcaacatgttgatcaggctggtcttgaagtcctggcctcaagtggtccacccgccttgcctctcaaagtgctgggattacaggcatgagccaccatgcccagccgtgatcaaattttttatgtttatttgtccatttagattttctgtctctttttcagtatatttgggtaacttacattttcctggacaattgtccatttcattaaaatgtccaattttcctaggcagttgtccatttcatttatcagatttgatgtcataaacttgtttgcttctagaattgtctctgtttttgtttttaatattgtgtgtgccctctgtcttattttgaccagacttgccagtctattttattaatctttgccaagaaccagataaaatgacctttattctgcttctcagtgttgtgtctatttccttaatttttgcctttatattcattatttctactgtcttacagtttatgttattgttctttctcaagcttctttttctatttagatcctatattttcagtctttcttgtttttaagtaaatttgtttaaagcttttaaaaaagtgtctttctgcttgaactgcattctgtgatatgtagggcttttgttttatatctatttttttctccttattaacccatgattatttagaaatgagtttttcagtttccattcagttggaatatgtggtagggtgacatttttatttctaattttattataaattgtatttttaatccaacgacatttattctaattttattataaattgtatttttaatccaacgacatttattctaattttatcagagaggttatcttctagcaaaattctttgaaatgtttttttccaagaataagttggactggagacactacccttagtttataaaacaggaaacattatagtcgtaacagatagctaatattttacacacacttaacaatttcttaagacttttagcatgggatatatcttgaatcccatgaggtcgccattaccatgttcattttatatggaggaaattggactcagaagtttatgtggcttggcctgaggttacacactcacacatagtgctttccatgatcttctactatattctctttagcttgtattattttaatagaaaatgaattaagaatttatgaactagtttggacacataaagagataagctttcattttctgcattcactcatatgagtatctcactccccagaaatgaggaataaatgagatgctcttacatttaaattgaaagtggtaggaataaaaatttaataagaataatgtagtgcccttttgttccaagtaccagaagaggcctacaagttttatgccatgtgtttttctgttatgaagagcttgttatgctgctcttgctatgctgctgaaagcaacctaaagggaagtttgacactttttagattttttttattttatattattattaccatgttcaaaatgtgacatatccccaaagatattttggtggtaattcatccaacatactgtaaatgttaaagtgcttcctatatcattcatcccctaaatggaaacagatggccctaggagcttttgttaaactttaattatttatgaagcttgcttttcttcttaatattttatgaaatgctttgtatatgtaactgaagcagatgttgtcataggtattttctctaggatagtaactctgaaggtagctctactggcctttataatttgtttgtgtgtgcttgctttttgtctccataaggaaatgccttccaattaataacaaagttcatttaagaattcagaaaaataaatttaaaaaaagaattcagaaaataacaatgttattctacatttatttgaaaattaatttgtctagtgttactgttcttaatacttcgaagtctaaccaaaaaaagtagataaaaggaaggaaaaaacttcatgatcatttcaatagacacagaaaaagatttgacaaaattcagtacttttttgtgataaacactcagcaaactagaatagaagggaacttacataacatgatagcatcaaccaatgtcatattcaataatgaaagactgaaatcttcctctgctaacatcaggaacaaaacaaggatacccattttcaccaccgctattaaccattgtactggaagtcctagacagggcaattcggtaagaaaaagaaataaaaggcagccaaattgaaaaagaagaattaaaattacctctctttgcagatgacatgattatatttataaactctcagagagcccattaaaaaaactaatagagctaataaatttagcaacatataagataaaaacacaaaaatcagttgcatctctatattccatcaatgaatgatccaaaaagaaggttaagaaaataattccaactacaataatactcagagaataaactatctaggaataaacttaaccaaaggagttaaaggcctgtacactgaaaactataaaacattgctgaaagaaataaaagatataaataaatgcatataataaatgttcatggattgggagatttcatgttgctaatattgtaatattccccaaagtgatctacagattcaatgtagtccctatcaaaattccaatggccttttttgcagaaatggaaaagccggtcctcaatttttttttttttttaatttgagacaaggtctcactctgtcacccaggctagagtgcaatggcatgagctcagctcactgcaacctccacctcccaggttcaagcgattctcctgcctcagcatcccaagtagctagaattacaggcatatgccaccacgcctggctaatttgtttgtatttttagtcaagacggggtttcgtcatgttagccaggctagtcttgaactcctgacgtcaagtgatccgcctgccttggcctcccaaagtgctgggattacaggcgtcagccactgcactcggcccagtcttcgaattaatatggaactacaagggaccatgaatagtttaaacaatattgaaaaggaaaaataaagttggaggactcacacttcccaatttcataacttactataaagttacagtagtaaagatagcgtggtatggacataagtatagacatatagaccaatgaaacagaattgagagttcagaaataaacctgaacatctatggtcaattgatttgcaacaaaggtgccatgactattcaatagagaaagaatattctcttcagaaaaaggttttgggacagctggatagccacatgcaaaagaatgaagttcaagccaggtgtgatggctcacgcctgtaatcccaacactttgagaggccgagatgggtggatcatgagatcaggagttcaagaccagcctggccaatatggtgaaacctcatctctactaaaaatacaaaaattggctgggcgtggtggtgggtgcctgtagtcccagctgcttgggaggctgaggcaggagaatcgcttgaacccgaaaggtggaggttgcagtgagctgagatcgtaccactgcactccagcctgggcgacagagcaacactctgcttcaaaaaaaaaaaaaaaaaaaaaaaaaaaaaaaaaagaatgaagttcaatgaagttgtgaacccttacctcacaaaattaactcaaaattgatcaatgacctaacttataagagaaaacagagatagatctttatgaccttgatttggcagtgcattctcagatttgacgttgaaagcacaagtaacgaaagaaaacatagataattagactgtatcaaattaaaagcttttgtgcatcaaaggacattattaagaatgtgaaatcaacccaaatgatgagagaaaatatttgcacatcacatatctgataaaagtttcatattcagaatatacaaagaactcttacaactcaacatcagagacaacccaatataaaagtgaacaaaggaggctgggcacagtggctcacgcttgtaatcccaatactttggaaggccaaggtgggggaattgcttgagctgaggagttcaagagcagcctaggcaacatagcaagaccctatctctacaaaaaaattttttaaattagccagacatggtgctgcatacctgttgtcccaactactcgggaggcccaagtgggaggattacttgagcccaggaattggaagctgcagcaggctatgatcatgctactactgtactgtagcctgggtgacagagcaagaccctgtctctttaaaaaaaaaaaaaaaaaaaaaaaagttgtgtaccaaaaggtcaatgaaattaaaagctagttttttgaaaagattaacaaaattgataaacctttttttccctttaattttaatttcaggggtacatgtgcaggatgtgcagattatgtaggtaaacttgtgtcatggagggtttggtacacattattttatcacccacgtattaagcctagtacccattagttatttttcctgattctctccctcctcccaccctccaccctctaccctctggtaggccctagtgtgcgttgttcccatgtgttctcataatttagctcccacttacaaatgagaacatgtggtatttgcttttctgttcctacattagtttgctaaggatagtggcctccagctccattcatgttcctgcaaaggacacgatctcattcttttttatggctgcatagtgttctgtggtgtatatgtaccacattttcttttcttttctttttgttttttgtttttgaggcagagtcttgctctgtcacccaggctggagagcaatggcgtgatctcggctcactgcaacctctgcctcccaggttcaagcgattctcctgcctcagcctcccgagtagctgggattataggcgcccaccaccgcgcccggctaatttttgtatttttgtagagctggggttttgccttgttggccaggctggttttgaactcctgacctcaggtgatccacccaccttggccaaagtgctggggttacaggcatgagccaccacgcccgaccatgtaccacattttctatatccagtctatcattggtgggcatttaggtttgttccatgtctctgctattgtgaatggtgctgcaatgaacataagcaggcatatgtctttataatagaacaatgtatattcctttggggttatactcagtaacgggattgctgggtcaaatggtttttctgtctctaggtctttgaggaattgccaccctgtcttccacgatggttgaactaatttacactcctaccaacagtgtaaaagtgttcctttttctccacaaccttgccagcatccgttgtttttttaattttttattgataaccattcttattggtgtgagatggtatctcatggtggttttgatttgcatttctgtaatgatcagtgatgttgagtttttttcatatgattgctggccacatgtatgtcttattttcagaagtgtctgttcatgtcgtttgcccacttttgaatgaagttgtttgtttctttcttgtaaacttgtttaagttccttatagatgctgggtattagacctttgtcagatgcttagtttgcaaaaaaaaaaaaaaaaaaaattcccattctgtaggatgcctttttattccgttgatagtttattttgctgtgcagaagctcttaagttttattagatcccatttgtcaatttttgcttttgttgcaattgcttttggcatcttcatcatgaaatctttgcccatgcctatgtcctgaatggtattgcctaggttttcctctagggtttttatagtttcgggttttacatttaagtctttagtccatcttgagttgacttttgtatatggtgtaaggaaggggtccagtttcaattttctgcatatggctagccagttatcccagcaccatttattaaatagggaatcctttccccattgctttttgtcaggtttgttgaagatcaggtggttttaggtgtgcggtcttatttctgggttctctattctgtttcattggtctatgtgtctgttgtactagtaccatgctgtttggttgctgtggccctgtggtatagtttgaagttgggtagcgtgatgcctctagctttgttctttttgcttaggattgccttggctattcagaatcttttggtttcatatgaattttaaaatagttttttctagttctgcaaagaatgtcaatggtagttcaatgggaatagcattgaatctataaattgcttagggcaggctgggcacctgactcacacctgtaatcccagcactttgggaggccacggtgggcagatcactttaggtcaggagttcaagatcagtctggccaacatggtgaaaccccatctccactaaaaatacaaaaattagccaggagtggtggcacatgtctgtagtcccagctgctcgggaggctgaggcaggagaatcacttgaacccaggaagcgcagtttgcagcgagctgagattatgccactgcactctagcctgggcgacagtgagactccttctgaaataaataaataaataaataaatagcttaaggcagtatggccatttttatgatattgatttttcctgtccatgagcatagtatgttttttcatttgtttgtatcatctctaatttatttgagcagcagtgatttgtagttctccttttagaggtccttcaattcccttgttagctgtatttctagggtttttttttttgttttttttttgggttttttttggtttttttgtatatcagttgtgaaagggagtccattagtaatttggctctcggcttgactgttgaaaatcagcaaacctttagccagactagtgaggaaaaaaagagaataaccaaataaataaaatcagaagtgaaaaaggagacattacaaccaataccacagaaattcaaaggaccattagaggctactgtgaacaatatatgccaataaattggaaaacccagaagaaatggataaatagggctgggtgtgatggctcacacatgtaatcacagcactttgggaggccaaggtgggtggatcacttgaggccaggagttcgcgatcagcctggccaacatggcgaaaccctgtctctactaaaaatacaaaaattatccaagtgtggtggcacatgcctgaaatcccagctgctcgggaggctgaggtgtgaaaatcatttgaacctgggaggcagagtttgcagtgagtcaggattgcactgctgcacttcatcctgggcaacagactgagactctgtctcaaaaaaagaaaaaaaatggataaattcctagatgcatgcaacctaccaatatggtttggatttgtgtccccacccaaatctcatcaaattataataatccccaatgttggaggaggggccagtgggaggtaattaaatcacggggatggagttcccccttgctgttctcttggtagtgagtgagtcctcatgagatctggttgtttaaaagtgtgtagcacctcccccttctctcttttcctcctgctcctgccacgtaagacaaagctgcttcccctttgccttctgccatgattgtaagtgtccggaagcctccccagccatgcttcctgtacagcctgcagaaccatgggtcaattaaactgtttttctttataaattacccagtctcaggtagttcattatagcaatgtgagaatggactaatacacctaccaagattgagccatgaagaaattcaaaacctgaagagatgaaaaaacaagtaacaagatcaaagctgtaatagaaagtctctcagcaaggaaaagcctgggactgggtggctttgctgctgaattttatcaaacatttaaagaataactaataccaattttactcaaccaattccaaaaaatagaggaggggggaatacttcccatctcattctctaaggccagcattaccctgataccaaaatcagacaaagacacatcaaaaaataaaaactacaagccagtatccctgatgaacattaatgcaaaaatcctcaacaaaatactagcaaactgaattcaacaacgcattaaaaagattattcatcatgaccaagtggaatgtatcccaagaatgcagggatggttcaacatacacaaatcactctgtgtgaagggcaaaaactatatgatcatttcaattgatactgaaaaagcatttgataaaatttaacctccccttatgataaaacccctcaataaactgggtatagagggaacatatctcaatacaataaaagccatgtataacagacccacaatgagtatcatattgaatggagaaaaactgaatgcgtttcctctaagatttggaacatgacaaggatgcccacttttaccactgttgttcaacatagtactggaagtcctagctacagcagtcagacaaaagaaagaaagagcatccaaagtggaaaggaagaagtcaaattattattctttgcagatgatgtaggcttatattttgaaaaacctgaagactccaccaaaatattcaaactgataaacacctttagtaaagttgcaggatacaaaatcaacatacaaaaataagtagcatttctatatgtgaacagtaagcattctgaaaaataaatcaagaaagtaatgtcatttacaatagctacaaatacattaaaatacataggaattaaccaaagaagtgaaaggtctcttaaaatgaaagaaattgggaggctgagacaggagaatcgcttgaattcaagagatggaggttgcagtgagccaggattgtgccagtgcactccagcctaggcaacaaaagcgaacatatgtaactaacctgcacattgtgcacatgtaccctaaaacttaaagtataataataataaaaataaaaaaggaaggaaggaataaattgaagaggacacaaacaaatggaaagatattccatgttgatggattgggagaataaatattcttaaaatgtcaatactacccaaagcagtctacagattcaatgcagtctctttcaaaataccagtgccattcttcacagagatagaaaaagcaatcctaaaattttgacagaaccacaaaagacccagaataaccaaagctatccagctatcctgaacaaaaagaactcaaggaatcatattgtgtgacttctaattatactacaaagctatagtaaccaaaacagcatggtactggcataaaaacaaataccagtggaacagaatagagaacccagaatcaaatctacctatctgcagtgaactcatttttgacaaagttgtcaagaacatacattggagaaaggacaatctcttcaataaatggtgctggagaaactggatatattcatatgcagaagaattaagacccctatctcttgccatatacaaaaatcaaatcaaaatggattaaagacttaaatctaagacctcaaactatgaaactactaaaagaaaacactgagaaactctctaagacataggactaggcaaagattgagtaataccctgcaagcacaggcaaccaaagcaaaaatggacaagtgggatcacatcaagttaaaaagtttctgcacagcaaaggaaataatcaacaaagtgaagcaacaacccacagaatgggagacaatatttgcaaaatatccatctgacagaggattaataatgagaatatataaggagctcaaacaactctataggaaattttttttttttttttttttttagtatttattgatcattcttgggtgtttctcggagagggggatgtggcagggtcataggataatagtggagagaaggtcagcagataaacacgtgaacaaaggtctctggttttcctaggcagtggtccctgcagccttccgcagtgtttgtatccctgggtacttgagattagggagtggtgatgactcttaacgagcatgctgccttcaggcatctgtttaacaaagcacatcttgcaccacccttaatccatttaaccctgagttgacagagcacatgtttcaaagagcatggggttgggggtaaggttatagattaacagcatcccaaggcagaagaatttttcttattacagaacaaaatggagtctcctatgtctacttctttctacacagacacagtaacaatctgatctctcttttccccacatttcccccttttcttttcgacaaaaccgccatcgtcatcatggcccgttctcgatggtcgctgtctcttcggagctgttgggtacacctcccagacggggcggccggacaaaggcgctcctcacttcccagatggggtggccgggcagaggctctcctcacatcccagatgatgggcagccaggcagaggcgctcctcacctcccagactgggcggccaggcagaggtgctcctcacttcccagatggggcagccgggcagaggtgctcctcacttcccagacgatgggtggccgggcagaggggctcctcacctcccagatggggcggccgggcagaggtgctcctcacttcccagacggggtggccgggcagaggcgctcctcacttcctagatggggcggccgggcagaggtgctcctcacctcccagacaatgggcagctgggcagaggtactcctcacatctcagatgatgggcagccgggcagaggtgctcctcacttcccagatggggcggctgccgggcagaggcactcctcacttcccagatggggcggctgccgggcagaggtgctcctcacttctcagacggggcggccgggcagaggtgctcctcagttcccagatggggcggccaggcagaggcactcctcacctaccagacggggtggcggccaggcagaggcgctcctcacatcccagacggggcggccaggcagaggcgctccccacttcccagacagggtggcggccggccagaggcactcctcacatcccagatgatggacagccaggcagagatgctcctcacttcctagacggggtggcagctgggcagaggcgctcctcacttcccagacagggcggccgggcagaggggctcctcacatcccagatgatgggcggccaggcagagacgctcctcacttcctagatggggtggcggctgggcagaggctgtaatcttagcacttttggaggccaaggcaggcagctgggaggtggaggttgtagcgagccgagatcacgccactgcactccagcctgggcaacattgagcattgagtgagcgagactccatctgcaatcccagcacctcaggaggccgaggcgggcagatcactcgaggtcaagagctggagaccagcccggtcaacagggcgaaaccccgtctccaccaaaaatacaaaaaccagtcaggcgtggcggcgtgtgcctgcaatcccagacactcagcaggccaaggcaggagaatcacgggagcccaaggcagggaggttgcagcgagctgagatcacggcagtatcggcaacagagggagaccggagagatggaggggggaggggaagggagaggtggaaaaaatttaataattcgatttaaaaatggggaaaagatctgaatagacatttctcaaaaaaggacatataaatagcagacagggcaacatgcaatggctcacacctgtaatcccagcactgtaggaggccaaggtgggcagatcgcttgagcccaggagttagagaccagcctgggcaacatggtgaaaccccatctctacaaaaagtacaaaactatagcggggcatagtggcatatgtctgtaggaggctgagatgggaggatctcttgagccagggaggcagaggctgcagtgagctgagattgtgccactgcactctagcctgggtgagactctgtctcaaaaaataatgataaaaataagtggcagacaggcatatggaaaggtactcaacatcattaatcatcagagaaatgcaaatcaaaactacagtaagatattatatcatcctagttcaggtggcttttatccaaaagataggcagtaacacagatgctggtgaggatgtggagaaaagggagcccttgtatactgttgctgggaatgtaaattagtacaaccgctatggaaaacagtttggcagttcctcaacaaactaaaaatagaactgccttatgattcagcaatctcactgctaggtatacacccaaaagaaaggaaatcaatatatcaaagagatatctgcactctcatgttgattgcagcactattcacaatagccaagatttagaagcaacctaagtgtccatcaacagatgaacggatagagaaaatgtggtatatatacacaatggagtattattcagccatgaaaaagaatgagatcctgtcatttacaacaacatagataaaactggaggtcattatgttaagtgaaataaactaggcacagaaagacaaatttcacatgttctcacttatttgtgagagttaaaaaattaaaacaaattgaactcatggagataaaatgtagaaggttgtttaccagagtctgggaagggtagtcagatgtggggggagccaggatggctaatgggtataaaaaatatagttagatagaatgaataagatctatattcgatgacacaataaggtgaccacgtcagcaatagtttattatacatttaaaaataacaaaaccagccaggcatggtggctcacgcctgtaatcccagcactttgggaggccaaggtgggcagatgacgaggtcaggagatcgagaccatcctggctaacatggtgaaaccctgtctctactaaaaatacaaaaaattagcagccaggcgtggtggcgggtgcctgtagtcccagctactcgagaggctgaggcaggagtatggcatgaacctgggaggtggaggttgcagtgagccaagatcgtgcctgggagacaaagccagactccgtctcaagaaaaaaaaaaaaaaaaaaaacccacgtgattatctcaatagatgcagaaaaggccttcaacaaaatttagcagcccttcatgctaaaaactctcaataaactaggtattgttggaacatatctcaaaataataagagttatttatgacagactcacagccaatattatactgaatgggcaaaaactggaagcattccctttgaaaaccagcacaagataaggatgctctctctcaccatttgtattcaacatagtattggaagttctggctaaggcaatcaggcaagagaaagaaataaagggtattcaattaggaaaagagtaagtcaaattgtgtctttttgcagatgacatgattgtatatttagaaaaccccattgtctcagcccaaaatctccttaagctgataagcaacttcagcaaagtctcaggatacaaaattaatgtgcaaaaatcacaggcattccagcagtaatagagagccaaataatgagtgaactcccattcacaattactacaaagtgaataaaatacctaggaatccaacttacaagggatgtgaagggctcaacgaaataaaagaggacgcaaacaaatggccatactgcccaaggtaatttatggattcaatgctgtccccatcaagctaccactgagtttttcacagaattggaaaaaactactttaaagttcatatggaaccgaaaaagagcccgcatagccaagacaatcctaagcaaaaagaacaaagctggagacatcgtgctacctgacttcaaactatactacaaggctacagtaaccaaaacagcatggcactggtaccaaaacagatacatagaccagtggaacagaacaaatgcctcagaaataacaccacacacctacaaccatctgatctttgataaacctgacaaaaacaagaaatggggaaaggattcagtttaataaatggtgctgggaaaactggctagctatatgtagaaagcttaaattggatcccttccttacactttatacaaaaattaactcaagatggattaaagacttaaatgtaagtcctaacaccataaaaaccctagaagaaaacctaggcaataccattcaggacataggcatgggcaaagacttcatgactaaaacaccgaaagcaatggcaacaaaaaccaaaatagacaaatagtatctaattaaactaaagagcttctgcacagcaaaagaaactatcatcagagtgaacaggcaccctactgaatgggagaaaatctttgcaatctacccatctgacaaagggctagtatccagaatctacaaaggacttaaacaaatttacaagaaaaaaacaacgccatcaaaaagtgggcaaaggatatgaacagacacttctcaaaagaagacatttatgcagccaacagacatgaaaaaatgctcatcatcactggtcatcagagaaatgcaaatcaaaaccacaatgagatactatgtcacaacagaatggcgatcattaaaaaggaaacaacagatgctggagaggatgtggagaaataggaacacttttacactgttggtgggagtgtaaattagttcaaccattgtggaaggcagtgtggcaactcctcaaggatctagaactagaaataccatttgacccagcaatcccattactgggtatatacccaaaggattataaatcattctgctataaagacacatgcacacatatgtttattgcggcactattcacaatagcaaagacttggagccaacccaaatgtccatcaatgatagactggattaagaaaatatagcacatatacaccatggaatactatgcagccataaaaaggggtgagttcatgtcctttgcagggacattgatgaagttggaaaccaatattctaagcaaactatcacaaggacagaaaaccaaacactgcatgttctcactcatagatgggagttgaacaatgagaacacatggacacagggtagggaacatcacgcactgggacctgtcggggggtggggggctaggggaaggatagcattgggagaaatacctaacgtaaatgatgagttgatgggtgcagcaaaccagcatggcacatgtatacctgtgtaacaaacctgcacgttgtgcctatgtaccctagaactgaaagtataataaaaataaaaaagtataattggattttttgtaatacaaagtaaggataaatgcttgaggtggtggataccccatttaccttgatatgattattacacattgtagtcctgtatcaaaatatcttatgtaccccataaatataaatacctactatatacccacagagattaaaagttaaaactttttgaaaaaaaggagagcgggacacaggcacagggagaagatcacgtgaagataccagaagaaggtggccaactacaagccgacaataattaccgtcagaagaaattaaacctgtcaacactcgatcttggacttctacaaagtcacttttgccaaatgaagtaacattcacaggttttgggaattaggacatgaacatatcttttgagaggctaccattcagcccactacagctgtttgtaaaaagaagcaagcttcctgatggaagtaaacgttaccttcccaagaaaataaataaataaacaagacaaaaaacacccattccaatgtataggaaatactggaaacagaatactacaaggatgtaataaaaattacatgtttgtcatttcttcccagactacaggaaactctacagaacaaaaacccagtttcttcaacaattaaattgcaagagggaggaaaggagagatagatgaagaaactagtatatgaaaagaaagctaaacagcatcgtgcaattgcactgtgggggctgtatttgtatcctgatttgaaaaacttttttgtaaaaaaaagaaacaatcagggaaatttgagaacttgttgctttgtaagtacttactgtaaattgtaatatggatatattttcttaaaagagtccttttagatgtcatactgaaatatttataaactaaatgataggtctggaacttgtttcaatataattaggggtggaagaggtaggtgggcttaaagatgaaagaatattggccataaggggatgttttggaaactgggtgatgaagacatgaggatacattctattgttgtctttacatatgtatttgaaattttccataacaaagagtttaaaattttaaaaggttgaaatctcctcctcaagaggaacaaaacaaaaaggttaatagttttgaggacaagtttggcaactagagaggtgatcctcttagcttttctgcatggtgattagagaggctctgagggctgtgtaatgagctttcacagctattctagcttaaaactggaatccaagaagagaacaaagtacatttctctttgagaatatgtttattcagccagccttcccagaccatattctgacaactcctcacctcatctcaccccatcatcggcctggattaaatatcaccttgttctcttctcgtaccctttacacactccgtggtgtattttaattatgtagtctgtttggttcgcccagttcccagattataaattctttgcagatactaaccttgtttgtttgtcttattcatctatatatcccccttatccctgtgtttcatgttggacctggtaaactctctcaataaatggttggtggagtgagggggagggaagcagtagagaaatgggattgcactggtaaacaaaatgcaatatacacctactactttttgcgtctcctcaattatcccttttcccaggactactaaagtagaggtacagagttactttgaactttttttttcttctgcccatcttctagcagaggtgctaatgggctataatatactgcaaatgaaagacaagtaaggggtaagcgatatggtagcaaaatagaaagtggggttttttgccccatcagatgccgatttccactctttcccaaggtatgtaaatgcaatgaattcttttcagatggctgcctttctgtgctatttgttatgctgccttatcagaattctccttttatagaaattccaggccgggcgcggtagctcacgcctgtaatcccagcactttaggaggccgaggccggtggatcacgaggtcaggagatcgagaccatcctggctaacagggtgaaaccccatctctactaaaaaaatacaaaaaaattagctgggcgcagtggcgggcgcctgtagtcccagctactcgggaagctgaggcaggagaatggcatgaacccgggaggcggagcttgcagtgagccgagcttgcaccactgtactccagcccaggcgacagagcgagactcgtctcaaaaaataaataaataaataaataaatatataaataaataaataaataaattcctttctagcctgtcttcttggtatgctgtaagatggtaattagagtgtaacctcctcaagaaggtgctgagaaatactctacaaacactatttggtgctgtggatgggattatctggcagtttcctagtggatggcaatggccatgaaacagactttaagaggcccatacaattttagagctgggagagatggcaaagaccaatgtgtttccttatctgcacactattctgtgttacacagaatagctttttgtgtaaaaactatcttcttgctttcttaaggtattatatattgtccagtccccaaatctgatctagtttctaaactatcactttccaaatttatttttgagaaaataggacagataaataataaccattgtctaaaatgaaaaataaaatgcgtaacaccatttcttttttaccacagtgttggatgatttctcatttgtatagaaaatagcagaataaatcttaaactttataatgtaattggacattttaacctcattaaagacctaaagatattttattttctctttaggtggtccgggactacaatcttcagctgtttttgcaagaaaacgctgtatttcacaaaccccagcccttccagttccagccttgtgacagtgatactgtaagggaattatagattttcatttcatgtgttgttcagttgtgtttgtgcttaagtaacagttacccttggcatagacagacagaaaaagctgagtatatctcatcaattttataacaaaactgtgaggacacagaataattatgactttttttttctgaattgtggccaagaaactcagtgtctttatgctagcaaccttctaccaaatgaggttaagttataagacaagttactgaaacctgaaaacaactgagggaagaagaaaaatattcaatacatttactcaaatgtaaattatattttccctgaaattttttatgttgtacccctccacagaaatcagtggttaaattttaaccagagtaggccgtgcgctgtggctcacgcttgtaatctcagcactttgggaggccgaggcaggtggatgacctgaggtcaggagttcaagaccagcctggccaacatgacaaaaccctgtctctactaaaaatacaaaaattagctgggcttggtcgtgggcccctgtaatcccagctactcaggaggctaaagcaggagaatcacttgaacctgggaggcagaggttacagtgagccgagatcacaccactgcactccagcctggatgacagagtgagattctgtctcaaaacaaacaaacaaacaaaaaaaaaaccagaatagaattaataaatggaataatgaacatgtgtatgaaatattttggttggtcttataaaagattataggccttttataattcctttcagatttcttagaatattaaagcacttacataaacctcaaattagcaatttttttaatgcctctacccctctgccattttttttatggtagcagaatacacataacacaaaaattaccatttttaaccatagttaaagtgtgagattgattcactgtcacttactacatttccagtgctgtgcactgtcataacttggtagttccacaacatttcatcactttaaaaagaaatcctgaccccattaagcagtcactctccctatactcctcacctcagcccctgacatcattaatctactttctgtctgtagattccaactggcaatttttgtttttatttttacttatttattattattattattattttatttttgagacagggtctcactctgtcactggggctggagggcagtagcgtgatctcagctcactacagcccccctctcctgggctcaagtgatcctcccacatcagcctcccgattagctggggccacaggcacgcaccactgtgcctggctattttctttgtattttcaatagagatgggggggtctcaccatgttgcccaggctggtctcgaactcctgagttcaagccacctacccactttagtctcccaaagtgctggcattacggacgtgagccacgatgtccggccccaattggcaattgtttaaaagcatacagtaatcgtccttgagtttatgggaaatgtttgccattatttaaatttttaaaaaagaacaaaaatgctaatttggtaacataaaaattgaaatttaacttctgcaaaatgagaaggcacgcattggcattattagtacattctgtcaatgtaggcaagccaaaaggaaaatcaaattatattcataaagtattttgataaatttagaaccagaaccaagggagtttatgatatagttccagagtttaatggtatcagtttaatagaaacacatttgccagcgatatcttcattacttttcttatactttaagtagctctgttagcagctatataaagaaatgtaggaaatcagcatttccctctatattacaacctttgccctttatagtagtgctttttttttttaatcaaatcagcttttgccaatgacttattcacattctcctgtgatttgacttctttgaagcctgggagggatgaagcagagcattagaagatacagggtatagacaagtgtgtcaagcttgtcttaaaattatgactaatttgatgttattttatcattgctattttccacagaaaaaatcagaataacagtgactctcatctcactttttcccagcccaactgcagccctaaatcttttgtttctaaacactgtgctaaatgttcttaggtgttgtgtccttgtttgccttaaatttctaactctatgctatgttttttgtccttgtgcaatctttactgggcagagtttaaaagccgcccaactggtggatattgagctctcccctgtcagtgctctgagaatgaccatagctgaggtatatggggtgtgggtcaagggcgggagggatgggaagtgtgggtttgcatgttaatgaagggtgggacctggtgttgggatgaaagttatgtatatacatgtataagaggccctgatgcaccagctgtgttttctcttataaattaagaatttccttccctgtttatagtgaagaaattgagctactcatttttcatcttgtgtgaagcaccttaatcttcttcaacaggtgtgctggagagaaccttagagctaatcttgtctttattaaaggggaaactgtagcctagtaagggagacttgtccagagtcatacggtaaattaatgacatgttactgttgtgattgcaatagtaatgttatgtctgctgtgctattctgtcttctaagaagaaatgttcaggacttgggaagcaattagttttttcataatggaaaaagataaatgcctatgattttaaaaaatcattccagaccttcaatcatttaaaaagtctttttttttttttttttttttttaagatagggtcttactctgtcacccagactgaagtgcaatggcataatcacggctcactgcgcctcaacctcctgggctcgagcagtccttccacctcagcttcccgagtaactgggactacagctgatttttattttattttgttttattttatttttatttttggtagagaggggatgtcaccatgttgcttaggctggccttgaactcctgggctcaaaagatcctcctgcctcagccagacatgtattattgtctggctctgattataatcatcctagtggatatgaaatagtatctcgtggttctggtttgcatttccctaatgactaatgatgttgagtatcttcatgagtgtattagccactcatatatcttctttggtaaaatgtctattcaaaccttgtttctatttttttattggattgtgtctacttgttatgaattagatcttgaagatgagttgcagtttactctgcaaagagggagaagcaacatgccaggaagcaaaaacaaaaattgaaaagaataaaaataataggtgacattcattgaacatttatttcgtgctagacatttttctaatggcattacctatattaatttattttatcttcacaacaaccctatattgtaggtgctatttttaatccttcttttacagttgaggaaactaaagttaagaaatctggctgggtgcagaggcttacgcctgtaatcccaacactttggaaggccaaggtgggtgcattgcttgagcccaggagttcgagaccagcctgggcaacacggcgaaaccctttctctaaaaaaaaaataataataataatacagaaaactagctgggcatggtagcacacacctgtagtccctgctactcaggaagctgaagtgggaggatcacttgagcccgggaggtggaggttgcaatgagccgtgatcacaccactgcattccatcctgggtgacagagcaagaccctgtctttaaaaaaaaaaaaaaaaaatagaaagaaaagcaatttgctttgctcaaggtcactcagctaataagcattagagccagaaaagtttgaaagtacatgactatacctgaaatagcaagtagacttgatgatgaaagtgggatgcaaccaggtgttatttttgagttttatatatgatggtaaatggagaactatatactcaggtaagatagtaataggatgagatccattgcaggggcaggacagtattgttcttttattttgaattttatagtttgaattaggaattttgaactgcttatgggtttaacaaatttatttttcatttactaagcagacacttacatatactttgcatatgcccttgccttacaggcaagagaattcagcaaatattttatctaaatttacgtaagatatagttaggaaagttataggacttttaaagttaccactgtgataaaatgtaactcttctgatgattttcataaactgtcttaaaatttttttaactttttaatataacccatttcaaactacactgttttccctacaaaagtccaagacacccaattgaatatgtatagtcacagtattattatagtaatttaattagggcttttttgggtagaattttaatattaaccaaaagatgactacaagtgacagtgaccaatggcaagctttgttcttatgtagtaacttaatagctgtctcatggttaatactgaaggattttcttatctatatttccataagagagttactgatttctaaagtgttctttctttatatcttcaattatcatttctcagatgataccagaaagccagagctctttctagaaaaagtaaaatacatcttttttgctgaaatgactttttaatgcagaatttttctgaggaggatatggaatgtgcctttaaatcttcctgtctataataagaatattctgtgagagagaactgacaaacacatttattaggatctcaatgttagagtcattcagctgacacatggatcacactggggttagtgattcatacaggtggtgtacaatggagaaaacatgggtttgggtgtctaaactagcagtttatttacatatatttaacttttgtgattcagcttcctcatgtgtaaaatgacaacagttgtcccttggtttccatgggggattgattctaggaacctctttgtgtaccaaaattcacagatgttcaagtcccctatataaaatgatgtaatatttgcatataacctgtgcacatccttcatatattgtaaatcatcactagattataatccctaatacaatgtaaatgctatgctaataatggtcctattacattgtttaggaaataagacaaagaaaaaaagtctgtacatgttcagtacagacacaactatccttttttttttttttttttactctttttaaaaaatatttttgatccacggttggttgaatccacagatacagaacccacagatatggaaggacaactataccttatttgtttgaaaattaaataggatactaagcatttaactcaatgcctggcacattgagtcagaatagatgttaactgacttcttaaaatctttccacaggacggccgggcgtggtggctcacgcctgtaatcccagcactttgggaggctgagagctgagatgggcggatcatgaggtcaggagattgagaccatcctggctaacatggtgaaaccctgtctctactaaaaatacaaaaaattagccgggcgtggtggcgggcacctgtagtcccagctactcgggaggctgaggcaggagaatggcgtgaacctgggaggcggggcttgcagtgagccgagatcgcgccactgcactccaccctgggtggcagggtgagactctgtctcaaacaaaacaaaacaaaacaaaacaaaaatccacaaggcaagcatatttctttcttttttttttttttttttttttttttagtattttccccctaattgctacaggaaataccaaatatcaaatatagaagacattacaaatcttgaaatacttgcaatacttttgcagtcatgatccctagctctcaactcccttattggattgatcactaaaagtcccttgggacttttgttctacttattccacaaagaggatctcatcaacggccttcttggcagtttgtacatctgaaaggcaatctgtttggaataattttaagtacatgacttgtacttttcaacatctctgccctatgtacatctcagtgacctatcctttcattaccagaactagtgatgagtgccattaggggcattttctcacatcctgtgaaaaaggacaaagcgaagctgggatgggaaataatatgggaaacatgcatgtccacaaaacttagataagtatgatctatacaggcaggaaaaacacggaaacttcctcaggtttcccagtcggaatgagaatacactttcccctttaccttctttgaacagcaaataacaagatcttcacagatcatgacagcaaaaagctgacactaaatttctgatgtatgatctttccctgttattctagatgctatttctgatatttaattctgccttctatagattaaaaattatagtaagtaaaatgtccacttgctgtagttgaggatttttacacattaaagttttacataaggggagtgatttatgcatctattaaaaaaatatttggcaaaaatttcccttgtctataaaagtctacatggggttaatatactgtgcaggaaatgtacctgaaaattctctttgttatgggtggctctttctgcttgtagaaattttgtattgcatatagcgttgtctcataaatgtgaaaaaggctgtgatagaatttgtgggatgtcctcctgttgagtaaataggtaccatcctcttacacatgcttggcacagtatccaaaaatgagaggctttgactaaagacatgagtgttgcgttttagaattagcaatactgacagttaagtgttcgtagtggttgtcctaatttcttcagcgtttcacaaaaggctttttgtaaaaagtccactatctatgtgataggccctctactggtttagtcacctttctcctgatctggttccttgtctaaccatccagagtaactagatctttgcatagacgcattagttatgtgctgacaataggagcctgaaagttcccctatctagcttgtgattatagctcttaaagcaagatctctgtgagagctaccaaaataaaggcatactctttataaggctgttccatctaaccatgcctctaggtatgttctcaaaagtgttagacgcaaggtttttatgccatttttgttttactttcatgtcattactcagggacatattttttgctaaggtttgcctttggtactcttaatccaagacaaaagaatagctcctttcagagttctcatcatttcttcaccccagccttaatgggtatattccttttccccaggtgtccagagttttccagaattgtcccaaggctcagtccacaccagttcttctccagtgtgctctcctgagaggccaggcacactcaacaattatctagatgagttcccacttctttccaagtgaaggttctgctatcctagcatagtcagaataagttaaattatgtctcttaagaggcactgttccactcctcttcaaggtgtgtggcatatttgaaatatgtgacttaaaagtctacagtctcttaccaaaagccttgggccaaatacatgtcaaaattcagaattttccagattttagaaaagtgacccatataccatacattgcataaaaccctgagcaatgtatggggaagcacctgtgaccaaacatagtatttttgcagtgaaacatatgaatattttcattcatatatgtatatatgaaagaaaaaactataaataacctcttattagttcaaatcacattttggctcaagtgagttttggctccaaacttaccaaaaaatacttattctttttcagagcattttgaatttcagaattgtgggattgtgaacctgtacaaacgtgtagttggaatacagagatccagatgctttttacttgaagaagtccttttgaggataaataattaataactttattgaaataattaaccatatattaatatacttcataaagaataagatggatccaatatttaactcaatatattaatatatattttttgagaagctctgtcacccaggctggagggcacaatcatagctcctggcagccttgatctcttgggctcaaacaatcctcctgcctcagcctcccatagataggactacaggtatgtgctaattttttttaagagctggggtctagctatgttgcccaggctggtctcaaactcctggcctcaagcagtttttctgccttggcctaccagaacactgggattgtaagtgtgagctactgtgcccagccccagtatatttcttgtctctcagtaaactgaaaaatgtaagtagtacaaattccctgaatgagggttaactagaatgttatgccattggcctaacaaccccaacactatctttttttgaaatggtttggaatgctagtattttactgttagtgattttcattcatcatacatgaccatctctttttctctccttgaaatggttatattttagttacagagttaaaaaactgattgttttcttctgcgaagtcagcttttctatcgctgctcactctgctcagatatctgagccttctatgcctttgtattaaccttaaaataaaacaaaatcatatcttgagagagcatctaaggacaaaatagttaagatgacttaaagactaatatatcaagaatattggaatgctgatttccttaatttagttcttcaaagttatttaataactttatgaatgttgaaaagactttattgtaatattttattctaaagggactagagttttttttttttttggagacagagtctccctctgtagcctaggctggagtgcagtgccacgatcttggctcactgcaacctccggcgccaccacgcctagctaatttttgtatcaaatacatttttaaaagataaaggaaaaatattgggctgggcatagtggctcatgcctctaatcccagcactttgggaggtcaaggcaggaggatcatttgaggccaggagtttgagatggcctaggcaacatagtgagatctcatctctactaaaaatcaaaaaaattatctgcgtgtgatggcatatgctgtggtctcagctacttgggatgctgaggtgggaggattgcttgagcttgggaggtcaaggctgcagtgagccatgattgcaccaccgcactccagcctgggcaatagagtgagaacctgtcttccaaaaagaaaaatgttaaaagaatgatctaggccaggcgtggaggctcatgcttgtaatcccagcactttgggaggccaagaacaggtggatcacttgaggacaggagttcgagaccagcctggccaacatagcaaaacccccatctctactaaaaatacaaaaagttaactgggcatggtggtacatgccctgtaatcccagttactccggaggctgaggaatgagaatctcttgaacccgagaggcagaggttgcagtgagctaaaatcatgccactgcactccagtctgggtgacagagtgaaactctgtctcaaaaaattaaaaataaaaataaatttgccagcattttaaaaagaagcagtcattacggtttctttgttagaatcgaccactgctaatatcactgtcttaaaaaaaaaattaccagccacgcacggtggctcacacctgtaatccaagcactttgggaggccgaggcgggtggatcacgaggtcaagagatcgagaccatcctggccaacatggtgaaaccccgtctctactaaaaatacaaaaaattagttgggcatggtggcacatgcctgtagtcccagctacctgggaggctgaggcaggaggatcacttgaacccaggaggtggaggttgcactgagctgagatcatgccactgcactccagcctggccaacagagtgagactctgtctcaaaaaacaaaaaacaaaacaaacaaaaacacaaaaacataattatctatactagatcctgatttatattgatctttgatagtgaaggtggtattggaacatttctctgtgtattgtttaatagcctgggctgtattcaccttgtatgaaattctcagttgtcaagacctgtgtctcaggagcttccacatgtattccatggcttgatttcagaattcatgaaaaggataaattaatttgagttttagttttgtgtcattccctacccaaaggatctcaaagccacatcttccaatcagtggcattagttacctgtcctgatcattggactcccaagtcttagtagacacataaaaaataagggaaaagctctatcctgagcacagtgaatactcaataagaaggtataaattctgtaaggcaaattgggttatggcccatctgcagccagcacacaatttaaacccctttacctattcctaaaatgctgctcagtaacaaaaattaaatgtctctatcagttgcctcctttctcatctagctactccctacaaattcattctctttgagatctgccttaatctttcaatatatcttcaatcttcattttggattcattgtttaggctattaagaacctaggaattatctggattttcttatgaacagtaataagaaaatttttgtttcaagtaattttcaattgggtctttaacattaacagttaccattactggatgcctaagatattatgtagatcctataccagaatgtttaaaatatgacctcattataacctaccaaccctatggagataggtgacattttcactagttttcagatgtagctacgactcagataattaacatgcccaagatcataaagctagtagtgccataaaatggcatacaatggattcaaactaagtctatctgactcaaaaacctattcttggactcttcagaatttatctttctacttttacagatcacattcctctgacttttgtatatttcatttgtatctgtgtccagagtttaacactttaatattcctgactttgagaacagatgtaagtttgaatgcccagattcatttgcaaagcaaaatataatagtaaagttcattcccaaacttctgataaccccaaaaatgaattagaatgtaaaatatgaatgtaaagatggttaagtttgaatattgattattttgctctatttcaatttatttgtcattgttataatctagctgaaatgtctgtatagaacaaaaatttttaaaccctgcctcatcacaattcccccaacaaaaatattaatttttaaaatccagtttatcaatttctacttactctatcaattttgagctatgagaccttgcaaaagaattactaggccaggtgtactggctcatccctctaatttgaacactttggaagaccagggtgggaggattacttgagccaaggagttcaagatgttgaactcctatgttgcctgggcaacatagtgagaccttatctctagaaggaaaaaaaaaaatgagctgagtatggtgacacacacctgtagttccagctactcaggaggctgaagtgggagagtcacttgagcccggaggttgaggctgcagtgagccgtgatcagaatttctaaaattcttttcattctacaattttgctgctttctatattaaaagcctctttgggtaatttatattttaaaaaaaattcctaattatctcaataaagtttgtttttcttgggtctttaagaatttagagagaattaaaatagttttgtgtttaatagctctgattctggaatcggtcaattaaggttgtaacatttaacatctaggacatccaggaaaaattaacctctctgagcctctgttttcttttctataaaatgatgtgggacccacatcatcaggttgttaaaaaaaaaaaaagttatatgaagcactttccatagtaccttgcacaatagaagttagctattactatttttatttagattttgtggtttgttctttgtaaatcagaatcatagcattttagagctagaagaaacccttggtgatcatttgatctagcacccttatctttcatatgaagcctggagaaagagcaaaagctggcttttgaggtttggtggcaagttgatggtggacctctaaagagttccgtctgccttggggcagggggaggggtgcaagattgtgttgctgttattatattgttttgttcttacttctctttaatgattctttactcacatttaaactattaagttgtttccatttttatttatgcaatgattttatcaccatagtaggttggcatgaatacattttcttctttgcttaccttagctagcttccttcccactcggaaagataagtccatcacacccaaaaagataagtctgcagtattatagatgatgcttttgtgttcagcagtgtaagacaaaaagcttatggtctttaatggttttatgctgatcttactcttctggtaactttctgtgacgttaagacattgcttccagcagtagtggagcgtgcctcatgttttgagtgctgattaagtgaaggccttctgatccatctacaaagcagtagtggttacaataaggatagcaatatttttatctctgttctctcttgtattgtagagccgacagttagaatcagaaactgggaccacagaggagcacagtctaaataaggaagctcgaaaatgggccacacgtgtggcacgtgagcataaaaacattgttcaccaacaacgggtaagtgtaagagaaagtcctagttacattcaccttaagccaaatgtcaaacagtttaaggaactgagttttattaatgtgaaaaatatcctatatgtgttgttttgttttatttgagacaagaggcttgctctgtcacccaggttgaagggcagtggtgtgaacatggcttactgcagcttcaacctcctgggctgaagcagttctcccacttcagcctcccaagtagctgggaccacaggcacatgccactatgcctggctaaatttttttagattttttgtagagatagggtcttgccatgtttcccaggctggtctcaaactcctttgctcaagcattatatgtgttttttctgtactttctcaacactcagcagtgtgctgtcagctatctactcatgttggaatttccttaagccctccatcagcaatacattaatttacctgtttaccataaaattaacaaagaaaattgtgatagtgtattatgggcaggggaagagacatatgttgaattaatataagttttcatccctcaagacatattttttaaaagacataattatagccgggcgcggtggctcacgcctgtaatcccagcactttgggaggccgaggtgggtggatcacaaggtcaggagatcgagaccatcctggctaacatgtgttacggtgaaaccccatctctactaaaaatacaaaaaattagccgagtgtggtggcgggcacctgtagtcccagctactcgggaggttgaggcaggagaatggcatgaacctgggaggcggagcttgcagtgagctgagatcacgccactgcactccaacctgggcgacagcgagactctgtctcaataaaaagaaaaaagaaagacacaattatagatttcatgaaaatatatgtttggctgggcgcagtggctcacgcctgtaatcccagaactttgggaggctgaggcaagtggattgcttgaaccaggagtttgagaccagcctgagcaacatggcaaaaaacccggtgtctacaaaaaattcaaaaattagtcgggcatgggggcgcacacctatcttcccacctattcgggaggctaaggttggggagaattgcttgagcccgggaggtggaggttacattgaggtaagatcatgcctctgaactccagactgggtgacagagaaagaccctgtctccaaaaaaaaaaaagaaagaaagaaagaaagaaaatatatctcgaagactaaactctaagcacaaagaaattatttggagtatagtactttttttctgtttcatttattgatacctatatccgtctcattctttgccttcacatcctgcttcttaaaagaattgcctatgcttattatctatagaatctcacctcccacttactttttagcccattacatttgagctttcctgtcctttccttcccctgtctaagcttaccaaaatcgccaatgatgtctgtgttgctagcttccaagtggacactttgatttctcatttttcttaatctgtcaacaatttcatcacaattaacaattccatgtcttaaaatgttatcttctctagtcatccacgattcaacattgtcctggctttccttctgcctttctggccatacctagattttttcatgggttcctctttctccatcccacaatgaaatattcagtttctcagattcctatacttggctatcttgttttcttattctttaccctcatataggcattctcagtcacttccatggttttactttaccaccaaatcataaattaacatcttcaacattgggccttgctactactgtgtatccatataatctcttgcctgttttgacatcttcttttcactatctcacaggtgtctcaaattcagtgttccacttatgtaatgttgcttaacaaaccacctcaaacttaatgccatagaacaagagggtttttacattatctctcactaatctgagtattggatggtctcagcttagcagtttcccttggggtctctcatgtggcggcaatcagatagtggctggtcctggcttccccactgaagggactgtctgtagtaagtttgttactagtaagtctataattatttcaaaatgttcaaaaaataaataaatgaaaaaaaattatggctactagtcactaaagccctttgaattatgtaaatactttaatcacttaaggaagatgaaaagtaaaaaacagtcatcattattgtcccattttctttaataggttctaaatgatctggagtgtcatggagctgctgtatcagaacaaagccgagcagagctagaacagaaaatagatgaagctagagaaaatattcgtaaagcagaggtaaggtggcagctaattgtggcattttgcccaggtctaatgacactgtcacagctgtgatatacatctttaaaactgagtttctacacacactgagatgaaggtgattcaccgtcttcattcgtgtccacagtagtatttgttgagtacctgctctgtggaaggcagtacatataacaaaaagatgctgtaaagtttacagtcatgaaacattaaatacaaaagatttaagtcacaatgaagatactaattttaaagtttctaaaaggtacataataaaccacagagattaatggtagaaaaaatgatgtatatatatcaatttagatatatatatatatctccttatatatcaatatctatggagacatatattcatatatatatatatattttcagagcttaggaaatctcccccatatggaaggttccctggatccaggggcatgagctgggcttttaagaatagggaagatttggctaagcagagatgggaaaaaatttataatagtggattttaattttttgtggagtcatgggacctttgagggttgtatgaaagctgtgaaacattctctcccacacacaaaaatgtacattttgtgtagtgtttagagttcttatgcctgaggctaatactccctgctctagatagggagaggttgggataggaaacaagaaagtattagcaaaggaggaagacacagagtataatttggtagctggatatgattagagtggaggatttttgtgaggaaatgtggtagaaagtaagtaaacttgttgtggttagggccagtttatggaggacctgtgcacacacttttatctactcagcagcaatgtggtgaaggggtatggaggtagacatttataaaagactgacaccatccagccattaaaagattaggttcttgttagaaaggcataaagaatgccaaaaatcactaagatggtaaagcataactgccgaggagtggtgcattaagtatagttgaagaacccagaggccacagaaatcactctgggagggattgttgcgggtgtaacacagaagaagacttaagatgaatgctggcagatgaatagtatttgattagtcagagaaaaggggatagcacagacttatgccatgcaacttcaggaggtagaatttgaaccaaaagatgaaggtaggaaagaaggagatgtgagtttagtattgggaaatactttctaatagtcagatcttcccaaagacagaataagcactcctgagacatagtgcagccctataagtatgtaagaagattctgggcaagcatctttcagggacccaatacaaggaatccctgcactggtttaggtttaaactaaactaatggttttctaacacccccttagaactccagaggttttgaggaagtgcttcactggttgtggggtgaagggagaggcagcgtaggcaagcatagagaatatgagcatgtttttggtacagccccatggaagtgatctgaatcagaacaggcttgccatctgcctgggctggagaaaccccagtaaccccacctccacttcattcctgttcacagtctaattgacagccaccatagtgaggagggcagggtgtacaatgaatagtcatttttctctttgaattcagggtcatgtctaaaccactatcttagggtgctggccaagtagtgttggcaagccctcatctactctaagaaacactggcctgtggtagaagagttattcctgttgtttgtttctccgcactctagatgaagccagtttttcagagccttggtggaacaggagtaattattttaagacaagtctcagaggttttctgaggggtatttcatgtattttccatttccagaccccatgcatggtatcaccgactggtaccctaactccacgaaacctcccgccatccccagtagtagcagtagtaggtatcaggcacacagagtcttcatttaggccagatgacctattatttccatagtatgccaaactagactgtgtttgttagtttcaaactaaaaatatgaagtgaaattctcataccacgatgtctcacctcttctaatgcaagtatttaagtctacattctcaaaaatagttttcttatcaaaaatgttgaatatagtatgctaaaaccattgtagcagatccgttttctcagttttgaatatctgtagcatttaattaattttactgttagcataaaataatctcacttggtttccacttaacagatacaaaaaatagcctaagtaaaattagccagcaaatatgagggcatatttattggggtagtacttacaggattatcataataaaatttttggatggactagaccatgagagtcttcaaaggaattaacaataatggtttctgcacatacccttttcctttcttctgcctgtatatcatttgcagtggtttttcgtttttatcgatactttatttattataaatacctatacaaaagagagaacactggttatataaaatgtgagtcctcattattgcaaagttaatgacaagagtgaccctgctattaaaacaaaatttttaggccaggtgcagtggttcatgcctctaattctatcactttggaagactgaggtgggaagatcacttgagctcaggagtttgagagcagcctgggcaacagatgagacatcgtctctgttacaaatgaaaataaattagctgggtatgctaacatgtgcctgtagtctcagctacttgggaggcagaggcttgatcctggaaggttggtctgcagtgagccatggttggaccactgtactccagcttgggcaacagagcaagactatatgtatgtgtgtgtatatatatgatcttttatatatatatatatgatcttttatatatatcatcatatatataaactatatatatgatcttatatataaactatgtatgattatatatatgatatatataacatacacacagatatatatatatttctaatcacattatttccaaatttatattacctctgggcctgttactgtgaggtttcactgtattcatgctatgttagcagacctcttgactaatcacttttatttttttactgaaaattttcaaacatacagaaaatatgaagaataaacatgtatttcctaacatctagattcaactattatattttgcaatactggctttatgtgtttgttagattgacccattaactgtgttgtataaaatggaagttaggtcttaaggcctgattagaggcaggttagtgttttaggcagaaatagttcgtagatgatgtgatgtttttcatcacataaagaatcataatatcaagttgtcctgctattaatgatactaagagtggtctcttaataaggtggtgtgctaccagatctttccatgataaagattctttcctctttgcaattaccaagtgctagtcacctccagtggtggtgaatgggtatttttttttcttgggtattattatgacctcattaaaaaaaattttttttttttttttttgagacacggtctcactctgtcacccaggctggagtgcagtggcacgatctcaactcactgccgcccgaacctcctgggctcaagcgattctcccatgtcagcctcccgagtagctgggaatacaggcgcactccaccatgcctggctaatttttctatttttttgtagagatggggtttcaccatgttgcccaggctggtctcaaactcgtgggtcaagcaatctgcctgccttggccgcccagagtgctgggattacaggcgtgagccactgcctccgacttgtcagtctttttaaacttagccatttgagtatgtgtgtaatggtatctcactgtggttttgaattgcatttggctacagactagtgacattaactaactatgctgagcatctttttataagtttttagcccttcatatatcccccttagtaaagtatttgttaatatcttttgcccaaatttagattggtcttattactgagttataacaatttatgttttctggatactagtcattttttaggtacatgtactgcaaatattttctccagtctttggcttaccttttcattttctagattggaaacttttaattttgatgagattaatttatgaattttgtcctttatgattagtgttgtgttctaagaaatttttgcctgatcaaggttgtgatatgtcctctcatgttttcttctagaagtgttatagttcaagcttttctttgtggactgtggtcctaaacatttctagttaaattgttgaggtctggtatgagttaagggtcatgtttggtttttttgttgttgttttgttttgttttttcctatacagatagccagttgttccaccatcatattttaaagagtatgcttttcccattacctttgcacccgtattgaaaacaactaatcatatgtgtatgaatattttcaattttattcagttccattggtctatatgtctgtacttatgccagtatcacagtcttaatgacattgtaagtcttgaaatcagatagtataattcctccaacactattcttgttttagaattatttggactattctcattgccatcagcttctacaaaaaaagactgcgggcattttgattgggattgcattgaatccacaaataatttgaggagaattgacttctcaacaatattgagtcttctaattcatgaacatgatgtgtctctctatttatttaggcactctgtttccttttttggcttcttaattttttattgatacaaaataattgtacatatttatgagatgcatgtgatattttgatacatgcatacagtgtataatgatcaaattagagtaattaagatatctatcacctcagacatttataatttctttatatttagaacatttcaaatcttctagttattttgaattaattattaactagtcaccctgctaagctatcaaacaccagaacttatcccatctatctaactgtttgcttctattccccaatctctcttcttctccttccccataatccttcccagcttctgataaccatcattctactctgtacttttttttttttgagacgaagtcttgctctgtcacccaggctggagtgcagtggcacacgccaccacgcccggctaatttttttacttgtaataaaagacagggttttaccatgttggccaagctggtctcgaactcctgacctcatgatccacccgccttggcctcccaaagtgctgggattacaggcatgagccaccatgcccagcctctgctctctttttttttgagacggagtcttgctgtcacccaggctggagtgcagtggcgcgatttcggctcactgcaagctcctcctcccggcttcatgccattctcccgcctcagcctcccaactagccgggactacaggcgcccgccaccacacccagctaattttgtttttgtatttttagtagagatggggtttcaccgtgttagtcaggatggtctcaatctcctgacctcatgattcgcccccctcggcctcccaaagtgctgggattacaggcgtgagccaccgcacccggccccagcctctactctctacttctataattaacattttttagctcccacacatgagtgagaacatgtgatatttgtctttctgtgcctagcttatttcacttaacataatgacctccagttccatttatattgctgcaaatgacaggatttcattcttttttatgactgaatagtattccattgtgtgtatatatcacattttcttaatccactgatggacacttaggttgattccacatcttggccactgtgaatagtgctgtaataaacaggggatgaaggtatgactttgatacactgatttcctttcctttggataaatatccaaaagagggattgctggatcatatagtagttctatttttagtcttttgagaaacctccatgctgttttccataatagctgtactaatttacattcccaccaacagtgtataacagttcccttttttctgcatcttcactagcacttgttattttttgtctttttgataaatagtgattctaactggggtaagatgatatctgattttggttttgatatctggttttgatttgcattttactgatgataagtgatgttgagtattttttcatatacctgttggccattatgtcttcttttgagaaaagtggttacacatccattgcccaatttttaataagattacatggtattttgctattgagttgtttgagttccgtgtatattccgtatattagtcccttgttgcatgaataatttgcaagtattttcttccattctgtaggtcatctgttaactcttttgtttcctttgctgcatagagtttttaatttaatgtagtcctatttgtctgttttttgttttgttgcctgtggccttaaagcctcagccataaaaatctcccttgaccaatgtccagaagcatttcccctatgttttcttgtactagttctatagtgtgggtgtttgtttgttgttgttgttgttgttttctttttttttttttcgagacagggtatcactctgtcacccaggctggagtgcagtggcacagtcacagctcactgcagccttggcctccccaggctcaggtgatcctcccacctgagtttttgtatttttagtaagatggggtttcgctatgttgcccagactggtctcgaactcctgggctcaagggatccacccgcctcagcctcccaaagtgctaagattacaggtgtgagccactgtgcccagccataatattgggtttatttttaaagtctttaatcattttgagccgacttttatatatggtgagagatagggatctagtttcattctttggcaggtggatattcagttttcccagcagcatttattgaagagggtgtcctttccccaatgtaaattcttagcacctttgtaaattggttggctataagtacattatttctgggatgtctgttctgttccattggtctgtgtgtctgtatttgtgacaataccatgctgttttggttactaaagtcaggtagtgtattacctccagctttattatttttgctcagaattgctttggctattcagggacttttgtggttccatacaaattttaggatttttttttctatttctgtgaagaatgtcattgattttgatagcaattgcacatggattcgtttttgtcctcttcaatttctttcatcagtgttttgtagttttccttgtagagatctttcacttccttggttaaatttattcctggggttggggttttttgtttttttgttttttgggtggtttttgtttgtttgtttgtttttgtcttgttttggtttggtttgggtagctattttaaataggattacttttttttttttttttttttttgagacagaatttcactcttgttgcccaggctggaatgcgatggcgcgatctcggctcacgtcaagctccgcctcctgggttcaaccgattgttcggcctcagtctctcaagtagctgggattacaggcatgagccactgagcctggcccattatgccttgatatatgttttctgtcctcttctatgatttcaattacatgaatattaaatcacttgatattatcctacatgtcatatgcaaagctcattccacacatttttatctggccttattttttatctcagtctcagtttgatgagttattattagtgtctattaaaacctatggatatttcctctatagtgtataaactactgttaaggccatcttgtgaatttttatttcaaatgttatatttttagctctataagttctatgtggttcttcttttatcttctagttcattcctatttatcttcatgtttttctttaaacctctaagtatatttataacagcaattttaaagttcttgtctactcattccatcatctctgtcatttcattctttttattgactgatttttgtcttggctcatgtttttctgcttttcaaatacctactaagtttttactgaatctagacatagtgactgtttggttattaagtttctagattctattttcttcttataaagactattgagttttgttttggctgccaggtcagttacttgcagatcagtttgatcatttcgaagcttgcttttaagctttgtttgggttaatgtagagataaattagaaattagccctatactaatgccgtgggtatacaccaagttctctcaactctggctggatagagttgtaatatctttttttttgtttttttgttttgttttgtttttgagacaaagtctcactctgtcgcacaggcttgagtgcagtggtaatgatctctgctcagtgcaacctctgcctcctgggttcaagcagttcccctgcctcagcttcccaagtagctgggattacaggtgcccgccaccaaaaccagctaattttttttgtatttttagtagagacggggtttcaccatgttggccaggctggtctcgaactcctgacctcaagtgatctgcccgcctcggcctcccaaagtgctgggattacaagcatgagccaccacagagttttaatgtctttcaaccctgtacaagctctaggaatttttcagttcatagctctactgtagatattcttttcttagtagttattgtttgcctctcctcctggagttccacctgacatcatttcaacttattatagatttttatctatttagtatattatcaattccagttgtcattttaagttccatattatctaaaactgggagtccattcaactgacttctgtgtacttttgacattacccccgttagtccttgaatactttcttcctagtaaaacaagctatcacagtgttcaccttatatttttcctgcccagacttagaattagctgtttctccaagaagctctgattctcttaatagaaaatggtatttagacactaaggcctgggctgtgaaggtgcttattgttctaagtgtcattttcttttttatcttttctttgttgttagagctagggataactttttttaagtcatgagttcatgttgatatttccaattaacatggacaattagagggattttacttatttttagagacagggtctcaatatatttcccaggctagaatgcagtgactattcacaggcacaatcatagtgtactatagccttgaactcctggactcaaatgatcctcctgcctcagcctccaaaatagttgtgactacaactgcatgccactatgcccagccagagggattttattgaacttatttgatttctttgattttacatttatttatgttctttttgccttacaccaaaaagttttattcctaatcatattatctaatattttatttgctttatatatttaaaaaaattttttttgagacagtgtctctgtcacccaggctggagtgcagtggcactcattgcagcctccacctcccaggtttaagcaatcctcccacctccatttcccgaatagctggggctacagacatgtgccaccatacccagctaatttttgcattttttgtagagacagggtttccccatgtttctcaggctggtcttgagctcctgggctcaggcagtctgcatgcctcagcctccaaagtgttgagattatagacatgagccactatgcccagcctgctttgtatattatagaataataactgcagtatatattaagcactttcagaactacaacataaatattgctattaatagtaaactattgaaagttttagatttctttataattctctttgaatgtagaataaatatatctctaagagactttctgcttcttgtaataggttactagcttatataagactattttagatgacaatattaatctggggtaaaaatattaaaacaaaaattatttaatagagctggaaaatgacccaaagcatgtaaaacctggagaggaatttctccttgaaagaacaagactatacttagtgatatttccattatatagccctgcatctgtaaggagcagcacaaccagaatttaagcagaacctccatcttactggcctgaaggtggatgtcctttggaacagagactctaaggagcttggcaggaaacaataactgaaaggcaaaaaaatccaggagaaattttagctgttgcttatcacaggagaacaaacactaatcattaaaaaaactgaagtggcaaaaccccatctctacaaaaaatacaaaaattagccgggcatggtggtgcacgcctgtagtcccagctactcaggaggctgaggtgaggtaggaggatgaggctgcactggaggcagcctggaggttgaggctgcactgagccgtgatcgtaccactgcactgcagcgtagacaacaaagtccagaccctgtctaaaaaaaaaaaaaatgaagtgatcatattactgttagacaaaatacattttaggacaaggaatattaaaaaggataatgcataatgattttttaaagacatttcatcatgaatatattaaaatcctggacgtatatataataataatgctacaacatacataaagcaaaaactggcagaactgaaagaagaactagacaaatctacaattgtagtaggagtctttaggatccctctttcagtaattgatagaacaagaatatagaaaatcagtaaggatatagaagatgaacaacatcattaaccaactttacctaattggcattcatcgaactccactgcatatgagtagaatatatgttcttttaaagtacacatagaacattcaacaagaccatacactggaccataaacctgtttcaataagtttaaaaggattgatattatacatagtaagttcttgattaattaggcttatattaaaaatccataatagaaagatggctagaaaatacccaaataattggagattatgttgttcaaacacagtaatctgttgctgcctttgaaaaccatcccaaactttatggcaaaaataacagtggtttattatctgttgccattctgggtgctgactatgcatttccttttattcttttattttcttttgagaccatctcactctgtctcgcaggctggactgcagtggcacaactcactgcagcctcaacctcgtggcctcaagcaatcctcccacctcagcctcccgaatagctgggactacaggcatgtaccaccaaacccagctaatattttattttccttttttatagagatagggtcttgctattttgcccaggctgcctcaaacctcgaattcctgggctcagcaatcctcccacatcagccttccaaaatgtggggatcacaggtgtcagccactgtgccaagccaactagtcatttcttttgctggttttgcctgaggttactcaagcaattactttcagctagaggactggccagagggctgggctcagctgtgatggctgggtcttttccccatgtggtctttcatcagcatataggttaaactggacttccccagcatggtggcagcatatttcaagaagtcagatccaaatagcacttactgagggtcctctgtttccattaaattggcaaatgccccactagccaaagcaaatcacatggacaagcccagaatcatggtgggagtggactacatggataccaggaagcatgattatttgggaacctttaatataatggtttaccacagttggtgtgaccttgattaaatcatttttctcatctataaaatggagttttggggctagggatggtggctgacacctctaattccagcattttgggaggccagggcaggagggcggaaggatcgtttgaggccaggagtttgataccaaccaggcagcatagcaagaccccatctctacaaaaaactttaacattagatgtggtggcatatgcttctggtcccaactgctcaggagaaatccaaggttacagtgagctattattgcaccactgcactctagcctgggcagcagagcgagactctgtcaaataaataatagctagctagatagatagatagagtttataatattgacccctagaattgttttgtgaattaaatgaaatatatgatgatatagttcctagtacctatgataaaagctgtttggagcttttttttaaggtaccaaagatggagtagcaaatactattatctaccattattgattctattctacaagtaaaccactgtcctaaatagtaatacattacacacagtccttgtccttagagaagagatatgttaaaggcaaatgaattagtccaaattagatttacagacttgaaattcaactatagctttacacttatatgtgtttatgttaaatgttgtgttaaaatctaggtaattgactgtgtttataaaccaagattatgtatcctaaaagatctggatttttaaaatactatttttaaaagctctgtctctttaaagcttccaaaaatgatttggtcaagtagtatctggaatgccatcaagtttacagagagctatactctgaaaatttttaataagttggcaaatcatgaaaattcatttgaaaacactagaaagttctgcttttagacaatttttaacttataagcaactgaaatcctaaagggaagatagcagtgtttaattctgggactgcagtctaaatctgagttggcaaataccatgtttatctgttgtttgataaaatactgacaaaatcttataaaaactggattacttgaataactgctttgagaaaatagaatgtagtgaatacttctctcttttctgcttcagcaattaaatgacttgcatatgtgatttctaagaaagagcttgttggttcactcttttaaaaaacaaaaataaaaacatttcattgttttaaaatgaatactagaggtcaggcacagtggctcgcacctgtaatcccagcattttgggaggctgaggcaggaggatcacttgaagccagaagttcaagaccagcctaggcaacatagtgagacagctgtctctacaaaaaattttaaaaaattagccaggcatggtggcatgcacctgtagtcctagctactgggaaggctacagtaggaggatcacttgagcccagcagttcgaggctgcagtgagctattgtcataccaccgcattccagcttgggcaacagtgagaccctgtctcttaaaaaagcaaaagcatactacaatggtgctagggcaagtggatatccatatgcaaaagaatgaagtttgaccctgttaaaagataaacttaggcacattaaatttttttttatttgagaaaatagtgataattacttgggcagcaccagatcatatgcagttcagggttccaccaatggaacaccagaggaatgcttttatagggtgaactcagaagcaaaacaaagcaaatatttgattggttaaagtggcacggtagtatccttttttggatcattccagtggaaggtttctagttagaaggtagttggcagtttttgattggttaagcttcagttttgttttaccatttatactgagttgagttttggtttgcttacgtaggaacccgggatgctggagctgcctcagtttaatgaccttccagttaattatcttaacaaccccactttacatcatatatacaaactaactcaaaatgaatacctaaatgtaacagcgaaagctaataaacttacaaaaaaaaccacaggggtaagtctttgtggccttggattagtttcttagatataacaccaaagcctaagcagcaaaagaaaaactagataaattagacatcatcaaaatttaaaactttcatgtttcaaatgacactatcaagaaaatgaaagacagcccacagaatgggggaaaatatttgcaaatcatgtatctgatagaaacttacttctagaatatattaaaactcataataataaaaaggcaaaaatactcaacttaaaaatgggaaaagggtctgaatagacatttctccaaagaagatgtatgaatgacccataaataagcacatgaaaagattcatttttttttttttttgaaacagagtctcacaccattgcctgggctggagtgcagtggcgcgatctcggttcactgcagcctccacctcccaggttcaagcgattctcctgcctcagcctcctgagtagctgggattacaggcacccgccaccgtgtccggctaattttttgtatttttagtagagatggggtttcactgtgttggccaggctggtctcaaactcctgacctggtgatctgcccgcctcagcctcccgaagtgctgggattataggcatgagccaccgtgcctggcctaagatttgtaacattaatagttatccaggaaaatgcaaacaacagtaagataccactttatatccactagcatggctagagtcaaaagacagacattaacaagcatttgccaggatgtggagaaaccctcatcaccctactggtgggatcaaatgataaagccacgttgaaaaacagtctagtatttccccagatggttaaacttagcattacttcatgatccagcaatgccagccctacatataaacccaaaagaagtgaaaacatgtccacactaaaatttatacacacacgtttatagcaatattattcataatagccaagaaatagaaacaacctaaatgactcccaactgacaaatggataaacattctaatgtatatccatacaatagaatgttatttggccattaaaaaaatgaaatactgatacatgttacaacatagatgaatcttgaaaatattatgcaaagtgagagaagttagtcataaaagaccatgtattatattgtttcatatgtgttaaatgtctggaataggcaaatctttatagacagaaagtagaatagtgattgtcaagactgcagggaatagggggctggagaacaataggtaaatggtacatggtttcttttggaggtgataaaatattctaaatttgactgtggtgatggttgcatgtactatgaatatactgtaagccactgaatttcagacttgaaatgagtgaattgtgtggttctaaaaaaaaaaaaaaaaaagaaaagaaaaaaaaagttgtgtgccaaaaggtctttgtcacctgagctatatgtcaataaagttttaccaaaaaaagaaattatgaaaagaataagcagatttttgcaagagtatttaccaattggagtgcctctaagccaaaaattccaattgtcttatataaagacgtatatgataccccaaaccattgtattgtatactttaaaatggtgcagatagtaaattttatgtaatgttttacctcaatttttataaaaatctatttgcttaaaaacgttaatataaaaaaaattaattcagcaaagaaagcccagtgatacaagtcagaacataaattgtttttgatatcaactccccaagcagagaattcggagggaaatcaaaattatgtacctgttgggcacagcagttcacacctgtaatcccaacacttttgcaggccaagataggaggattgcttgagctcaggagttcaagagcagcctgggcaaaagagcaaccactctggctctaaaaaaaaaaaaaaaaaaaattatgtaccaaaggtatttgtcactggagtgcagtggctatctattcacaggcatgatcatagctcactgcagcctcaaactcctggactcaagtgagcctgcctcctcagtctcctgagtagcttggactccaggtacaagccactgcaccagctccaacttgtttgtccaagagtcccacagaaagccaccaagtgagagtggaactttacttaggttaagtaagtggaaccttacttaacctaaaattagcttagtggaaccttaaatgttaaggaagagatcaccacttgcatatgtgaaacaatgaagctgaatgcattacttgctaagcaaaagaggctgaatgttttacttgctaagcaaaagagaatgacacaaaacacattgactctgaacaaagcaagagttgatatatagggttttgagaagcttgaatgtcagggattggcagattttcaaaactaggaatgtttaaggggttggctcactttcagccttggtttttagagtttggaggactagtagaagcagaagctgtcacagattagctgactttcagaggcatggctgttggagcaaagcagcagttactttctgatcgggaggggtttaaaactagttctgtggttacttgtttatggtttatggaacaagggctaaagaataagcagttattccctttcttgaatttggagaataggaactttttattctcaatctctgctatttctgccagccacatcataaatgtagtttaaaagcaaagacattactgttagtcaacaaacaagttagtcaataaaggcagccaagtcaaagggggaattcttttttttttttttttttttttgagacggagtctcgcactgtcacccaggctgtagtgcagtggcgcaatctcggctcactgaaagctccgcctcctgggttcacgccattctcctgcctcagcctcccgagtagctgggactacaggcacccgccaccacgcccagctaattttttgtatttttagtagagacagggtttcactgtgttaaccaggatggtatcgatctcctgacctcgtgatctgcccccctcggcttcccaaagtgctgggattacaggcgtgagccaccgcacctggcccaaagggggaattctttaagcttgtgctgaagaatgttagaattgttagagagaagttcttttatattaaaaattattattattaaagagacacagtagtttataactcaatatcattgaatggcagtctttcaagattggtagagccaatcttgaaagaattggtagagcctattcagtcttttcttggaaaagtagaagcacagttatataggatatttattcaaaaaaggttactgaacacataacaggagaataacgctgaatgtcaatgctcgagtcttaaaggagcccccaattatatcaaacaggcatacttagttaaatagctaagtataatttcgtgcctatcacattgtaattagatctatatagagtgctttaggagcagagaaaaaggaattattaactgcctaaggaaggttgagaaatacttagaaaaatctttgtggaaagggtaatatttgaacggaccgtcaaaagataagcactcaccaggcatcaaaaagcaatgagaaggcctttacagagggactggcacgcacacaggcacgcaagcacatgatggatcagaggaacagcaagtgggacagtggggtgggagcataggggggtgtggaaagaaacagtagaaggaaataactcagccaaactgtgaaagatattttttattcctagttaagaattagttaattctttactcagtagacagtcaggagttatgaaagtttttaaactggggagcaacatgatgaggtcattcacagactgtaaaagatggattacagaggagaaaaagtccaggaaatgggttagaaggctactgaaaatgctggatttcagggtgttctgaggcatagcattatgaacaggaaaaggaaacagactttatcactcttgatctcttcctcttcacaagttatatttgatctatcatcaataccatgcccttgtcaaaatgcaagtatgtgctcacttcagcatcacatatactaaaattgaaatgatgcagagaagattagcatggcccctatgcaaggatgacacacaaattcgtgaagcattccatacttttattaaaaaaaaaaaaaagcaagtattccattgttaggagaccctgattcctttcttttgttcatgttctctgtctctctgcctctgtctctctctctctcttcttccctccccccaaccctctctttcccttcttcactatctcccctccctttccccttctcttgccctgcttcaagtgaaaaattagcatctgtgccagggaagaattgctagtgaatatcaagattgttgtaattaatcgattaggaagaacttaattaatttgagggaaaaaagccttgatttcctttttttgatagggatataaacaagaagtttataataaatggtaacttggctgggtgaggtggctcatgcctgtaatcccagcactttgggaggctgaagcaggtggatcacctgaggtcaggagttcgacaccagcctggccaacttggcaaaaccccgcctctactaaaaatacaaaaattagccgggtgtggtggtacacacctgtaatcccagctacttgggaggctgaggcaggagaattgcttgaacccaggaggtgaaggttgcagtgagccaagatcataccactgcactccagcctgggtgacagagtgagactccatctcaaaaaaataaaaaatttaaaaaaaaaaggtaacttaaaaagtaaaagctaagctgcattgccaccaagaatacagttgtgcaaaaatatgtctgcatgtggacaaagccttgagaatatttgccatgtaagactgataggatcatgtatgattttttttccttttaagtaatttcctttcatgacggttatatagtttcttggtttgtttgtttgtttgtttgtttgtttgtttttaacagagtcttgctctgtcacccaggcgggagtgtagtggtgcgatctcccctcactgcaacttccccttcctgggttcaagtgatcctcccaccttaggctcccaagtagctgggactacaggcccatgataccatgcctagctaatttttttttcaacttttaagttcccggatacgtgtgcaggatgtgcgggtttgttattagggtggtgcaaaagtaatcctggtatgtgtgccatggtggtttgctgcacagatcaacccatcacctagctattaagcccagctccattagctattctttttaatgctctccttccccacccatcgccctctgacaggccccagtgtgtgttgttctcccccactcatgtgtccgtatgttctcattgttcagctcccacttacaagtgagaacatggagtgtttggttttctgttcctgccttagtttgctgaggataatggcttgcagctgcattcatgtccctgcaaaggatatgatctctgtcctttttatggctgcatagtattccatggtgtatatgtaccacattttctttatccagtcgatcattgatgggcatttgggttgattccttatctttgctattgtgaataataaaagccttgatttccgaccattttcttggttctctagataattaaattgaaagctgaagcccggttggacctgctaaagcagattggtgtttctgtggacacatggctaaagagtgccatgaaccaagtaatggaagaactggaaaatgagcgatgggcccgccctcctgcagtgaccagtaatggcactttacactcggtacgatttcttttcttggatatgacaagttgattttcactgaagcatgctttgactctgtagtcaaacttaataatagccaaaattttttaaaaagataatagtttgctagtgatttaggttttattcttcagcctatcactaattgatttaaaattattgcgggaagtgaaagagaggaaaaaatgagtgttttttttaatgtatgatgaagaatatgttatcactatttgggttatcgatgcctatctaccaaactcatcccattcatagagtaaatatgcttcgtgtctggaagtaatagaatagaaaacaatctagtgtctctgaagttctcagaggtcttctttagtgaaaatgaaaataaacatccagagatttgcacaaaatcttaagtgaaaggaatgttcttcttagtacgtgggcttagtctgaaggtgacttcaattcttgacagctttcatattctcctcacatagagagagtgtaggtgagttttacagacaaggccaggacacagcttaagtctccttacttcaagtccagggctttttctactctgatgtcatctggttcaaccttagtttttcatgttggagatctaagtaccagaaaaattcggttgatttgcctgatattacatagctggatatgtgatgccttgctagtcagactaatgtaattcctactgtcacctccccacccattactctctgtcatcctgtttatttcctcaatggtatttattacagtttgaacttgccttctttatttgttttcttttgtttattgttgtcttcctctctagaatgtaattgccatatcttcctggttctctgctctgcacagcaaagtgcctgacacatagttggtacttaaatatttttgaaggaaggagtgaatggttggatgggtgagtggctagttggaatagtggcaaactaaaagctaaaactctaacctcccaacttcccactgtcttcatagtgcctctttaaatgcttgtgctcttcagatatcaggcaggcttgctagcgaaactgacgaaaatttttcaacattcttggaagttttgtcaattttttcacatagcattctaattttctaatgagaatacacttgcacatttaaaaagggttgtgtgtgggtctacattttaaggaaaaacaatctattgaagctttattttcatttaactattaatgttaatccagctagagggaaaaagaaacatcacccacttgactttggggttgtaagcacttccccagttgttattagaacagagttgctctggccgtgcatggtgattcacacctgtaatcccagcactttgggaggccaaggcagatggatcacctgaggtcaggagttcgagaccagcctggccaacatggtgaaacgctgtctctactaaaaatacaaaaattagccaggcatggtggcagacgcccataatcccagctactcaggagactgagacagaagaatcgcttgaacccgggaggcagaggttgcagggagccaaaatcatgccattgcactccagcctgggtgacaagagtgaaactctgtctcaaaaaacaaaaaaaacaaaacaaaacaaaaaacagaacagagttgctccatctcatggaatatctcctactattgcactttctaaaagtcataatgctcatctacttcagactgttgtagagtttttgatgacagcaaattccaggcccacttgatttgggcttctacagcaggactgtttccaaccaatcaaacccatgattttccttcagctagcaccttttctaaccaaatcaattgaggggccatataccatctgactttgaactgagcaggcacataccatctaactttgtacttacttcctgggcaaactgaagatgaacaaaacttggtctccctcctcatagaatttacaagctaggagaccagacagatcttcatagatcttaatgatacatggcagtgtatgactggactactgtgtagcacacttgagattgcttacttctaactcatctgcacaccttggaaaaagtcacttctcttgggtttctgaaagaaagattaaaagactctgagattcccactccccacccccaccaactccagaatctcatgattctttgaaatactatcagaaaagctcaatatcagctagaagaatagggaagaaagtgtgccccatggaggatatgtcatttgagatagtctttgaagaattttaacaggagataaagaagaagggctgttctcgttgtgaaggaagggaatgaaggagctgtgcctagtacagtagtagtaagcattgaataaatgagtatttttgagacctgtccagagaaatcactcctctagagacatacatatcctctgtgaagggagcattttgcaattccatccgacgtttttcttccccctcatcactcttatggagcctgcatctttcaactgagagattacattttgtggaagatctaataatataaataaaggagagacataggcacaaaatagcttaatgaggacctatatttatttaatctgcttttaagtaacagcactgaaattatttagagggggttgtatctcttcatactgacagctagctggctgaggaacatgaagcagaaatgcacattctagaggctaaattatttcttccattacagctgccaacaaaagcattcgtcatctggaaaacatgattaatactactgttagacattaatagtgcaactgaaaagtgccttgtggaagataaatgttttaaaaagacacagactactcccttatagaataaggaaggaactatacttacttgggtattaactctgccttctgtatcatgctatagtacagaatgtaagattggaaaaaaggaatcccagagtatagcaacgttgtttttaaaggagaacagtccactgacacagttactcagttgcaggtgtctggagcctgcatgcagcttcccctgttagattgctgccagcaaccccatcagcctgtgtcactcagcctcccttctcttatcatcctgcttctcttattcaaaagccataccaagatgacaacctgacttttgatattatattaattctgcaatagaagaagttatataagcagattaccaaaaaattggaaaatacaatacagaagaaaatgattaatagctccatccttataatagcacagctagcaatttggtgtatttccttactcttatttatttattttttaattgacaaacaattgtatatatttatggtgtacaacataatgtgtatttttgtttgtttggagatggtctccctctatcgcccaggctggagtgcagtggtgctgttgatggctcactgcagtctcaacctttggggctcaatggatcctcctgcctcagcctcctgagtagctgggactacaggctcatgcccccatgcccagctaatttttgtatttttcaccatgttgcccaggctagtctcaaactcctaggatcaagcagtccgcccacgttggcctcccaaagtgctgggattacaggcatgagccaccacacccagtccatatttttattttttctaatcttttatttatgagccactatgcccaccctgttcttttattgcttacattttcaaactatagcccacaatgttaacatcacttccccgttttcagccactttccccaactaatgtgcaagggcaaactgccagtctactctgttgtacagcctcacttagagtatgaacatctgcagagttgcatataaataaattctgactttggttgttgtgagaaccatgcttaataatgatgttggagataagggtaagataaggagtttctaaaactgctaagatcatatgctttggctgggtcatataataggtatatatttaacattttaagaaactgacaaactgttttccaaagtggttataccattttacaattacatcaacggggtactagtgtttcagttgttccacaaccttatcagtacttactatagtcagtctttttaactttagacattctaataggtgtgatgttgtaaatcattgtcattttaatttccatttctctgataatgttgatcatcttttcatatgtttatttgcatctgtatattttctttggtgaagtgtctgttcaaatctttgtttaatttttattgggtttgttttatttttattgcattttaagagtttatactctgaatacaaatcctttatcagatatttgatttatgcaattttcttctagtctgtggcttatttttttatttccttaatacctttcaaagagcacaaatttttaattttaatgaagtccaacctaccaatttttcttttatggatcatatttttggtgtggtagctaagaaatctttgcctaaaaccaaggtcataaagattttctcctaggttttcttctggaagttttatagttttaggttttacatttaaatctgtaattcagcatgagcttatcttttattatggtaaacagaataagtcagagttctttgtcccttttttgaacttttttttttaactgtcctttcgccactgaattgcctttgcatcattgtcaaaaatcagttattcaggcctgccacagtggcttatgcctgtaatcccaacacattgggctgagtgggaggatcacttctggccaggagtttgagaccagcctgagcaacatagtagaccctgtctctaaaaaaagaaaaaaaaaaatttcaactagccaggcattgtggtacattcctgcggtcctagctactcaggaggctaaagcaagaaggtatcttgaacccagaagttcaaggttacagcgaactatgattgtgctactgcactccaacctgggaaacagagcaagtctctttaaaaaaaaaattaatcatatatgtatgggtctgtttcttgacattttgttctgttctattgatctgtttgtccagcttgatgccggtattgcactgacttaattactgtaattttataataagtcatgacttcaggtagtgtaagtcctccaactttcttctttatcaaagttgttttgggtattctaggtcctttgcatgtccatatgaatttaaaattggttttctaccccaaaaagcctatcaggatttttattaggattatgatgactgcatagatcaactggaagataacattgccatgttaacaatattcagttttccaatccatgaacataatatacttctccatttatttaggactttaatttctctcagcaatgttttgtagttttcagtagatagatcttgcatatcctttgtcagacttacccctatttcataattttggtgctattgtaaatgattttttaaatttcagtttccaattgttcattgctgatccataaaaatacagttgattgttgtatattgatcttatatcctgcaatcttgctaaactcacttattagttctagtagcttttttgtaaatccataggattttctatataaccgtgtcacctgcaaataaagacagttttacttattcctttcctatttggattcctttttccttcttactataaaattgctgaatagaagtggtgagagtcaacagaaatccttgccttgttcttgaacttttagcaagaatgcattcagtctttcaccattaagtatgaagttagcagtagggtttttgtagatgccctttatcatgttaaagaagtttcttctgtttctattttgtttgctaatagaaatggatgttggatcttgtcaaatggttcttttttagtctgctaatatggtgtaattgcattgatgattattcagatattaaaccagcttcacattcctggtaaaccccacttgggtaatgatatattatcttttttttttttttttttgagacggcgtttcgcttttgttgcccaggctggagtgcaatggcatgatctcagctcaccgcaacctccacctcccaggttcaagcgattcttctgcttcagcctcccaagtagctgggattataggcatatgccaccatgcctggctaattttatatttttttagtagagatagggtttctctatgtcggtcaggttggtcttgaactcccgacctcagttgctccacccgcctcagcctcccagagtgctgggattacaggcatgagccagcgcgcccggcctatcctttctatatattgattggaactggtttgctaggactctgataagcatgcttccatctccattcatttccttgtagtattcttgtctggttttgttacaatgcttgtctccaaatgatttgaaaagtatcctctcctcttcaagtttctggaagccttgtgtagaattgtatggaatttcgtcttcctgaaatgtttagtggaatttaccagggctgttatctggtcctggagtttttttttttttttggaagtttttaaataatagactccatttctttagtagatacagggttattaaggttattcttctgagtgaactttggtaagttgtctcttttaaggaatttgtccattccatctaagttgtcagatttattggcacaaagttgtttataatattcctttatcctttgattatctggaaaattagtagagatatcacctcattcctgatattggtcatgtctcctctcttctgatcattctgctagaggtttattaattatatggatctctatgaagaatcagcttttgattttattgatttttccctcgtttttctcttttctattttcttgatttctactcaggattttattatttcttttcttctgttcaatttggatttaattttctcctttctaatttgtaagatagaaactgaggtcattgatttgagagttttcttctttttgaatattggcattaagtgctaaacatttccctgtaagtattgctttaggtccattgcacaaattctggtatgttgtgtcatcatttttatccagttcaaaatattttctaatttacatttttttttttttcaaacagagtcttgctctgtcactcaggctggagtgcagtgatgcaatctcagctgacggcaacctcctcctcccaggtgattcttatgcctcagcctcccagcaccaccacgcccagctaaattttgtatatttagtagagatggggtctcactatgttgcccacgctggtctagaactcctgagctctagcgattcacccacctcagcctcccaaagtggtaggattataggagtgagccactgcacctggcctctaatttatgttttaatttcttcttttgactgatgggtaattaaaagtgtgttactgaatttccaaatatttggagatttttccagatagctttttgttttttatttctagtttatttccattgtagtcaaataacatacttgaacccttttaaactttttgagctttgttttgtaacccagtataaacgtatatcttggtaactgttacatgtgttcttaaaaaaaagaatgtatattttgctattgttaggggttatgttctataaatgtcaattaagtcaggttggttatagtattgttctagtcttctagactggaacgaaccttttaccggtccatggcctgttaggaactgagccacacagcaggaggtgagtggccagagagggagcattactgcttgagctctgcgtcctgtcagaccagcaggcagcattagattctcagagaagcataaaccctattgtgaacttcacatgtaagggatctaggttggaccctccttatgagaatctaatacctgatgatctgagatggaacagtttcatcctgaaaccttccctcatggtaccccaagggtccagtccatggaaaaattgtcttccatgaaactggttcctggtgcctaaaagattggggacagctgttctgtatccttactaatgttaatactctactgggtgccctgtgccttatgaagtttttactcttttaggagggagcaggagttattctcagacctgtgtgagttctgaggattatttttcctaatcctttttagtgcttctagccctagctttgggtaatttcttcacatatatgtactgaccaatactcagccaaagtcttgaggaggaccctctgcagatttcctaagttctgcgcatctctctcttcttcattacagtccccccttatctgtgggggatatatttcaagacctccagtgcatgcctgaagtcacagatagtaccgaaccttatgtatactgtgtttttccctatacatacatatctatcataaagctaatttatatatgaggcacagtaagagattaacaacactaactagtaataaaatagaatactataacaataggccagcagcactactgtagtgctttggggccagtattaagtaaaataagggctacttgaacacaagcaccgtgatatggtgacagtcaattgggataaccgagatggccactaaatgactaatggacaagtagcttacatagcttgcatatactcgacaaaggggtgattcacatctggggagacagactgaaacactaaaatgtcatcaggctactcagaatggcacacaatttaaaacttatgaattgtttatttctggaactttccacttaatattttcagatcatggttgactgggtaactggcaccatggaaagccaaaccacacataaggggagactgctatactccgcatcctgagctctctccactttggctttactaaattcccagtttcatctcctctgttcagggaggtcaccatcatgtgcctgggtttcttctccctatgtcataacctaaaaactttcttcatacagtatgttgtaggagtttgtttgtttcccatcccccagggatcactgtccttcatgagtgatgcccagtgtcttgaaaactgttctttcatatattttgaacagtttttcagttgtttctgacaggaggttaaatctgatccctgatactccatcttgcctggaagcacaaatccattttcctgatatttttagcatcatctttttcttaacttttattttaagttcagggatataattgcaggtttgttacataggtaaacttgtgtcatgggggggttgtacagattatttcatcacccaggtgttaagcctcatacccattagttatttttcctgatcctctccctccttccaccctctaccctccgaaaggccccagtgtctgttgatcccctctatgtgtccatgttctaatcatttagcttccacttacaaatgagaatttgcggtatttggtcttctgttcctgtgttagtttgctaaggataatggcctccagctctatccatgtccctccaaaggacatgatctcattcttctttatggctgcatagtattccatggtgtatatgtaccacattttctttatccagtctaccattgatgggcatttaggtttatttcatttctttgctattgtgaatagtgctgcaatgaacatgcatgtgcatgtgtctttataatagaatgatttatattcctttggttaacatcatctttgataacttactcatgttgtatttggagtgatgtccactgtgattacttctctgtccagtggagttgagagattctattagtaaatattgaggagctgtcttcctctgtattaggtattaccagattctttatctggattctcccttcctcgtaaaaacaaaagctaatgctttattaagtacctcctatgcaccaaacatgtgttaggggttttaaatattttacttcatttaatctttatgctaaccctgtgaagaagtaactgtcttcattagagagacgaggtcattgaaattgaggagttaatttgcccaaggtcacacaacaagtaagtgacatagtcaacattcaaacccaagttggccagaccccaagaccctgctttctacctcatgattgtgccatgaagctgagcccctcagaggtgtttttaatgagtacaagaagatggctcccaaaaccaactcaaaaagatcatctttcctgcctctgcaataagagtaagcattttggccgggcgcggtggctcatgcctgtaatccaagcactttggaaggccgaggcaggtggatcatctgaggtcacgagttcaagaccagcctggccaacatagtgaaacccccgtctctactaaaaaaaaaaaaaaatacaaaaattagctgggcatggtggcacacacctgtagtcccagctactccggaggctgaggcaggagaatcgcttgaacccaagaggcagaggttgcaatgagccgagatcacaccattgcactccagcctgggcgacaagagtgaaactccatctcaaaaaaaaaaaaaaaaaaaaggagtaagcattttacaacatctaagaaagggtaaacgttagtatggctagaaagaatagttttgattgaagttctgtcaagtgacaagaagaaaaggagagagcagtccttaagagacagaggaagcatgtgattttagaaatgctgggtcaagaaaacagtgtaacagttcagttaagagagtggaagaggaaaaaggaagaaattattctgagatgacatgctttggaaagcagctagagcaatgcagaagcatatgacagtgaccgctattgctggcactgcagccttcttactgccttccatgggaatccaaaaatcaactccaaataaaggaggaaaaaaggaatgtttagtatcaaccgggttgccaagataaaatgttttggattgattcccagtgtcaaagcacagtacatgtatatttttggaaacttgttctacccacatttttataaatgtatgggtgttgtgttttgttttgatttttgtaatacccactgtttttttaaatgcctgtaaactttcctagaatatgaaggcaatgtcttctaagtatatataatacatttcaagttaattttatggcaatttctagcatgattcttttatgtggcacaatgccctgttggaaaacaatagaatcataagtctgtgattctgaatattatgctcctaactagtgagtggcaaaagactcagtatcatgtgagactgttttgccaccgaactgactgatgatagatgaataatttgtaagagatagcacaggatttcctcactcagctgtggagaattttcagtaaagttatcaatgagaatatttcagcagctttgaaatggtggcaataaatatgtcaggaaaaatatataatttattattctggaactctccacaattctgtgtaatcttttcccttttatttttatttgacacataatatttatacatatttatgggatacagaaggacattttgatacatgtatacagtgctatagaattgtattaggcaaacagtggttaagaggagagtcagttttaaaacttcagtgataattactcaagagaaagccatttaattcatgaaaaagtagaacttgacagctaggcagcctgtacttttggactcatcatatcctgacttctctccagtggcctcttccgcattcccagggccatgcacttggcctctccttttagtatccttcactctagattgtgaaccactggaaggagacactgtgtccttcgttttctatccatcaaagaggctagcgtagttttctacatacagtagatatttgatactttaattaattaatgtaatggctctcctatgaaggccaatcctgcctgtccattctttgtaaccttaaatgtgtaaacattggtgcttttgtatgtttgaatatgggaaaaagcagccaaataagtgcttgggtgtagcgggcaagaaacaaatatttgaggctgtttgtctcttctttattaggtttttaatttaaaaagtaaaacgtgcatattctaatagttcaaagagtatagatgtatataaaaagcaagtcagtcatttcctctattctccagtctttattcttctcattctgccttcccctgtcagatacgtatgctcatataaatattatttatattcactatatcacggacagtgctctaggtaagtgcctgtggatctaactcattttttacactcaatgccatttcaattaataaatgccttttagctatgatgggtaatataccttgaaactgggttaaaaaattattctccttgtgttacatttcagaagagagtgtgcttttcacgtttgttcgtgtgtatggtaaaatatacaaatttaccactttaagtgtaagtttagtggcattaagtacattcacatcattgtggaaccatccccaccatccatccatctccagaactcttttttttttgagatggagtctcactctgtcacccaggctggagtacagtggcatgatcttggctcactgcaacctccgcctcccgggttcaagtgattctcctgcctcagcctcctgagcagctgggattacaggcacctgccaccacacccagcaactttttggtcttttttgtttgtttgtttgtttgtttgtttgtttgtttttgagacggagttttgctcttgttgcccaggcaagctggagtacaatggcacgatctcagctcacagcaacctccgcctcccaggttcaagcgattctcctgactcagcctcctgagtagctggggttataggcatgcgccaccacacccggctaattttgtatttttagtagagacagggtttctccatgttggtcagactggtttcgaactcccgacctcaggtgaactgcctgcctcggcctcccaaagtgcagggattacaggtgtgagccaccgtgcctggcctaatttttgtatttttagtagagatagggtttcaccatgttggccaggctggtctcgaactcctgaccttacgtgatctgcctgcctcggcctcccaaagtgctgggattacaggcatgagccaccgtgcctggcccatttctagtattcttttcatctagcaaaagtaaaactttctggccattaagcaataactccccatcatgcagcctctgacaatcaccattctgctttctgtctctatgaatttgactactctgcatacctcaaataagtagaatcagagtattttatctttttgtgactgggttattccacttagcataatggcctcaaagatcacccatgtcatatgtagcatgtgtcaaaatttccctcctttttaagactgaataaactgggcatggtggcatgttcctgtagtcccggctactcggggggctgaagtaggaggatcccttgcatccaggagttcaaagctgcaatgagctatgatcgcaccattgcactccagcttgggcagcagagcgagaccctgtctctaaccagatagacagataggtagacagacagagaataatattccatcgtatgtatgtataccacatttttatttggtttgtggtatatacatacattttacttatccattcatctctcaatggacatttgagttgcttctaccttttgtgaataatgtggctgtgaacatttgtttacaaatatctgttcaagtctgtgctttcagttcttttgggtatatacccaaaatggcattgctgaattatgtggtaattctgtgtttaatttattgaagaaacatgttactgtttttccatagcagctgtaccattttacattcctaccagcagtgtataaaagttccaatttttccacatccttgtcaacacttgttattttctgggtttttaaaaatatatataacagcatcctaatgggtgtgaaatggtatctcattgtggttttgatttgcatttccctaatcattagtgatgttgagcatattttcatgtggttattggctatttacataaattatttggaaagatatctcttcaaatcttttgcccatttttaattggattatttgttgttgatggtcagttttagggattctttatatattctggatattagtcccttttaagatacataacttgcaaataccttatcccattctgtgggttgtcttttcactctattgttctttgatgcatacatattttttattttgataaggttcaatttatctgtttttttcttttgttgcctatgctcttggtatcatatttaaaaaactcattgaggtggggggattgcctgagctcaggagttcgagaccagcctgggcaacacggtaaaaccccatctctactaaaatacaaaagattagccgggtgtggtggcatgcacctgtagtcccagctacttgggaggctgaggcaggagaattgcttgaacctggcaggcggaggttgcagtgagtcaagattgcgccactacactccagcctgggcaacagagcgagactctgtctccaaaaaaatcattgccaaatccagtgtcataaagtgtttcccctgtgttttcttttaaagtttcataggcttaggtatttgatccatttaattttttctgtgtatcgtataaggtgagatttcaatgtcattcttttgcatatgggtatccaatttttccagcaacatttgttgaaaaactgtcctttcctccactgagtggtcttggcatccttgttgaaaatcatttaatcatgtatgtgaaggtttatttctgggctttctagtctcgaactcaatttttaaaaaaacttttaagtgcaagagtacatgtgcaggtttgttatataggtaaactcgtgtcatgggggtttgttttacaaattgtttcactacccaggtactaagcctagtacccaatagttattttttctaatcctctccctcctcccaccttctgccttcaagtaggccccagtgtctgttgttcccctctttgtgtccatgagtgctcatcatttagctcccacttattagtgagaacatgcagtatttggttttctcttcctgtattagtttgttaaggataatgggctccagttccatccatgttcctacagaagacatcattcttttttgtggctgcctagtatttcatggtatatatgtaccacattttctttattcaacttgtcattgattagtatttaggttgatttcatgtcttcgctagtataaatagtgctgcaatgaatatacacgtgcatgtgtgcatgtgtcttttttttttttaagacaatcttgctctgttgcccaggctgcaatgcactggcacaatcttgactcactgcaaccttcacctcccaggttcaagcaattctcgtgcctcagcctcctgaatagctgggattataggcataccaccacgcctggctaatttttgtatttttagtagagacaaggtttcgccattttggcaccacccactttagccttccaaagtgctgggattacaggcatgagccaccactcctgcccatgtgtctttatagtagaatgatttatgtacctttgggtatgtgtccagtaatgggattgctgggttgaatggtagtcctgtttttagctctttgaggaattgccacactgctttccacagtggctgaactaatttatactcccaccagcagtgtataagcgtcccttttttccataacgtcaccagcatctgttattttttgactttttaaataatagccattctcagccaggcatgatggctcactcctataatcttagcaatttgggaggccaaggcgggaggatcacttgaacccaggagttcaagaccagcctaagcaacgtggtgaaaccccttatctaccaaaaaaaaaacaccaaaaacaaaaattagccaggtgtggtggtgcacacctatagtcccatctatttgggaggctgaggcaggaagattgcttgagcccaggaggttgacactgcaatgaaccgtgattgtgtcactgcattccagcctggataacagagcaagaccctatctcaaaaaaaaaaaaaaaaagccactctgactgatgtgagatggtatctcattgtggttttgatttgcatttctttagtgatattgagtgttttttcacatacttcacgaactttattttttttcttgttttgttttctattttttgttttgttttgagacagagtctcgctctgtcaccaggccggagtgcagtggcacaatctcggctcactgcaacctctgcctcccaggttcaagcaattctcctgcctcagcctcccaagtagctgggactacaggcgcatgccaccatgcccggctaattttttgtttttttgttaatagagatggggtttcaccgtgttagccaggatgatctcgatctcctgtccttgtgatccgcccacctcggcctcccaaagtgctgggattacaggaatgagccacctcacccggccggcaacctttatttttaatgagtgttattaatctataatatggatacatcagagtgcattcaaacattcccctgttgatggacatatagattgtgtcgaggcgtttgtcactacaggcagtgttgcagtaaacatcttaaaatacatagtcttacaccttggtgcttttatttccccatgatgtattcataaaagcggaattgctagatcaatggtatgtttagtttttaatttcagtgaacaggttgttttttcaaaaggatgtatgaattcacatttctaccagccatagatgaaatcctgttctccacatccttggtagcacttagcaacctttttttttttttttttttttttgagacagagtcacgctgtgtcgccccagctgtagtgcagtggtgcaatctttcttggctcacttagtctccacctcctgggttcaagaaattctcttgcctcagccttcgcagtagctgggacttcaggcatgcaccaccatgcctggctatattttttttctatttttaatagagatggggttaggtttcaccatgttggccaggctggtctcaaactcctgacctcaagtgatccacctaccttggcctcccaaagtgcttggattacaggcgtgagccaccacacacctggcctgaaacctttttaatgttcactaacaggatcagttaaaatttagaggcccttgtcagtcagtacttaacagtgaaaagtgaaaggatactgataaatatttcttacatatttgacagaaacttccttcttgatttaaaaaaaatctctgtcctggccaggcacggtggctcacacctgtaatcccagcactttgggaggctgaggtgggtggatcacaaggtcaggagatcgagaccatcgtggctaacacagtgaaaccccatctctactaaaaatacaaaaaattagccgggcgtggtggtgggcacctgtagtcccagctactcgggaggctgaggaggcagagcttgcagtgagccgagatcacgccactacactcaagcctggcaacagagcgagactccgtctcaaaaataaaataaaaaaaaatctctgtcctaggcctggtgcagtggctcacacctgtaataccagcactttgggaagccgaagtgagtggatcacttgaggccaggagttcaagaccagcctggccaacatggtgaaaccccatctctactaaaaatacaaaacaattagccaggtgtggtggtgggtgcctgtaatcccagctattcgggagactgaggcacgagaattcttgaacctgggaggccgaggttgcagtgagccaagatcacgccattgcagtccagccggggtgacaagagcgaaattccatctcaaaaaaaaaaaaaaaaaaaaaaactctattctttcataacatgaaaaatgtaagtgcgaaagatagtcatttctatgcagagttaaaaggcaaattaacattttgaaacaatcaggttttaagtgtttttccggctttcaaccattttcttgaagtaaggaaactagccaatggtttctaatttttcttagcttaatgcagataccgaaagagaagaaggcgaagagtttgaagataacatggatgttttcgatgacagcagttccagcccttctggcaccttaagaaattatccactcacctgcaaagttgtttattcctacaaggtttgtatttctccaacataatgttattaaattctgattaactctgaagatacacatgactgtatccatccagtctctcaagctgtacttagcataaaattgttattaggttaatattggggcaacataacagaatggtgatgagtttaggctctgacttgacgtctttcacttgctactccgtctgcctagaactctttttttccccaaatctcagttggttgtcccctgctcctcattgaagctcagctcaaatagttccttcttaaggtcacccataaccacctaaataaataaccaactcctcagtcactacttgttatcccattgcctcttttattatatagcacttctgctcagccaaacttaatcttatttattttcatatttctttgatgctccactaaaggtccatgaaggcagaaattttgtctgtgtatgtgtaccttgtctgtgtgtcttcagccccgaggacgatgtccagccatagtgggtcatcagtagataattgtgggatgactacatgaatgttggaagggaggcgtgaatacatgaatcttctcttgcccctgttctggtggaggcatgtgtgagaaggggcaatgcggaaggctatcagaagggaaggtcctggagagagaatccacctgtcatgcaccagattcactcctccgccacatccctgtgtagccaaaaggtggcagtgtttggtaacctcaatatcagtgattcccagacttgttttgagtttaacatcctttcattttatatttaaattcataatacttcctgttcattgaaagtgttagcatttttttccaatgtaaatcgttttgataatcttttgaaaatttaaaatcatcttctcagatacttggaaaggtattacagggtattataaaactagcattggaattgtttcctgataccacctcccattatatttacttgaacgtcccagaactaaaatttaagttccttaaatagagagattcctaagtgtctgagtgattttaaacagttcacattcattcaacattccctctgttggcatatcccaggcacatccctgcgttaaatagactatgaacatctatttagtcagttaatcattgaataaacatatagagtgcccaatatgtgatacactggggggatgccagaatgaatatgacatctctcccctctaggaatggacaatctatgaagggttaaatattaaactggaaaatagaacaagtgtgaaaagatttatagtaaaggtagagccactaattctacctggatcattgggagaaattttacagatgaggtggcatttaaagtaggtcatgatttaagacctttctagatgcagtgagaaggtagggagaggaaagagccttctaagcaaagagaacagcaggtatagagacagagtgtgatgagagtgtggggtgttcaggaaatgttaaattcagtggtgtaggagtgggagaacagaggggctgtgcataaaggtgtttgttgtcagatagtaaagggccttgggtaccagacttagaggtttggtttttatcctggctaggaagatccttagatggcctgaaatcagattggacttttaagaagctaacctggtcatggtatagatattctagaggacagattaggatacagagggactgactttaagcctaatcataattcttatagtccagaccaaaaaggaggcctcgaataatctggtgagaacaaagaaactatatttaatggttagagttggccgggaatggtggctcacgcctgtaatcccaacattttgggaaaatgaggcaggtggatcactgaggttaggagttcaagactggcccaaccaacatggtgaaaccccatctctactaaaaatacaaaaattagctgggcgtggtggcgggcgcctgtaatctcagctactagggaggctgaggcaggagaatcacttgaactcaggaggaggaggttgcagtgagccaagatcgcaccattgcgctccagcctgggtgacagagcgagactctgtctcaaaaaaaaaaaaaaaaaaaaggttagagtcaaaagccttaagaatgttcataacttttgaccctattagcatccatcctaaggaagtaaatcataatatagaaaagttttggacacaaaaatgtcctttcatatagtactgctttataatgtatggcacttctgcccagccaaacttaatcttagttttcatatttctttgactccccgctaaaggtccatgaagggagaagttttgtctctgtatgtttaccttgtctgtgtgtcttcagcccctaggacaatgcccagcacgtagtaggtcattagtaaataattgtggaatgaatacttgaatgatggaaggcatgaacaaatgaatccttcccttgacctcattctgatagagacatcagtgaggataatagagctcatgactggatgcaatggctcatgcctgtaatcccaacactttgtggggccaaagcgagaagatcacttgaagccgggagtttgagaccagcctgggcaacaaagaaaaacctggtctctacagaaaaattttaaaattagctgagcatggtggcacatgcctatcgtcctagctattcaggaggctcaggcaggaggatcactggagcccaggagatcgaggctgcagtgagccatgattacaccactgcactccagcctgagtgacagagtgagaccctgcctctaaaaaataaattttaaaaaaatttaaatttggcagttcaatgagaataattaaactagacattcatatactatagccataacatataatattatgaaacttactgaaattttcatcaagagtttttctatataagaagaaacccttatgtcctaatattaaattaaaaggtaggataccaaattgtatgtaccgtaagagctcaattatgcatattttccagcttttctacgatgaacatgtatgatataatcaggaaaaacatattgttttaaaagaaatacaggaaatttggagagatactggtggaaacggagctctggttgtcactggatactaggacttaaggagacagtatgagagtatgtgtgtatttaataaccatttactgctcactgtctttagttggggtaagtgagaagaaatgtagtccctaattatttctagtaggaagctcacaaggacaaactcattagagcatcatggtagtcagtgttatggggacgctcagagagccttttaagaacaaaatgggggctgggcacggtagctcacgcctgtaatcccagcacgttgcggggccaaggcgggcgaatcgcgaggtcaggagttcgagaccagcctgaccaacatggtgaaaccccgtctctactaaaaatacaaaaaattagccaggcatggtggtgtgcacctgtaatcccagctacttgggaggctgaggcaggagaatttcttgaacctgggaggcagaggttgcagtgagccgagatggcaccactgcactccagcctgggcaacactgtgagactccgtctcaaaaaaaaaaaaaaaaagagcaaaaggaggagcagcttactcatcatgagtagtctgggaaaacatatgcgctcagtctcaagtcaaaagtaatcgtaactacttatctatctatctatctatctatctatctatctatctatctatttatttgtaatcccttcaataaccctatgaggaagatattatcaaacaccccattcattcaacaaatagtgcttgagcaccttccatgtatcagtgctgtgggcttttctaggctctgggatatagcattgatcaaaacagacaaaaatctttgccctcattgagcttatattctagtacgaaaaaagaaaactgaggttcaaaggtatcttacagtcacttgcccataaaaatatactgaagctggacttaaacccacagtaatctaagtctgctcatcagataggaaagagggaacagagcctgatggacggaagaacacctataaaagcacagaggcaaggaagaacatggtatgctcagagaatagaaatagtgtgcaggggccaaagcgtcaagaggcccacagggaccaaactctgcagggtcttgatagccatgcaaagaacttgaccttgttaggtggaagaattggtcatcactgctttaggatgggatgatcaagctagtgtctgcttacattggacaactagtgctgcagtgttgaaaaacttgcatggacctccatggtttttgtttgtttgttgttgttttttttttttttttttttttttgagacagggtcttgctctgtcacccaggctggagtgcagtggtgtgatctcggctcactgcaacctctgcctccctgcaacctctgcctccctgattcaagtgatcctcccacctcagcctcccaagtagctgggattacaggcacgtgccaccacacccaccaattttttgtatttttcatagagacagggtttcgccatgttgcccaggccggtctcaaactgctggcctcaagtgatccacccaccttggcctcccaaagtgctgggattacagacgtgagccacctcactcagcctctccatagctttttataagggcagcagtttatttaaaagtgtactacctccctggtttgctgtcacatacattaacgtctggtcgtgttgatactttttaggtcttgccatgaaaaacatttttattacaaaaatgccttttgctggcatattcaaggcatagtgtggtttcagagtagtgaaggaattccattggaaaagctatcaagggtaaatgagtggggttttttcctcaatattatttttctgtctcagggagctatggcaacatccagaatctggattttgatgaaatgttttaatgttcataaaatgggaaattgatcttgaaaatgaccccttttttgccttatttttgtttgtgtaacttggagttaattttacattttgagattgtgagattttaaaaactttatggttttaggtgatggttttaacccatcttgggacttggggaaagcttttaagactgttttctagagagccagaagccagcaggcccctgtctattacacatgacaggcaagactgttaggaagcaaagccacacggactttccagcccctctgtggagcctcagagcgtttacagatttggcagtctcaagggcaacatgtgggtggctgatgctggtggattgctgctgtcagggataataaaaccattatggttagcagcttgtacggtagcacgcaaatggatcagctcagtctccacacagttaagttggagcataagaaatccaaaccatgactgatctcaatcatttcctttcctacaatttttttcttttggccactgctttacagtgattccagatcaatcctaggcactgcacccactatcatcaaattcacgtacatagttctttgcattttcactgcatgcttgtccatgggagccctctggtagcagttccaattcagtgccttctcgtttgcctttgcttcccaaatcatcacagttctgtgcttatccatcccacattgactcacatcctccagaaaatggcaggattgtcatttcaaagaaatggaggcatcaagttgaataacttgatacagaagctggagttggaacccaggtcctctacttccaggaagtgctctctttttttgtttgtttttttagagacagggtctcgctctgttgcccaggctggagtgcagtggctcactcatggctcactgcagcctcaacctcccaggctcaagcgatcctcccacctcagcctcccaagtagttgggactacaggcatgttccaccatgcctgactaattttatttatttatttacttatttatttatttattggtagagatgggggtctcgctgtgttgcccaggcttacatgttctgttcattgaacgtcattgcctcttgaggattcagtttcttgagtttttgttatggttttattctgtttagttttttaaagtaaaacttcacctcattatgaaagttttacagcatttaaatttttatgttcaacatgtttctcaaaatcatttcaatattttgatccccagtttttgtcatgatcagctcacatctgctccttatctaacctttttaattttgtccatgaccatcctacactgcaggcttctcaaccagatgagttgaccattgaggaacatgaggtgttagaagtgattgaagatggagatatggaagactgggtaaaggtatattcctttgctcatatcgccctttcttgtgacatttttaggagtttgttttggtctttgttgtgccctgtctaaattgtgtgtgtaaacttgttttgtcacatgtcttttacccaggctcgaaataaagttggccaagtgggttatgtgccagaaaagtacctacagtttcccacctcgaacagcctcctgagcatgctgcagtccctggccgctttggacagtcggtcacacacgtccagcaattccacggaagcagaactcgtttcaggcagcctcaacggagatgccagtggtaaagactgaaacaaggcactctttatttggtcacgtttgacctaaactgtattgccctggagtaagccttcagtaggataaaaagcacaactttcctcctgtcctataatatgcttttctttatatggtcacgtttgtcctgcacagtagaaccctaaagttaatcattcatcagtgagtaaaaaaattacaactttaatcctattctgtatgatgctcttttagttgtcatgtgagcataggggtggttgcaaaagcaaccggctgttaattatcttaccagatttgtttttctcttgctccctagtatgttttgtgaaagcactttatgattatgagggccagacagatgatgagttatcttttcctgagggagcaataatccgtatcttgaacaaagaaaaccaagatgatgatggcttctgggaaggggaattcaatgggcgtattggagttttcccatcggtgctagtggaagaactttcagcctcagaaaatggtgacactccatggatgagagagattcaggtacctgagaggggagacagttgaattaaaagatgtttaaagaaaattgctcccaaagggtctgtggatccacacaaaagtgggctgcagtctctgccttaccctcaccggtccttggttgccagtgtctgcacaactgcatttgggaaaccagagacttgtcagtcagtcccttgtggaatgtggccatcctcccacacctccatcttcccacattctctctcttccttgaattggttaaccaaaatgccaaattatatgtgacataccaaagatcgttttggtggagagaaagaaacaaaccgaagagggaaggcgttgctctgtggttaatttacgtagtaaaactcttagctggctctctctctccctcactgtcagagcctccttgcctagtccaggtcctgccagtctatttcagagaattaatgagcctgccagagcccctaatccccactcaagtgaccctagacttagttcatcacagggaaacagcctttaaaggaacctctaattcagtcagagtttagtttgtcccctcagggatctatcactgcaggccagacaggtagaggaagaaggaacgtgtttgccgatcttgtttgcgtggtgattgtgaccccttagcctaacatgcacaaaacctggggaagtcagaaattcagcaaagtattttatcttcaccccaaaaaatccaacttgttccttttgttgttgttgttctttgctaagtttactgaattgactaatttggtacattttcaatagaaccctagagagtagcttcacttgataactgtttaagataaactaaaatcagtaatgtgatgagatctgtaagaggaaaaagtgaagtgcaatgcaaaattggagcttgaggtggttatttaatgctcagttgcctctaatgaggttgacaagtttcaacaatcagcttagctttagagaaaaggcatgagtacagagcagtcagagaagcagccaggctctccttcctggaggggagcaccgggtaacctcgcttccctttgctgcagatctctccttcccccaagccacacgcctccctgcctccactgccgttgtacgaccagcctcccagcagcccctaccccagcccagataagaggagctccctgtactttccccggtctccttcagcaaacggtaagggttctcctgggcatgggtctaaatgcattttcacttcagaaacctacatattcgcctgaagggcaaaaaaaaactgcatttgcttttttttttttttttttttttttggagacagagtctctgtcacctgggctggacacccaggctggagttcagtggcatgatcacggctcatagcaaccaattcctgggctcaagtgatcctcctgcctcagcctccctagtagctaggaatacaggcatgcaccaccacacacagctaatttttgtattttttctggacaaagggtattattctgtcacccaggctggagtgcagtggtgggatcatagctcactgcagccttgaacttctggcctcaagtaatcctcccgcctcagtatcccaaagtgctgggattacaggctcaagccaccatgccagccttgcatcagcattattgctcaacaactcaagtaaaatgagcttctttggttttctcccttagaaaaaagccttcatgctgagtcaccaggattctcacaggcatcaaggcatactcctgagacctcatatggcaaactgcgacctgtaagtctctgatcttgcaggattatcgaatgcatagttcttccaaattgaaagtaaggaattaatgtttccccgtggcccctgtgttgttactgactatgccaaacaaggatgaactgggtttgggaaggtaaaaagagctattgaaaaggaaggccatagaaatcaactcatctcgggacatttaatctacactggaacttttttcactgagccacagtgagattgcaagatgatggctatgaaagtgatttagaatagaacaaactttatgagcattaaagcgggctaattgtgaaacacttttttcagtaagcatttaattttccaggcctctatttgcctctttgaggaataccaagatgaaataataagctaacttcatggccttaaagagcgtttattctccgggtgaatatattattgcaaagttacctctcctcacccttcactctactgccatctgcattccacccaccactgtactccaaggtcataacttgcacggtaatccagtcggatactttgcaattttattttccttgacccctattagcttttgataccattcctttaccactggcttcttttggcttcattcattcagcaaatatgtattgagtgccttcttaaggacttgagtctttatcccaaatgagacaggaagccattgtaaagtggtaagctggacagtgttgtggctggtgcatttttaaagcatcgctatggcagctaagaggcggatggatggagggtggcagaaaggatatagggagcgattaggaggctggagcagcatccaagaaagaagtggtggcaagatggactggtgggtaagagtgggaagagagagcagtgggctgatgtgcttctctacatttgcctcgtttgctttcttcctctctggtcctacctttctgtggacctttgcagccttgccgccacctgtctctgctgataattctcatggttctgtcactgggctgcttctcttgaagttgttgaacgcactcttgccgaatgacctcatctacttccacagctatgataaccatttatatgccagcaagtctcagatttataactgccaatccgatctcttctcttgagcttcagatgtgtggatatctcagtttatatatcccagatccccaaaactcagcaaaaatgagttatgttcccttccagacatgttccttctcccatattgcctatcttggtaaatggaacccccatcctactggtgttctggcatcattcttaatacctcctgcccctgcctcccacagtcattcccaaatcctgccaggtataccttgcagagagctcgcaaatctttccacttctctacttcccctactgccagtaccctcgtttgggctattgtcaactctcattcagaggattacaaaagtctcctaagttgccttcttacttggactcttgcttgcctctgatcctttctccagttgttacctgagtcatcttttcgcagatctgatattgcttaaaatccaccaaaaactcctcttttgcctacagaataaagcacagatttatttttttcttcttaaagcagatgtttaaacatggtttaacaaggcccttcacaacttaaccctagcctacctttctagccttctcttttgtaactctctacccaagacacactgaaatgtttcatttctctaagcattgctctcccttgcttccagccagacctttgctttggaggatgtgctaggatcttagtcataggacttgtgcccatgaggtttttagcctaggcaagaagctgatttgtgggcttgatatttcattgagaacaactgcttctcagtgtaggaaatagtgaagactaggttgaaagcacgtgctcacaacatttctgagacccctagggtgcccatgtccttggacagatgagtgattaggttttggggatgcttcagatactgagtcaggaactgactgacaaactacgtaattgtttcctgctcaggtccgggcagctccccctccacctacacagaatcaccgaaggccagcagagaagattgaagatgtggaaatcacactggtgtgatgatgggcttgcccatccattactgctacaatcaaggccaggcttggagtttggccagtcttgttttttaggcacctttgcatgatgatgactcttgaacagagcaaaaaacaaggaggattatgtgtgactgggtggcctggtagactcctcccacgttttgaatatttcgtgccttttttttttgttgtcattttctatgtcatttctcctaccatagcacaaatcctagcggaccctaggagcaaagaggggggcagccctcatgcctaacagtggtctgtttttatatgagactcaagaacaggcctcattccagggcacagtccctaaattactgatcatgtgcactcgtacagtatattactgtgaccacaaggatgtggcaaagattctcatctttcttcaagtggcttttgctcatctgattgagaattaatcagatcatgttggctacataaggaaacagaaggagggatttcaggagaggctggctcctccccaaggttagtccccagactgagaaagtgaaaccttattgggaaaaattggactgccctgaatttagcaccaattgcattaacgcacatctcttccacaactaacagacttaaaataacagtgtccttcgtattaatatctgtgccattcatttagaattagcagagctaatatggaggggctgaactagtagccacatcttgttcatcacatagactaatagaaaggaggctgtggctaaagcagaaatggaacttccggatctgaaattagccaatataatgttcttttgtatttgggtatttttcatcttaatttttacagcatatactcttcttaccagtatccttagaatccaaatgtctagataagttgaggacacatacctgcattgttgagcttctctactggggacgccccggcattattttattcccaagccagcagaccggcccagacagccaggctgtggctggtccagaccaactgctatggtggaaaatgcagcttccaggtcccactaccctgacatttccgtggaaggaagaacctggtggctcgtggaggaaaccagctttctatgagaaaggactgaaggattgcgcaccctgcacaagtacagattgaccaggaaaagacaagtgtcttctgtgtgtcacagggaaagccaggagtggccttctctgcaggccagcaagcctgcagcagcaggtgcccccacgtcaggtgctgactgtctgctgtccgctcctgtagaaggtagggagcacaatacctagggactaagggatgttcgccggttgtggtttgttttttttttttttccttggttaagaaatcaaatttgcagaatttaatctacaagttgtattatgctttgaaaactccatccctcctaagaatcttaaaaaacttgaaatgctcgccaaatgtccccatgggatttttgaccaaaagtaaggtgataactgaagaaatttttagttctttgatcacttcagtgacaatacccattaatgaatcttctccatgatttggggttttttttcgttgttgttttttacacttcttaacctgttgatctatttgaggtcttttgtgtttatcaaacttattcttaagtttaaaaaagaaattaaaagggtggtttttttaagattttaaagtttgctaacatattaaaaatcttcaaatgcttattaaatagagcagttcttgccacccagtcttgtattctgtctttagctagccaaattgtccttgaatttgggttttccacaacctcaaagggttatttgaaatcttttgttgtattttaaaatattttttggaagagctgctaattttattttaaaaaacaaagttgtgaaaacatgcctcctttttaaaaaataacccctccatccaggatatggaatccagcaccacagtgcacaggtcagggctcggagggagcctctgtgcagatgtgctttctttacagtggctgtaaaaagtttgtatttattatgtataaaatgttgaataataaaaaaaatggaatt

SEQ ID NO: 36443 - DNA, 25857 bp, Homo sapiens
cgcaggcgggcgtgcgtggagcgggggccgcggccgcgccgcagagatgtgactcgggccgaaggccagctggagcgtcggcgctgcggggccgcgggggtcggtaagtgcgagctgcgccgatgcagtggaggacgctgtggggaccccagaaacttttcccgccgtggatttgggagaattggggggtccgcttcttgtgtttttctaagcgcccccccaacccaagccagggagtttattgctgggggagatgtggaatctgggcgaggggaaccacggtgcgacgagagcagagccgtagaggggtgggcgggggaggggaggatctggggacctttacggggggagggagactgtgcccggaccaggtagagatccaagtctcccaggagggtgtgggggcgaccacaggtgaagggcagctgggagggtaaaggagcccagccgtgtcctagtgactcgtcatgtgtgaggagctgcgggctggtcctggggccgcgttgggggctgactgtggacagggcagacgcagccgggggcacaagggctggactttgggggtgaacagccgcacctgtcgcgggggctgggggtcaagcccgcagccggcttgagtgcgcattactcagcaaggggagggggggacacggcggtgggagatggcagagctgagacctgggctggggacgaatgacggggaggggtggggaggagggggcggctgcatacaatggcggggggggcagtggcgtttcccttccagacagggggcacttggacctctggaagaggcggctaggctggagataaggactagacctgttctcggtcccctctccttgggggacacaggcttccagccccacaaggaccccacacatcccggggtccctagcgcttaggccgaaaagggagcgcgcgggaggagcccgcacccgccttggccccgggcagccggttgaacagcctgggaaggggccaacgaccttgccccagaaatctcccccgtgcagcgggttcactcctccgtccttgctctgtcacacccaggcctagccagtcctccctttccgtcccccgttcgctaagggggcggctccttggagcgcggacaaaggcccctggagtgtggcgggcagcggcgtccccgcctggggccccagcccacgcgccacattggccgcccaactgcaccaggccggggggcacctgaacagagcccagaaagccctgggggaccccgcaaagacaagagaagtgggggagggatctggcacaaaaaccccggcacttcagccaaggaaccttcttaattcagaagtttcttcggtggggactcgggcttgcggaggatccaggctttgagttaaactgcatgcaaatgacatgtaaatagaatgcaaattggcatctgtcgtttggaagccctcccggccagtttggtatctaagactgtggagtgaacagtttgctatctgctccctgctctaagcctggaaaggggtcagctgagttgggaagggaaggagattccaggaggaaggagccgccatttgggggcacaggcagcaagacaggcagttttgttagaaagataaactcagaatctttactggattaatatgttatttcaagaaacgtgccagggacagaactgggtgccttgtataaaacggacaaaacccctgctctcccggggctggggaagtgagtggacaaacattaaacaaacccatagcaaatggctatgaaatccgattggggtgaggacggccaggaaaataagatggggtgatgtaaaagaaggtgacaggggtgtatgtacctgagatgactgttccgggagtgacatttgagtggagcccagctagaagaggggccctccgctgggaggtcttggaggaagactgaaccaggaggaaggcactgtgcctgcaaaagcttggaggtgggaatgagcttagaggaactgaacaaaggccattgtggctggagctgtaggcagatttgggggtggggataggggaatggtagggaccagccagatcatgatcttttgggtcatggaaaggagtttagggtttattctgtttggaccagtgaacccttggagggttttgagtgggaggccatgggatctgatttgtagaagctcccctgacgttgacaaggaaatggaaaatagcccccctttccattctgcccatggggatagagagacgctgggagcctccaaggggctctgtccagccttgggggaccgctttgagcctagccagccactgcaagccaactggaggagcagctcaggttttaaaatccactccctgctttcatacagtttttatccactctaacggagccccccggagcccacggccccgtaagcactttctcgcagagcttcctgggggttccgcttagtcacattttcttctcggaattacagcctgagaggaaccaaccactgtggatcgggcagccaaggatgcaatttgcatttcaatgattgcttttatttacaggactggagctgctttgcatattcatggatcacagagcttgtgttcttgcaaccctgtttactaacctatgaggattttttaatttgagagccctcaaatgggccagtggtctagtcagcattgggaaatgaagatgatgagatcctgtaactcggaaaagatatcagagggtgagaattgggggtgtgggaaagagcgggtctgaagtcaggaaaccttgtaacagtttaatcctgcagagcaggaaatggaccagaggctccagcaggagtgagttgggacagactatgatgctggggtgcatggggatctggctctgcagccccatcctgagcctctgccacacgtgagggattcagaacagggatgcagcagaaacgccttgaggtcaggagctgggagaaatgggggctagtcccaggccagcctgtaaattccagtgaacctctggccaattttcctgacgtctctgccttcattttcgcaacaggaaaatgggaatcatgattgtctttcttttttgagacagtttaactctgtcgcccaggctggagtgcagtggcgcaatctcggctcactgctaactccgcctcccggtttcaagagatcctcctgcctcagcctcccaagtatctgggattacaggtgtgcaccaccacgcccggcttatttttgtatttgtaatagagacagggtttcaccatgttggccaggctggtttcaaactcctgtcctcaagtgatctgcccaccccagcctcctaaagtgctgggattacaggcatgagccaccgcgcctggccatgattgactttttaacaagcaattcactaaaaagctgttgcttcctctgtgtcgggcaccaaacctgacttttcttttcttgttgtatttatttataatagagacagtcttgctacgttgcccaggctggtcttgaactcccttcctcaagcaatctcctgcctcccatagtgctgggattacaggcatgagccatcacgcctggcccagactatttttcacgtacttctcacaccagccttgtaaggcagcgctatcattatccccattttacagatgaagagaccgaggttcagagaggttaagtaatgcccagtgtcatatagctctgtctgactcccctcttctggcctgcctcccactgaggcctttcagcctgatgggagagtgaactgtgtacccgtattcatgtgggtactgggcactgaactattaaatatgcacagggctcggaaatccactcccaccccacctgctcattttgtctttcccttctgtgttccagtgcctaccgccatctttagagaaggtaggttaagatgccactgccctgctagacactcggaggggacatggctggggtcgaggggacatggctggggtcgaggggacacagggtggagccgtgctggtagcagctggggcaaggccagtaagaatgttctagaatggttttgtacatttcatgtctcctttcccgtgagtgaaagggaagatgaggatgctggttcccaagagaatggctggtgtctgctctctgggtgtcctgggtctgactccgcaagagagatgcctggtttcagggcaccccaaggtcctctggcctaggttctacctccacagcgaggctctcacttacagcacctgctgcaggttgcagaagagtgtgggagtccccagggccaaccaccccaagagggtctccccttcacaccacctcagggacctctttcgttgatgtttgatgggggaggctagaagccagcagtggacaaaaacctaaaccagtaatctcattacaacacattcttttcttattttattttattttattttattttattttatttataacagagacagagtcttgctatgttgcccaggctggtcttgaactcctggcctcaagcagtctcccacctcagccttccagagtgctgggattacaggcatgagcttggaaaccagcggtggacaaatacctaggcgagccacctcgttacaacaccatctccatggcaaccaccccttctagaaaaatcagtttcagaagagctcaccacctcagacaagggagcgtttgccaatcttttttattttattttattttattattatttattttattttattattattatattttgagcagggtctttatgctgtcacctaggctggagtgaagtggctcagtcacggctcactgcagctcaaactcttgggctcaagcgatcctcccaccttagcctcctgagtagctaggattacaggcacacaccaccacacctggctaatttttgtatttttatagagacagggtttcactatgttgcccaggctggtctccaactcctgggctcaagcgatttgcctgccttgggcctcccaaagtgctgggattacaggtgtgagctacggcgcttggccttttttatgtatttaatagacaccttatataaagtgcttaccccattaactaccgtcctaaaccctaattattttaaccgtcaccgcaaccccatggggtggacactgttagcacctttgttttgcagatgaggcaccttatggcagctgcccagagtcacaaggtgctagcaggtggtgtggggacattatcggaaactgggagatctgattcctaagttcacaccaaggtatggccttggtgtagcctccgggcaggccttgttttccttctcacacaaggaatcctgcctgcctgtgttcgccctctgcaggccccagcacgtggagagatagagtgtgctgttcctccacctgctagctgcttctggcccctctgcagagtgcgtgcatgcgcgtgtgtgtgtgtctgtgtgtgtggtgtgtgtgtgtgtgtgagagagagagagatgcagtatatttaagagcatctgagtgagtcacatttctaggagcctggctggcagcaaaggtaattagtatgtgagctgagtcttgtgcattcgttcacatttattcattactccttttgagaagcgcacgcctgcatcccacgggtttgttgccatatattcatcctgtcccaatcaatcctgcctcgaggctgactcgaaacctctaatctggtattgttccttctggggctcctggagagctgcccagctctcgggggtgggaggcaccaggtgcctaatttagcaggatgggggcttacctgccatggggcacagtggatcgtgggcattgcctgccttgtcttgggctggggtggggaggtgaaggagctagggctctgagttccggctctcgctgctatacgtgtccttgtgtatccagcctcagtacacccccacatcgcctgcagcactggtggaagcactggtggctggacccacgccctgagaatctgcatttctaaagagctccagggcgatgttgctgcttttgccagcccgagaaccaaacttcgatgtaaacctctcagaccctcagtttcctcctctataaatgggaatgagaacacacagcctttcggggtggtgtgaggtttggagaccacatttatccattcactcggcaactggattgtgagcactgcccaagtgccaggcactggggaaatggtgcagacgacaaggtcccgggcatgaggtaggggttgggggaagaggggaatggtgaggaacagaccaaaagagtaatacaaataaaataatctggcccagtgtggtggctcacgcctgtaatcccagaactttgggaggctgaggcgggcagatcacttgaggtcaggagttcaagaccagcctggccaacatggcaaaacctccgtctctgctaaaatacaaaaattagccaggtgcctgtgatctcagctacctgggaggctgaggcaggataatggcttgagcccaggaggcagaggttgcagtgagccgagatcatgccactgcactctagcctgggcaacagagcgagactctgtctcaaaaaagtaaaatcaaataattgaaaattgaggtacacgctacaaagatatcactcaaaagattgacaaggacagggagaatctactttgggtttttttgtttgtttgtttgtttgtttgtttttaagacggagtctcactctgttgcccaggctagagtgcagtggcgtgacctcggctcactgcaacctccgcctcctgggttcacatcattctcctgcctcagtcccccaagtagctgggatcacaggcacgtgccaccacgcccagctcatttttgtatttttagtagaaacggggtttcaccatgttggctagactggtctcgaacttctgtccttaaatgatctgcctgcctcggcctcccagagtgctgggattacaggcgtgagccactgtgccaggccagggagaatctactttgattgacttgccagtcaaaggctcagcaagtggcacttctgggactctagtgtgtagtaaaagctagtgtgtagtaaaaagcaataggacaattgtttgtgtctcgcctctcccctttgtagctgcgtgaccttggacaagcctgctgtcttccctgtgccaggttttgtctcctgtaaaatggagatagtaatagtacttaccttatagaattataatgtggatcattaggtattaatatacgcgaagtacacagagtgcctagaacatagcactgtaagggttaaccagttattgttgttgtcactttggctgcaataggaaactctggggggcatttctgaatcccccagaaatcctagatgagctgcctcagtgtcagtctgtgaggcaatgtgccacacccctcccccaaacatcctggacattgtcctatggagtgggtggctgtcacctcatgggcagccatggcaatgataatgacccacttgagacaagtggtgccatcagttgcatctgtgtgcttagatattgggtacggaggacttcctggaagaagggggccataagatgtgggaggaacattagaacttctttgttggtaagtgacagaaacccagctcaaactggcttaatccaaaaaaagcaggggctgggggagttaactggctgccggaactgcatagactaggctggcttcaggcatggatgaatccagccattcagtgtattaggactgtggtccatcccatagctgtttcctctgggacagctttactctcagacaagttctcaccctgtgtgttctccagcttcaggcctccatccttgtagtttttcaaccccagcagaaagagaagacctctttccagtgagtgctagaacaatcctagagcggattctcacgggcctggctcaggccacgtgcctttccatgaaccactcactgtggctaagggtagcataaatgctctgattggccaggcctaggacagatgcccatgctgggagctcagacgcaaggtagctctccaagggaaaatcaggtgctctttccagaaatgggagaagcggatgctgagcagcgaaaacaacagctgtcccggaagagcagagcgttccaccctcagggatgaaaacagaaagcaagagtgtatctatttcccatgtcagagaggagtcaggagctggaaacctggaccagggccatagaactctgcaccatttcagaagcttggtcgccatcttggtgttggcatcctccacataggttttctgttgcgactgcatggctgagcaggaagtgggaggagctggagaaacaaaagtcccaatttgcagccaggtctggaaaagagagaaccccctcagggagtgaatggaaacagcttcagaaggccaagttcttgcaaggagacccagggtgcaggcctgctgctgaggggcctggctggttttgtggcatcttccccatcgattctctctttacgtgcctaaaccaggcttgctccaccttggcacagttgacctgtagggctggataatcctttctcatgggagctgtcctattgtaggatgtttggcagcattgctggtctctatccccctgataccaattgcatctccctccctagttgtgacaaccgaaaatgtctctagacattgccaaatgtccccttggggtcaaaactgcaactggttcggaaccactggcctactgggtgaggaggggttggggaatcggtggtagtgaggactgcaaagcacattcctgcctgtcatcctcccagccaccctggggctggatgggattagagaggctgcttgcagcattgcttgctgaaacttgctgagaagtctcttaactgagctggccattgatgagatgtctcaggggaatccattccagggcccctccactgggtcggggactgttggcattttgttctgacacctccagttcttaaattttgatccctcgtgtgctttagtacctcgtgacaagcaattgtgctaggatgatgtttctccaaagggtggtaggttgaaatgcgcccagtgggtatgcaacatgggttacatcaacgagcgattttattttatttttatttatttatttattgagacagagtcttgctctgttgcccaggctggagtgcagtggcaagatcttggcgcactgaaacctccacctcccaggttcaagcgattcttctgcctcagcctcccaagtagctgggactataggcacgtggcaccacgcccagctaattttttttatttttagtagagacagggtttcaccatactggccaggctggtctcaaactcctgtcctcaagtgatcctcttgcctcagcctcccaaagtgctgggattacagttatgagccactgcacccagtctcaatgagcaatttaaaaatgtctggagataaatacttgaatgtgtttggttttcttgtaagtgggttgattcaaaagttaagtaaataaccgcccaggtggtgtgtggacaaagcataagtagctgtggtggcacgtcagtgaccgacgtggcaggaccacgaataagtgctggattgcaggccgaccgatgcctggggtgcatcctcaccccggaaggtacctgagcaggatgctggggcggaatgctggccggatgccttctattctgaggctgcctcctctcatcagtaggcaaaggacatgagcccgacagccccaggcaccttttccttcagtaacatcaataatttatgccactggaaagcctcacagccagggcaggatctgagatgctcacaggatctctgtaacagtgaggtggtcgataccgcatttacttagggaagccccagggacgtactggagcccggggagagcagctggtcacaaccccacacgtgggttgagctggggcagtaagtctggcttgagaggccaggaaacaagcatccagccagctgtgcgggctgtggctttcctaaagaccaggctcccttcaaaagcaaggggccgttagagaaaaaaaaaaaaaaagggaaggagctggtagccgtgaggtaggggacagtcctcactatgtttctcattcattcagtatttactaaacatcgtgccaggtgctgtgtgtcgagcttgagtctacagccatggttctcatccaggtgattttgctcccccaggggacatctagcactgtctagagacattttgggttgtcacagttggaggaggggacgtgctaccggtatccagtgggtagaacccagcgatgctgctaagcatcctgcaacgcacagtcccccatgacagagaacaacccagcccaaatgtcagtcgtgccaagactgaaggagccttgtctgccggtgaacaagagagaccatgtccctgccctgccacgtcttgcaatggaggaagtgaggatgggaggacaggaggaagggaaggcagaaacaaagtaaacagccaaaaaatgacagacgtgattagaccagaggctgtggtggagaggactggggtgtgaccttggccaagtctgagttgatggcatcagagctgagctcagcactgggaggaggagtggccaggcagagggagcagaggggcaagaggagacttgggttaggcccatcgctgaggctgctgtgtggactccagctcgtatatgggcaagagagagggcagcagggagaattctgcaggtttcccagggagagaggcactctggggaatcctccagagatgttctagagagcgagcgtgggaggtgagggagagacgcagcctggaaccaaggaagacagctgcttttgtgtttactacatttgaaatgctgggattccagcactttgggaggccgaggcgggtggatcacctgaggtcaggagttcgagaccagcctggccaacatggtgaaacctagtctctactagaaatacaaaaaaatttagccaggcgtggtggcgcacgcctgtaatcccagctactcaggaggctgaggcaggagaatcgtttgaacctggggaatcagaggctgtagtgagcctccgattgcgccactgcactccagcctgggcgacagacagactccgtctcaaataaaaacaaaaaaggaaagaaatgctgggagcccgcggagtgaggtcgcacccaggagttgagttgtgtgaccttgtgcaaaggttgtcacctcctggagactctgtattgtcacctgtaagatggaggtcctaataggagctgtctcacagggcattgtgaggactggatgtgtccaattcctggctgttagctgttagcctcgagaggctgagaccaggtaatgtgtgccactcattctcccagtgcagcacttggcctgtggctgtgtctttaaagtttcatttttttccccttatttttctttctttggtttttttttttttttttggagacggagtctagctctgtcgcccaagctggagtttagtggcacgagctcagctcactgcaaccttcgcctcccaggttcaagcaattctgctgcctcagcctcccaagtagctgggattacaggcgcccgccaccatgcccagctaatttttgtattttttagtagagacggtgttttactgtgttggccaggctggtcttgaactcctgacctcgtgatccgcccgcctctgcctcccaaactgctgggattacaagcatgagccaccacgcccagccttcctcttatttttcaagaggtcagatgtggcacagagtatccaattcaaagaatacaaaagggtatacagagaagttggcctccctcctaccctgtccttcagccaccagtgatgatgattcacggttcttcactgcacccagccaagggtacagatgggtcccaaaacctccgtgcctgaggaaaggagcacgttttcctatgtgtgcaaaggtgccgtgtgcgcttgcaggtttgaaatgaggcgagtcttcttcaagaagtcaggagagggggagtcttccaatgaattcatctttccttccccccaaccattcccctcttggcttttctagaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcaggtaaagtgggcaccacccggctgggtcaggccgggggaccattcatctcaaaagatactcttcttcctcttcagtggggatgggcggtcccagtacctggggcagtcctagcagatcagaacccacaaatgttgactcctgggctgaaactgacccagatatgggtttgggttgtttgtttgtctgtttgtttgagacagattttcgctcttgtcacccaggctggagcacaatggtgcaatctcagctcactgcaacctccgcctcctgggttcaagtgattctgctgtctcagcctcccaagtagctgggactataggcgtgtgccaccacgcccagctaatttttgtatttttagtagagatggggtttcaccatattggccagcttggtcttgaactcctgacctcagctgatatgcccacctcggcctcccaaagtgctgggattacaggagtgagccaccacgcccagcagggtttgggttttttgttttttgtttttttctttctttctttttttttttttttttttgagacagggtcttgttctgttgcccaggctgagtgcaacagtgtgatcatagctcactgcagcctcgaactcctggctaaagcaatcctcccaactcagcctcctgagtagctggaactgcatgcatacgccaccatgtccagctactttttttattctttttagagacagggtctcattatgtggcccaggcaggtctcaaactccggggctcaaatgatcctcccgcctcagcctcccaaaactctggcatgagccactatgctcagcctcagatatggatttttattaagctttttttttttccctaccaattgccagccaatttattttaaaaatacaggtttctggcttcttttgcaaagtcaaatctggcaacactggaccaacatttccaccaggctgcaatggtctgaaactgacttgagcccatgtgcactggaagggccctgcctctggcccctcctggacttgtggctgccctttagatgggaatccacttttctgttcaccgcactctctaccgctctctattgcacctgacccagctgctatataggatagtaacattaattccctggctcccccaaagcatttgagtcttcaacccatgtgctggatggatgtagggggccacagcggggattgctcccatcccctctcctagctcagttaccgggaatgtactaatttgggccctggaggcagatgtctgcgttcaaattttgcctctgccacttcctagatgtgtggctttgaggaaattatattactttcgtgagcctcagtttttctcatctgtgaactagaaatagtaagagactgtacctcatagagctgttaggagaaggaacacagtgagtacaaagccctcttggtacctggtatgttctctgtgcatctgacttggcttccactgaaagaagaatctgagacacaagggctccagtgcaggtggtttcgtggggaagtggtccctgcaagggagaggacagggagaatgagactgagaaggcagagaagataaaacaagcacattaatgagctagttactaccacgggcaacaggggctcatttgtgctgggaatcctctgaggacatatgctgaatgagcctcagaattggtccaggaagaaaaggaggctggggcatctgtccacaggctcccatctcccagtgttatttggttttggttttggttttttatggattgagtctcgctctgttgcccaggctagagtgcagtggcacaatcacagttcactgcagccttgacctcctgggcccaagcagtcctcccacctcagcctcccgagtagctgggaccacaggcacacaccaccacacccagttaacttattttttatttttgatagacatggggtctcactctgttgcctagggtggtctcgaattcctgagcccaagtgatccccccacctcagcttcccaaagtgctgcgattacaggcatgagccatagcactgggccccccagtgttattaacatcccctataattctggtgactggggtggataagtatcatcagttccaaggcagaaaaacagacttgctgagcgcttgagatggatgttatctgggtacccaggactatctgctactgctgcagggggcttcagaagtgaggtcctatctaggggatgtggcataggaacccaataggacctacctaggggatgtgatacaggaacccaaatcccctgctattgatacttgaaaagtatctcgtagaatcattacttgaagggagtcagccagggtcccagcacttgagattaaataaacttgccctttctcggttctttgaagatgcatcaggggctacaacattaataataataataactagtattgtcatcatttgttgagcactaactatgtgtcagacactattgtgaatctgtcttttttttttttttttttttgaggcagagtctcactctgtcacccaggctggactggagtgcagtggctctatctcagctcactgcagcctccacctcccagcttcaagtgattctcctgcctcagcctcccgagtagctgggattacaggtgcatgccatcacgcctggctaatttttgtatttttagtagagacagggtttcaccatgttgcccaggctggtctcgaactcctgacctcatgtgatccgcctgccttggcctcccaaagtgctgggattacagacatgagccactgcgcccggccactattataaatatttgacctgcattagctcattagtcctcactaccacctaatgaggtaaatcttgttattatccccatcttatgggtgaataaatggaggctctgagaattaaatgacttgtccgaggacttcagattgtcatgattccctcttcagtgacattcacccaggaggctggtgcatgggccatgctcagcagctgcttatcctatccaaggccatccacatccctctgtcccgcgtggatgggccccctccccctggccagatctctaggagggaacgccagtggcctctccgctagatagggctggaaatcccagtgtggctttatcagctgctctcttcttaccaggaagctccaggttggcaagcccgtgtttgttgagatttggcagggatggcagagtcagcccagcttggaggctggctccctgggatgccagaagatagggatcaggacagagatcagcactgggaacccagaggacgggcccttcagggaatgtcgtgagcagagatcgggagctggtcagttcctgggttcctggttgggccatctctctgctggcccaaactccctctggaactcaaaaatagcaagaattcctgaaacggatacaaacttttatacattcatgttttcttttttctttcttttttttttcttgagatggagtttcactcttgttgcccaggctggagtgcaatggcatgatctcagctcaccacaacctccgcctccaggttcaagcaattctcctgcccctgcctcctgggtagctgggattatagccgtgtgccaccacacctggctaattttgtatttttagtagagatggggtttctccatgttggtcaggctggtctcaaactcctgacctcaggtgatccacccgcctcggcctcccaaagtgttgggattacaggcatgagccaccgcacccagccccctttttcgttttgttttgtttttctagatggagtctcactctgtcacccgagctggagtgcaatggtgtggtctcagctcactgcaacctccacctcccgggttcaagcgattctcctgcctcagcctcctgagtagcaggactacttgagacggacacttgagatgtgcgtgccatcacacccggctaatttttgtatttttagtagagatgggctttcactatgttggccaggctggtctcaaactcctgacctcacgatctgcctgcttcagcctcccaaagtgctgggattacaggcgtgagccaccacgcccggccttggagcctcttttataaggacacgaatctcactcacgaagcctccaccctgatggcctaatcacctcccaaaggctctaccatctaatatcatcacactggagacgaggttttaacatatgtttctctagggaattgttctatggctttgtcagattctcaaagccacccatgacccccaaaaggtgaagaaccagtgtgttgttgaacatgatgattccgtttcttgaagtaaaaccacgatgccagagctacccaagtatcatggcctttacagtgtaagataactaacctctgttgggggcttcctgggggcccggtatcattctgagcattttagtggctgatctcttttaatctctacaataactgcatgagttctgatttgcagataggaaactgaggcacagagaggctaagcagtttgcccaagaggcagagccggaatttgaacccaggcagaggaagagtttaaatccaggcagagccaagagtttgaacccaggcgggatagctccagagcccgcatgcctgacccctgtgtcatggaattaccctcctctccataaagcgcttaagcgcccctcatctcactgaggtgtcaggaccactctgtgcatttggaaagatgaggactataagacccgttttacagagtggaaaactgagcccggggatgtcaggcaacttgttcaagcataggctataaatacacggcagagcaggaagggaaaaagttggtttcctgaattccactactgacatcctttcttgtaaaaatgcagccaagactttatagccagataagatccagagatgcaagggctctgggacccaggttggtgtcagcagagctggggctggcgcggggatgatgaagagtccagacttatcaataaggtgcggcacaccttatgtgtttcacatctgtttcatagtgacacattccgaagccaaggaagttgtctttctattcccctctttcttttccaaagcaaaaatatttattactccttcttggtggcaaataagcaacaataatcatatagaatcagtggaatcatgtaggttcaacaagtaaaaataatagccaggtgcgctggctcacgcctctgtaatcccagcactttgggaggccgaggcgggcagattgcttgagctcaaaagttggagaccaacctgggcaacgtggcgacacccctgtctctactaaaaatacaaaaaataataaaataataataaatagctgggcatggtggtgcatgcctgtagtcccaggtactcgctcgggaggctgaggtgggagaatcgcttgaaccggggaggcagaggttacagtgagctgagatcgcgtcactgcatcccagcctgggtgacaaagggagaccttatctcaaatgaaaaataaaataaaacaataataaacaaaaatttcttaaaatccctttgcccaggggcaacggtttgcttccacactcacacacaatggggcagagtgcgtcttaaccaggctacacattacaatgacttggggctgctttaaaaaattaccagtgcttggccgggcacagtcccagcactttgggaggccgaggcaggcggatcacaaggtcaggagtttgagaccagcctggccaatatggtaaaaccccgtctctactagaagtacaaaaaaattagccgggcgtggtggcgcatgcctgtaatcccagcttctcggaaggctgaggcagaattgcctgaacccgggaagcggaggttgcagtgagctgagatcacgccaccgcactccagcctgggcgacagagtgggactccgtctcaaaaaaaaacaacaaaaaacaaaaacagtgcttgctcaactgtgattaagtctgagtttggtattaggtattttttaagctctccaagtgattctcagatgtaaccaggttgaaaccgctggtctaagtgacgttcttcagcgtgcttgctttaaatcaatgttacagaggtaactgcagagctacagtctcctttttttaatcttcagctggtgaatattctgcctgcttctgactctcaacgataaacagtgctgcaatgaacattcttatgcattcatcttcaggcttttgatcaattcactccttgcaaaaaaatttttctaaatgtgggttaaagagcctgcacttcaaatcttgatacagtaaagtcctcacttgacattattagcaggttcttgtaaactgcgactttaagtgaaatgatgtataataaagccagttttttcctcatcaatttcagtagcaaaacaatgacactatttgaggatctcttgtatgttccttcacttaaagtcagagttttcaagaaccttttgatggcatcaagtgaggaattactgtacatatggccagatggcaccccagaaaggtagaccagtggactgtccttccccttgataaacgcatcgaagccccatctctccacctcttcagcaaccttgggtgttgtcagacctttttaaaaatagacttcttttgaatcatcccaaatgtgtgtccaccaaaattcacatgaagctgggtgcagtggctcacaactgtatcccagctctttgggaggctgaggcaggaggattacttgagctcaggaattttgagaccagcctgagtagcatagggagaccctgtctctacaaaaaaaaaaactaaaaataagccaggcatggtggcgtgtgcctgtagtccctgctacttgggaggctgaggtgagagagtgacttgagctacggaggtcgaggctgcaatgagccgtattcacaccactgtaccccagcctgagacagagaccctgacaaaaaaaaaaaaaaaaaaatgagaccgggcaaagctcccacagaaaggctaagttggagtcctggctagatggcctttgttctagaaacccttgctttgctggctggggactatctggcatgctcccttgccacaggaggagcagccgttggcatctttggtgctgacctcagccagcttgtattttaggaaccaggccccatgaggcagaggccttatccttgagcccttgggtctcacagaatcgccggtgcccaggagctatggttggcccagtttctcttgcattttagccttttgggctctcttcctttgagagtccatccttgacatgctcatgcggtgggaagggcattctccaggctggcctgtggctttgccaagccccagaagcctccacaccctatatccttccactgagtgagacctcagatagatacaacttcacccacctgctgcttattagtaagtatcaacaaggcataaggtatgtgataaaagattaaaatacactgagagatgtagcacctcgaatcacatcttggaaagcattaacaaggcacatgaaatgttggctttcaacagagcaagaaagaaaagtgttctttcctctattaggggctttgggctgtcagatctcattagggccaaggcctatttaaaacaactttttgcttcttgctagaaggccccgagttggctttgggggcaaggccagcctggcatcacatgcagggtctatgcaagaaaaggctggcatccagccatttgagctttgattcctaaggggacctcttgtcttaggagaggtcctaagcaaggtgggtgagcctggcttgcctttgtctctggcccaggtgtgggtagggtgttagttgggcttcttgaagtaagttgcaagtaataaaaaatccaatgtgagtaggctaaagcagctgtccccaaactttttggcaccacggacaatctttccatggatcaaggttgcgggggggttggggggcggtttcaggatgaaactgttccaccttagattgtcaagcattagattctcataagaagcgtgcaacctagatccctcacatccacaattcacagtagggtttgaggtcctataagaatcgaatgccagctgggcacagtgactcatgcctgtaatcccagcactttgggaggccgaggtgggtggatcacttggtcaggagtttgacaccagcttggccaacatggtgaaaccctgtctctactaaaaacacaaaaattagctgggcatggtggcacgtgcttgtggtcctagctactttactcaggaggctgaggcaggagaatcgctggaatctggcaggtggaggttgcagtgagccgagattgcaccactgcactccagcctgggcgacagagcgagactcttgtctcaaaaaaaaaaaaaaaaaaaaaaagaacacagattccttgcctgggtcccaatgctgactgtgccccttaccagctgtgtgaccttgggccccaagcaaagtgccccaagcaaagtggacataatgaaagtacatatagtcagcctgggcaacaaagtgagaccccgtctctaaaaaaaaatattaaaaaattagccacgcatggtggcatgtgtctgtagtcccagctactctggaggttgaggcaggaggaccacttgagcctgggagttcaaggctgcagtgagctatgatcgtgccactgcattctagcctggacaacagcaataacttgtcaaaaaaaaaaaaagtagctatcgtgcgatgaaaattaaatgagttgaaaagaaagaaagaaaattaaatgagttaatggttaatatatataaagtactttgcacagtgcctggctcctggttggcgctctgtgaagcttaactgtataactaaggtgattttggtccctgccccaagtaatttgcaaaacaaacaaacaaaagcaaaaacaagctctcttgttgctttttagccagaaaagtggctcccttcagggaagactttttgtgtgtgagacacaatttcaccaggctggagtgcagtggtgcaatcttggctcactgcaaccttaacctcccgggttcaagcgattcttgtgctgcagcctcccgagtagctgggattacaggtgtgcaccaccatacccggctaatttttgtattattagtagagggggttttgccatgttggccaggctggtctcgaactcctgacctcaagtgatccacccgccttggcctcccaaaatgctaggattagggattacaggcttgagccactgcgcccggcttctaccctttttttttgtttgttagattcctccatgtcttttcatgttagcttttctttaacaaaaaggaagttcaaatctctaaaagttcagtaaataagaaacaccggttttacccatctttcagagggaaaaagtgccgacatgccatcttggctttaggtctcccttttattcttgtttggaataaccctacacatgtggttagagtccccctgttctcatccctggtcactttccagtgaagactcttagcagcttcctcctcagtgtgtgtccagaaacagcaagcagttttgagtagtgtgatgctgaactttacatgaatggctttctgtagtgagaaggcgcctgtcacccgcggcctgcagaggctgcgtggcttggagggggaaccagaggcccaaccatgggcctccttcccctggtctctacagcagcttttcccaaacccactgagatgggtcaggctcctagagagcctgagaacaaagcccctttgtgacttttgttttgaatcaggcttgtgacaaaggggaggagccactgggttgggtggatgggggtgcccggagcgcgctgttgttgcaggggaagaaaacaaaattgtgtcttttttttggcaatgttgtcttgccaatccctccctcccccagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccgtaagtatcaagatgtgatgtgggggtaggaagcctaggagtctacggtgtcggggagcagcttcaacagggacatactcctccatggaggctgcccatgtggcctgcaaggaccgccacagctcaaacgcatgcaatgcttttatttttcttctttccctttctaccccttttctccacacacagaatacccacctctatttagaaaaccatctgtagattcgtttgaaagagtttgtaatccttgaggctgttggacccagtgaattatttggctttcactctgtccctgggaggtgacttttggaaaaagcccagaatgatggagcgcccctagcagattttgctgacatccagcctagtttaaggtccccggtcacccctctgttgactcctccccagctgggtaccaggttctcccattccctaagagatgtcttaagaaattgaagcagttactgtttctctccctcaaacacagaagcaggtttactactatctgatgccaaacagaccttcagcagaattgtcattgtttacgtttgcctccttggaatgacaccattttgtttctccagcaatccaaagatgcactctcatctccacatttaatttccaaacatagctacatgcttctttcagaaacaaggtctgagccagtttacatgtgtaaattgggtttccattctttatatcatgttccaactccataactcaacctgagcattcttctttttttttttttttttatgtaaatcagggatggtctttgatctctagagggaatttaggttttcctggccttttgaatggtatgctaggcattggtttgcattggtttggaacaggctcaaagacagaatcacagatttgcattcttaaaaccccctgccaacgactgggctgttttattgtcccgagccaagaaaagcctgattcacaagcattcggcctgtgtgttataataaatatgcttagaaaagcccccatccgtcactcttaagccctcctggttccttcaaggccagtgtgtgaaaaaatagtcaagactgaaagtgaatgagttgaacttacattccttacgggtggatggttatagaaaagggagctgggcttcccaagaaccacagcagcatgactcacagtcattgctgcctctcctgggaattattcgacccatctaggtaaaagcaaggtaacttatttttgccgcgttgtttacgcatcggtttctagtgttgactttgcaaagcacagagttctcagtgtgttatccttatgtgttattccagatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctc
